United States Patent 11,098,302 (IDENTIFICATION OF POLYNUCLEOTIDES ASSOCIATED WITH A SAMPLE) - sequence listing, part 4

SEQ ID NO: 9815 - DNA, 537 bp, Homo sapiens
  misc_feature: GYAE6OF01BH777.53.73.G07.1.454.CMB.1.raw
  modified_base (413)..(413): a, c, t, g, unknown or other
  misc_feature (413)..(413): n is a, c, g, or t
  modified_base (466)..(466): a, c, t, g, unknown or other
  misc_feature (466)..(466): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgtactcccttatacattgggtacacaggcccctggacaggggcttggagtggatgggtctaatcaacctagtggtggatctacaagttactcaacagaagaatgcgagggccgaattaccagtgaccagagacacgtccaacgagtaacagtactanatgggagtgagcagcctggagtatctcggaaggcacggccagttgtagttacngttgcggtacttagttaagtcgggtaattaacggaacttactaaacgttagtttttcgcgtaacgtacccg

SEQ ID NO: 9816 - DNA, 644 bp, Homo sapiens
  misc_feature: GYAE6OF01CZWM6.53.73.G07.1.454.CMB.1.raw
  modified_base (231)..(231): a, c, t, g, unknown or other
  misc_feature (231)..(231): n is a, c, g, or t
  modified_base (321)..(321): a, c, t, g, unknown or other
  misc_feature (321)..(321): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacagtcggggctgagatagaagacgccgtggggcctgagtgatgtactttccngcacgacatcgtaggactactccttaccaccgtaccgttacccttaatacgtagttagggtaccaccgtaccggccctaggacgtgggtntgaggtggatgggttactaactacctaaccgtaggtcggtagtacttacgtaactacgtttacaccaagagagaagtcggacgtacgggaccttaattaccgagtaccgaacgacgaacgaccacgtaccgaacgtaagtacgtagtaccgaacgtaggtacgggaggtacggacgacggaacgtcgtagacgtacgtcgtacgggagtacccgacggtaccgtagttacggttagttacgtgttacgacgttcgtacgttaggttacgttaacgttacgaaccgtttattaacgtttacgttttacgccgtacggtaaccgg

SEQ ID NO: 9817 - DNA, 720 bp, Homo sapiens
  misc_feature: GYAE6OF01DJ452.53.73.G07.1.454.CMB.1.raw
  modified_base (170)..(170): a, c, t, g, unknown or other
  misc_feature (170)..(170): n is a, c, g, or t
tcagcgcgtatacacacgaccggtgctcgatttagctctacgctcaggggatcatccaacaaccacatcccttctctacagaagcctctgagaggaaagttcttcaccatgactggacctggagggtcttctgcttgctgtcagtagctccaggtgctcgctcccaggtncagctggtacaagtcggggctgagagtagaagacgccgtggggcctcgagtgattgtactttcctgacacgactagtcgtaggacttaccacccttacacccgtacttacccttataacgtagttcgggtaccacgacggccccgtaggaccgaggggtcttaggagtggtagtcgggtactaacgtacctaaccgttaggtggtacgtacttacgtaactaaggtttacctacgaacgtaaggtaagtaacgtacgggaccgaacggggtaaccctaaattacccgaagttacgaacccgtaggaaccgtaaccgtaccgttaaccgaacggtaacgtaacgtacggtactaacgagtacgggaggtacgacgtcgtaacgtccgtaggaacgtagtaccggtaggaaccggacgaccggtacgtagttacggttaacgttacggtacggtacgtaccgttaagttacggttaagggtaccggttaaacgtttaacccgtaaacttaagttaaactttacggttttacgacccgtaccggtaacccggg

SEQ ID NO: 9818 - DNA, 773 bp, Homo sapiens
  misc_feature: GYAE6OF01BXIJ4.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctcccttccaccctgtctgcatctgtcggagacagacgtcaccgtcacgttcggccgggaccagacctaaaagttacttaacggaccgttggttcggccttaggtactcgagaccaacggtaaacccgagggaaaccgcccctagacctccgtagactactaagtaacgtaccgttacttaacgtttaggacgtacgggttaccgggtacccctagttaccgtaacggttcaacgggtccggacgtaaggttcggtactaccggtacggggaactacggttacgttaccctactacccgtaccgtaacttacggttaacgcccgtaacggtcccgttacggacccgtacgttaccgtagttaacgtttacggttaacgttttaccgaaaccgttttaactttaaccgtttaccgaaccgttaacccgtaaaacgttacgtttaaacgtttaacgttttccgggtttagggttaccccgggttacggttaacccgggtaaccggtaacgggtaacccgtaaggtaaccggtaaactacggaaacgttacgttggtaccgcgttagaccctaactgttacctcgttacctactaccgttccctaccggcttacg

SEQ ID NO: 9819 - DNA, 777 bp, Homo sapiens
  misc_feature: GYAE6OF01CW5WO.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggactggagggtcttctgcttgctgtcagtagctccaggtgctcgctcccaggtgcagcgtggtacgaggtcgggggctgagagtagaagacggccgtcggggcctcgagtgatgtactttccgtcgacacgactatcgtaggtacctaaccgtacccttaccgaacccgtaccttacccttaacgtacgtacgtttacggggtaacgaccgaccgggtcccccgtagggaccggtacgggggtcttagggaggttggggtaagttcggggttaaccttaaacgttacccgtaaacccggttgggttacgggtaggtaacttaccgttaaacgtaaacggtttacctacgaacgaaggtaacgtaagtacggacgtaacggggtaaccctaaacttaccgaagacgaacgaacgaacgaccgtaaccgtaccgaacgtacgtaacgtacgtacctacgtacggtagggtacggtagaacggtcgacggtacccgtaggaacgtacgttcggtaagggacgtaaccggaccggtaccgtagttagttaacgtttacgtcggttacggacgtttacgttacggttttaagggtaccgttaaccgttaacgttaaccttaaacgttaacgttttacgtttacggtaaccggtaccggtaaccggg

SEQ ID NO: 9820 - DNA, 791 bp, Homo sapiens
  misc_feature: GYAE6OF01CEMMV.53.73.G07.1.454.CMB.1.raw
  modified_base (215)..(215): a, c, t, g, unknown or other
  misc_feature (215)..(215): n is a, c, g, or t
  modified_base (230)..(230): a, c, t, g, unknown or other
  misc_feature (230)..(230): n is a, c, g, or t
  modified_base (410)..(410): a, c, t, g, unknown or other
  misc_feature (410)..(410): n is a, c, g, or t
tcagcgcgtatacacacgaccggtgctcgatttagctctacgctcagggggatcatccaacaaccacatcccttctctacagaagcctctgagagaaagttcttcaccatgactggacctggagggtcttctgcttgctgtcagtagctccaggtgctcgctcccaggtgcagctggtacagtcggggctgagatgaagaagccgtggggcctanagtgatgtatttccngcacgactatcgtggataccaccttccacccgtaccttacccttatactagttggggtaaccgacgacggtcccccgtaggaccggtaggggctttaggaggtggtagtgggtacttaacgtaccaacccgttaggtcggtaggacttacgtaactaaacgttacgtacaacgaaggaanaagttcggacggtaacgggtacccgtaaattacccgaagttacgaaccgtaaggaacgaaccgtaaccgtacccggaaaccgtaacggtaacctaacggttaccctaacgtaacgggttaggggtaacgggttacgaacggacgtaacggtacccgtaagggtaacgtaacgttccggttaagggaaccgggtaaacccggtacccgggtaccgttaacggttacggtttaacgttttacggttacgggtacggttaccggttaaacgttttacgggtttaacggttaacggggttaaactttaaacccgggttaaactttaaaccgtttaaagttttaacctttttacgggtaacccgtaacccgggtaaacccccgggg

SEQ ID NO: 9821 - DNA, 686 bp, Homo sapiens
  misc_feature: GYAE6OF01BV25N.53.73.G07.1.454.CMB.1.raw
  modified_base (184)..(184): a, c, t, g, unknown or other
  misc_feature (184)..(184): n is a, c, g, or t
  modified_base (295)..(295): a, c, t, g, unknown or other
  misc_feature (295)..(295): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccgaggtgccaaatgtgacatccagatcgaccctagtctccttccaccctgtctgactntctagtcggaagacgagagtccacgtctacgttcgccggcacgaccaagtatacgacgttgtggctagtatacagacaacgaaacgaggaaacgaccctaagtactcctanactactaataacgtactaccgttattaaggacggtacggtacggggacctaagttacgtaaacggtcgaacggtacggtacgacggtaggtactacgtaggtaactagttacggttacactctaaacgtacgtagttacgacgaagtcctacggacaacgtacctagggtattacgggttaactttcgaaacttaacttaacgtttaccggactaaacgaaaccttaggtaaacctaagtttacgttggtaaccggtaggttaacccgggacgtaaaaccgggaacgttaacgggaagttaaacggaaacaaacggtacgttacggacgttaggacgtaaccagttaccgactttacgtaccactttaaccgccctacccggtattaccgg

SEQ ID NO: 9822 - DNA, 541 bp, Homo sapiens
  misc_feature: GYAE6OF01EXLLN.53.73.G07.1.454.CMB.1.raw
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
  modified_base (382)..(382): a, c, t, g, unknown or other
  misc_feature (382)..(382): n is a, c, g, or t
  modified_base (414)..(414): a, c, t, g, unknown or other
  misc_feature (414)..(414): n is a, c, g, or t
  modified_base (419)..(419): a, c, t, g, unknown or other
  misc_feature (419)..(419): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagaccaaagtattaagaccgttggttggcctggtatcagcaaggaaaccagggaaacgcccctagacctcctgatctataacgacgttctacgtttagacaggtcgggtccatcgaagttcagcgcagtgatgngganagtagtcactctacaccattacgcagcncgcacgctgatgtatttcgactattactctanaccanagtactattacttggtagtcgtacgaccgaaagggtacccaaggtacgaactacgaaacgtacgtggtacggcctagaccctactacgttctacgttccttactacttcccttcccgctacg

SEQ ID NO: 9823 - DNA, 739 bp, Homo sapiens
  misc_feature: GYAE6OF01DEG3U.53.73.G07.1.454.CMB.1.raw
  modified_base (243)..(243): a, c, t, g, unknown or other
  misc_feature (243)..(243): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagcctccgaggtgctcgcctcccgaggtgcagcgttggtacaaggtcgggggctggagataggaagacgccgtggggcctgagtgatgtactttccngaccacgactatcgtagtactacctacccttccacccgtaccttcccttatacgtagttacgggaccgaccgacgggtcccctagggacggtacggggtcttgggaggtggtacgttcgggtaccttaacgtacccgtaacccgttagggtcggtagtaactctaacgtaacgttacctacgaacgaggtaagtaacgtgaccggaacgggtacccgttaaacttacccgaagttaccgaaccgtaacggaacggtaaccccgtaccgaacccgtaacggtaacgtaacgtacgttaccgtaacgtaggtacgggtaggacgaacggcgaaccggtacgttaggacgttacgtacggacgggaaccggtaccgaaccggtctaggtttacgttacgtttacggtgtacggtacgttactttacggttagggtaacgttaacgttaaccgttaacgtaaactttacgtttagtttacggaccgtccggtaacccggg

SEQ ID NO: 9824 - DNA, 140 bp, Homo sapiens
  misc_feature: GYAE6OF01BJMZY.53.73.G07.1.454.CMB.1.raw
tcagcgcgtatacacacgaccggtgctcgatttagctctacgctcagggcacgaccggtgctcgatttagtagtgtagattcgcgggggatggcctccctcgagtctacagtgctctgagcgggctggcaaggcgcatag

SEQ ID NO: 9825 - DNA, 718 bp, Homo sapiens
  misc_feature: GYAE6OF01DK8Y7.53.73.G07.1.454.CMB.1.raw
  modified_base (252)..(252): a, c, t, g, unknown or other
  misc_feature (252)..(252): n is a, c, g, or t
tcagcgcgtatacacacgaccggtgctcgatttagctctacgctcaggggatcatccaacaaccacatcccttctctacagaagcctctgagaggaagttcttcaccatggactggacctggaggtcttctgtcttgctgtcagtagctccgaggtcgctcgcctcccgaggtcgcgagtcgtaggtaacgaaggtcggggctaggagagtaggaaagacggccgtgggcctagagtgatcgtactttccgngacacgactatcgtagaactacctaccttaccgacctaccttacccttaatacgtaggttacggaccgacggacccggtcccgtaggacggtagggtcttggaggtggtagtacgggtactaacgtaccgtaaaccgtaggtaggtacgtaacttaaccgttaaacgtaacgttaactaccgaaacgtaaggtaagtaagtacggaccggaacgggtacctaaacttaaccgaacgttaaccgaacgaacggaacgaaccgtaaccgtaccgaacgtaacgtaaccgacgttaacgtaacgagggtaggacggtagacggacacggtaccgtaaggcgtaacgtcggaacggaacggaacgtccgtatacgttaggtacttagtggtacgacgttagttacgtaaggttcgtaacgttaacttaacttaaacgtttactttaagttccgaacgtaacggtaccggg

SEQ ID NO: 9826 - DNA, 723 bp, Homo sapiens
  misc_feature: GYAE6OF01A791I.53.73.G07.1.454.CMB.1.raw
tcagcgcgtatacacacgaccggtgctcgatttagctctacgctcagggggagtcagacccagtcaggacacagcatggacagtgacgggtccccgctcagctccgtggggctcctgctgctctcggcctcccaggtgccaaatgtcgacatccagatcgacccagtctccttccaccctgtctgcatcgtgtcggagacagcgtcaccgtctacgttcggccggaccaacgaccgtaaagttacttaacggaccgttcgggttcggaccgttggtactacgacgtacgaacgtaaaccggaacgggtaaacctccccgtagtaccgttccgtaggtactacgtaaacgttaacggtaccgttacgttaacgtttagaaccgtacgggtccgggtaccctaagtaccgtaacgggtaccaacggccgggtacgaggttcggtacgtcgggtacggacctaggtaacgttaccgacttaccgtacgtaccgtagttacgcgtaaccgcctaagccgacgtctagtattgttaactttcgaacttaagttactaccgtcgtaacctagtaacgtaactaacgttcggttaccgtaggtaccggtacgtaccggtaaacgggtacgtaaggtacgtaaacgtacgaaacgttacgtggtaccgcgtaccgactaacgtcccgttagtcgttaccttacgtaaccgtttccccgtaccgccttaacg

SEQ ID NO: 9827 - DNA, 709 bp, Homo sapiens
  misc_feature: GYAE6OF01B7KZO.53.73.G07.1.454.CMB.1.raw
  modified_base (239)..(239): a, c, t, g, unknown or other
  misc_feature (239)..(239): n is a, c, g, or t
tcagcgcgtatacacacgaccggtgctcgatttagctctacgctcaggggatcatccaacaaccacatcccttctctacagaagcctctgagaaggaaagttcttcacatggactggacctgggagggtcttctgtcttgctgtcagtagctccaggtgctcgcctcccgaggtgcagctggtaacaaggtcggggctgagatagaagacgccgtggggcctgagtgatgtactttccngacacgactattgtacggtaactacctaccttaccgaaccgtaccttacccttaataaccggggtaagtttcggggaaccgaccgtacggacccccgtagggaacggtcggggtcttaggaggttaggtaagttacggtaactaactacccgtaaaccggttaggttcggtagtacttacgtaaacgttaacttaccgacaacgaaggtaacgaacgtggaaccggtaagggtacccttaaattaccgagtaacgaaccgtaagacgacccgtacgtacaaacggtaatacgtaacgtcctaagaggttggacggataacggcacggcttagaaatcggtacagggtaaaccgactacgtaccttagttaccggtaattcgtaaggtccgtagtacttatttaggggaacgtactttaacgtaactttaaacgttacttttaaggtttcgaaaccgtagtaaaccccggg

SEQ ID NO: 9828 - DNA, 616 bp, Homo sapiens
  misc_feature: GYAE6OF01E2URD.53.73.G07.1.454.CMB.1.raw
  modified_base (274)..(274): a, c, t, g, unknown or other
  misc_feature (274)..(274): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagcagagtcaccgtcacttcggccggccagacctaaagtattaagccgtggttcgcctggtatcagcaagaaaccgagggaaacncccctaagacctcctagatactaataacgacgttaccttactttagaccgtaggtcggggttcccctaattacgaacggttcgagcggcgaggtcggatcgtagggactaggagttcactctaccacctattacgcagcctgccagccgtagattagttagtttcgaccttaactttattacctacgaccaacgtacgtaactaatttcgttggtacggtaccgttccggaacggtaacggtaaccgtaaggtacggaaaactaccgaaacgtacgtaggtcggacgttgaacctcccgtatccttcggttaccttactaacgtttccccctccgtcctacg

SEQ ID NO: 9829 - DNA, 741 bp, Homo sapiens
  misc_feature: GYAE6OF01CDUHD.53.73.G07.1.454.CMB.1.raw
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (253)..(253): a, c, t, g, unknown or other
  misc_feature (253)..(253): n is a, c, g, or t
  modified_base (274)..(274): a, c, t, g, unknown or other
  misc_feature (274)..(274): n is a, c, g, or t
tcagcgcgtatacacacgaccggtgctcgatttagctctacgctcgagggggagtcagacccagtcaggacacagcatggacatgagggtccccgctcagctccgtggggctcctgctgctctggctccaggtgccaaatgtgacatccagatcgacccagtcctccttccacctgtctgcatctgtcganacagngtcaccgtcactggccggcagcaatntagctggtgctgatcagcagaacgaggaacnccctagactcctagatactanaagtacgtcttacgtttagacgtaggtcgggtaccctagtacgtaacggttcacggtacgggtaccaggtaggaacgttccggtagggaacgtacggtaggttacctaacgttccgtaccaaccgtaagtttacggacctaacggtcccgttacggaccctacgggtaccccttaagggtaactttacgggtttaacttttacgggacccttttaaaacgttttacgtttaaacccggtaccgtaacccgtaaacgttaaggttaacctttaaaccgtttacgttttaacgggtacgggttaacccggtttcggggtaaccgtaaacggggtaccgtaaacggggttacggaaaacgttaacccggtaaaacggtaccggtaggttacgggaccgttaggtaacctacgtaaacgttccgtttacggttcctttaccgtaacgtttcccgttcccggtaaccttccg

SEQ ID NO: 9830 - DNA, 776 bp, Homo sapiens
  misc_feature: GYAE6OF01AYLMQ.53.73.G07.1.454.CMB.1.raw
  modified_base (103)..(103): a, c, t, g, unknown or other
  misc_feature (103)..(103): n is a, c, g, or t
  modified_base (174)..(174): a, c, t, g, unknown or other
  misc_feature (174)..(174): n is a, c, g, or t
  modified_base (187)..(187): a, c, t, g, unknown or other
  misc_feature (187)..(187): n is a, c, g, or t
  modified_base (534)..(534): a, c, t, g, unknown or other
  misc_feature (534)..(534): n is a, c, g, or t
  modified_base (716)..(716): a, c, t, g, unknown or other
  misc_feature (716)..(716): n is a, c, g, or t
  modified_base (739)..(739): a, c, t, g, unknown or other
  misc_feature (739)..(739): n is a, c, g, or t
  modified_base (754)..(754): a, c, t, g, unknown or other
  misc_feature (754)..(754): n is a, c, g, or t
tcagcgcgtatacacacgaccggtgctcgatttagctctacgctcagggggagtcagaccccagtcaggacacagcatggacatgagggtcccccgctcagcncctggggctcctgctgctctggctcccaggtgaccaatgtgacatccagtagtacgaccacgtccctcccnccaccgtgtcgcncatcgtcggtacggagacgaggtacgtaccgacctctacggtccgggcccgggtaccaccggtaaaccgtaaagtttacgtaaaccggtaccggttggggttaccgtccgttaggtactcgacgacgaaaccggaaacggaaccgggtaaccgacccgtaacgaccgtacgtacgtactaagttaagtaaccgttactaaccgtttagttacgtacggtacggtaccgggtacctacgtaaccggttaggtaccgcgggtacggtacgtacggtacggtaccttcggggacggtaatacggtactaccgtacctaccgtactacgtacgtacgacgtacgacccgtnacgtccgagtagtacgttacgttaacgttctactttacgggtaacttcaccgtaaccaagttaactactttaaggttacggttaggacccgggttcggtaacccgggaacggtaacggtaacggttagtaaccggtaaataaccggaaccggtaagttcgggaacggtccgacgtacccgtnttaacccggttataacccgtttntaacccggtttaccnccccccggtttcgtattaccgg

SEQ ID NO: 9831 - DNA, 596 bp, Homo sapiens
  misc_feature: GYAE6OF01AHPTB.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctgggttcggcctggtatcagcaagaaaccgagggaaacgcccctagacctcctgactctataagacgtctactttagacaggtcgggtcccatcgaaggttcagcggcaggtgacgtcgtgggacagtcgttcacttcctcaacctattacgcagcctgcagcctgattgtattttcgactaactttatactcgaacctaactagttaacaatttacgtttggtacgggttaccggttaccgggaaccgtaagggtaaccgtaagggtagaaactacgaaacgtaacgttggtacggtcgtagacctacctacgttccgttacgttacccttactaacctttcccgttccccggtcttaacg

SEQ ID NO: 9832 - DNA, 834 bp, Homo sapiens
  misc_feature: GYAE6OF01D31YX.53.73.G07.1.454.CMB.1.raw
  modified_base (239)..(239): a, c, t, g, unknown or other
  misc_feature (239)..(239): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcggggctggagataggaagagccgtcggggcctcgagtgagtgtactttccgngacacgactagttcgtaggaactacctacccttaccacccgtaccttacccttaataactagttacgggtaaccacgaccggccccgtgggacggtaggggtcttaggacggttggagtcggtacttaacgtaccgtaaacccgtaggttcgggtcgtaacttaccgtaacgtaaacgtttaacctacgaacgtaaggaaagtaacgtcggaaccggaacggggtaacctaaagtttaacccgaagttaccgaaccgtaaggaaccggtaaccgtaacccggtaacccgtaaacggtaacgtaaccgtaacggtacccgttaacgtaacgggttaggggtaacgggtaggtaaccggtaccgtaacggtcccgtaagggtaaacggttaacgttacgggtaacgggaaccggtaacccggtaaccgggtaccgttaaggtttacgggttaaacttttccggttaggttacccgggttaaccgtttaaacggtttacgtttaacggggttaagttaaacccggtttaaaccgttaaaccgtttaaacgtttaacgttttaacggtttttcggtaaccccgtaccggtaaacccggg

SEQ ID NO: 9833 - DNA, 768 bp, Homo sapiens
  misc_feature: GYAE6OF01AL16T.53.73.G07.1.454.CMB.1.raw
  modified_base (131)..(131): a, c, t, g, unknown or other
  misc_feature (131)..(131): n is a, c, g, or t
  modified_base (156)..(156): a, c, t, g, unknown or other
  misc_feature (156)..(156): n is a, c, g, or t
  modified_base (229)..(229): a, c, t, g, unknown or other
  misc_feature (229)..(229): n is a, c, g, or t
  modified_base (246)..(246): a, c, t, g, unknown or other
  misc_feature (246)..(246): n is a, c, g, or t
tcagcgcgtatacacacgaccggtgctcgatttagctctacgctcagggatcatccaacaaccacatcccttctctacagaagcctctgagaggaaagttcttcaccatggactggacctggagggtcttntgcttgctgtcagtagctccaggtnctcgactcccagtacagctaggtacaggtcgggggctagagatagaagaacgtccgtcgggtcctcgaggtanagttcgacttttaccgngaccgtacgaacctatacgtacgtatacccgtaccttccgaaccctaccttaccgttaactacgtaacggttcgggtaaccgaccgtacccggggcccgttacgggaaccggggtacggggttccgtaagggtacgggttaggtacgttaccggggtttaaccttaaaccggttaacccgtaccccgggttaaggttagggttaaccggttaactttaccgttaaaaccggttaaacgtttcccaacggaacgttaaggaaacgttactaccggggacgtaaacccgggttaaccgttaaagttacccgaacgttacgggtaaaccgaacgtaccggtacctaaccggtaccgaacgtaacgtaacgacgtaaccgtagacgttaggacgtacggtagcgtaacgcgtaagcgtaacgtgaacggcgtacgaccggtactgtacgttgtacgagtcgagttacgttagttagaaggtactaacgtagtaaccttagttaactttagactcggtaacggtcgg

SEQ ID NO: 9834 - DNA, 739 bp, Homo sapiens
  misc_feature: GYAE6OF01AOG8Z.53.73.G07.1.454.CMB.1.raw
  modified_base (231)..(231): a, c, t, g, unknown or other
  misc_feature (231)..(231): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgatttccngcacgacatcgaggactacctaccttccacccgtaccttcccttatacgtagttcggggtaacgaccacgggccccctagggaccgtagggggtctttaggacggttgggtaagttcggggttacctaaacgtcccgaaaaccccgttagggttacgggttacggtaacttaccgttaaaccgtaaacggttttaacctaccgaaaccgaaggtaaacgtaaagttcggaaccggtacgggggtaaccttaaactttacccgaagttacgaacccgtaaggaaccgaaccgtaccggtacccgaacggtaacgttaaccgacgttaccgtaacgtaggtagggaagggtacgacgacgacgccgtaggagtacgttacgagggacggacgaccggacctagttagttacttacgtgtacgtaccgtagttaccggttaagtccggttaaacttaaccggtaacttaacttaaacgttttagttttaccgtaccgtaacggtaacccgg

SEQ ID NO: 9835 - DNA, 812 bp, Homo sapiens
  misc_feature: GYAE6OF01C63I2.53.73.G07.1.454.CMB.1.raw
  modified_base (234)..(234): a, c, t, g, unknown or other
  misc_feature (234)..(234): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaacgccgtggggcctcgagtgatgtactttccnggcacgactatcgtaggtactacctacccttccgaacccgtacctttaccccttaagtacctaagtttcggggtaaccgaccgtaaccgggtcccccgttaggggaaccggtacggggggttcctttagggaagggttacggggtaaggttcgggggttaaccttaaacgttaccccgtaaaaccccgttagggtacgggttacgggtacttaccgttaaaccgtaaacggttttaaccctaccgaaccgtaaggtaaacggtaacgttacggaccgggtaaccggggtaaccccgttaaaaccgtttacccgaacgttaccggaacccgtaaacggaccggaaccctaaccggtacccgaaacggtaacgtaacgtacgttacctaaccgtaagtacggggtaggtacggacggtacgacggtcctaggacgtaatcggtaggaccggtacgaccggactagttacgttaacgttacgtacggttcgacgttacgttacggtttaaggtacggttaaccgtttaaccgtaaccttaaacgttaatttagttttacggaccgttacggtaaccccggg

SEQ ID NO: 9836 - DNA, 714 bp, Homo sapiens
  misc_feature: GYAE6OF01B523N.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgtcttgctgtcagtagctccgaggtgctcgctcccaggtgcagctggtacaagtcggggctgagatgaagagccgtggggacctcgagtgattgtactttcctgcacgcatcgtgactacaccttaccacctacctccttatacgtagttcggtacgacgccggccccgtggacgtaggggtcgttaggaggtggagttcgggtactaacgtaccgtaacccgtaggtggtacggtacttacgtaacgtaacgttactacgtaaacgaaggtaagaacgtggtacccgaagggtaacccgtaacgtttaaccacggttacgaacccgaacgacgtaccgaaccggtacccgaacggtaacgtaaccgtacgtaccgtaagtacggtagggtaggtaggtaacgccgtagtaccgtaggaagtacgtacgtagggaaccgactaacgggtacctaggttaagttaccgtttaagtcggtacgtacggttaaacgtttcgtttaagggttaaggttacccgtttaaacggtaacgtttaacgttaaatttttaccgtttacgttaacgacccgtaaacccggg

SEQ ID NO: 9837 - DNA, 734 bp, Homo sapiens
  misc_feature: GYAE6OF01A7US1.53.73.G07.1.454.CMB.1.raw
  modified_base (211)..(211): a, c, t, g, unknown or other
  misc_feature (211)..(211): n is a, c, g, or t
  modified_base (545)..(545): a, c, t, g, unknown or other
  misc_feature (545)..(545): n is a, c, g, or t
tcagcgcgtatacacacgaccggtgctcgatttagctctacgctcagggggagtcagacccagtcaggacacagcatggacatggagggtccccgctcagctccgtggggcctcctgctgctctggcctcccgagggtcgacctaaatgtgacactccagatcgaccctacgttccttcccttcccaccctgtctgcatcgtggtacgganacgagacgtccaccgtctaccgttcggccgggaccaagaacctaaagtacttaacggtacgttggttcggccgtaggtactcgaacgacgaacggtaaaaccggaacgggaaccgtaccccgtaagtacctacgtacgtaacttacgtaacgtaacgtaccgttaccttaacgttaagacggtacgggtccgggtacctagtaccggtaaggttccgaggcggtagtaaggtaggtacgtcggtaggacgtaacggttacttaccaccttacgtacctaacgtacgttacgactacgtccgtgaccgtacgtcgtaagtagttattacgtttanaaccgtttaatttacgtacacgtaacctaagtacgtttaattacgtttaggttcggaccggttaacgtcccggtaaacgggtaacggaaccggttaaaggtaacgtaaaactacgtaaacgttaggtcggacgtactaccgactacgtacttgttaaccgttcctaacgttaccttcccctcgtactcg

SEQ ID NO: 9838 - DNA, 761 bp, Homo sapiens
  misc_feature: GYAE6OF01C7G14.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccagatcgaccagtctccttccaccctgtctgcatctgtcggagacagacgtcaccgtcacgttcggccggcacgaccaaagttattaacgaccgtggttcggccgtggtatcagacaaggaaaccgacgggaaacgccctagacctcgtagtaactactaagtaacgtacgttactaacgtttacgacgtacggttacgggtaccctaagtacgtaaggttacgacggacgtacgtaacggttacggacgttacgaggggaactaacgtaacggttacctaccttacctaccaaacctaagttaacgccgtaacgtcccgagacccgtaaggtcctaagtagtttacgttaacttttaccggaaccttaaacgttttaaccgtaccgttaaccgaaaccttaaacggtaacgtttaactaacgtttaacggttttacggaccggttacccggtttaaccgggaacctaaaacgggggtacgtaaaacggggttacgtaaaaacttaacccggtaaaacggtaccgttagggttaccggacttaacgaacccttagttaacccgttcggttacttaccgtttaacaccctttcccgttaaccccgctttaaacg

SEQ ID NO: 9839 - DNA, 641 bp, Homo sapiens
  misc_feature: GYAE6OF01BTHP7.53.73.G07.1.454.CMB.1.raw
  modified_base (249)..(249): a, c, t, g, unknown or other
  misc_feature (249)..(249): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctcccgaggtcgcagtcgtggtacaaggtcgggggctggagagtagaagacgccggtcggggcctcgagtgatgtactttccgagccanacatcgtaggactaccgtaccttccacccgtacccttaccttatactacggttagggaccgaccgaccggccccgtagggacggtcggggtctggaggtaggtacggttggtactaactaccgtaaccgtggtggtagtactacgtacgtaacgttactacagtagaagaagtcgacggacggtacctaactaccagtaccaacgacgacgactaccgacgacgtaacgtactagtacctagtggtagggaggtcgacgctaacgcgtagacgtagcgtacgggacgaccgtacgtctagttacgttaacgtcgtgtaccgtagtagtttacgttaagggtactaacgttaacgttaactacgttagtttacgttcgacgtcggtaaccggg

SEQ ID NO: 9840 - DNA, 922 bp, Homo sapiens
  misc_feature: GYAE6OF01D30XG.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgcttgtcagtacgcctccgtaggtcgctccggtcctaccgtagggcacgacgtacggtacgtaacggtaacgggtccggggtataaggagtacggtagaaacggaccgggtccggtacgggccgtagtaggtagttacgtaacgtttccgttaccgacgaccgtaaccgtaacgtacttaaccggtacttaaccctaaaccccgttcccttaaccgaaccccgtttacctttaaccgttaagtacgtttaagggtacccgggtaaccccgtaagggttccccggtaccgggggtaacggtacggggttacgggttaaccgggtatacgggggttacgttaacggttccggttaaaaccttacgggttaaaccccggttgggttttagtacccgggttaaattaaccggttaacctaacggtaaaacggtttacctaacgaaagaccggttaaaggacgggttaccgtaaacggtaacccggttaagtaaccaccgtaaaggtaccggaaccgtaacgtaaccgaacgtacggtaaacccgaggtaacctacgtaacgttacgtaacggtacggtcgggaacggtcggaaccgtagggacttacgtaggtacgaacggtccggtaacgggtaaccgacgttacccggttaatacggtttaggttaccgtacggtttacggaccgttaaggtttcggttaacggttagttaaccgttaaccgtaaagtttacgttaaacggtttaactttaacgggttacccttaagggtccccggttaaaccgggg

SEQ ID NO: 9841 - DNA, 762 bp, Homo sapiens
  misc_feature: GYAE6OF01CBMSM.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacaggtcggggctgagataggaagacgccgtggggcctacgagtgattgtactttccgtgccaacgactacttcgtaggtaactacctaccctttaccaacccgtaccttacccttaatacgtagttacgggaccgacgaccggccccgtggacgaggggtcttggaggtggtagtgggttactaacgtaccgtaaacccgttgggtcggtaggtaacttacgtaaacgtaagtttacctacgaacgaaggaacgtaagtacggacgggtaacgggtacccgtaaaatttacccaagtacggaaccctaagggtaaccgaaccgtaccgttaacccgaaacggtaacgtaaccgtacgtacgtaacgaaggttcgggaacgggtacgaacggtaccgtacggacccgttaggaacgtacgtaaccggtgggaaaccgggtaccgaaccggtaccgttagtttacgttaacgtttccggttagtaccggtacgttacggtttaacgtttacggggttagtaaccgtttaaacgaaccgtttaaagtttacgtttaacgttttacgtaccgtacgggtaacccggg

SEQ ID NO: 9842 - DNA, 811 bp, Homo sapiens
  misc_feature: GYAE6OF01DRBSC.53.73.G07.1.454.CMB.1.raw
tcagcgcgtatacacacgaccggtgctcgatttagctctacgctcgagggggagtcagacccagtcaggacacagcatggacatgagggtccccgctcagcctcctggggctcctgctgctcgtggcctccgaggtcgcctaaagtgtacgacacgtccagtatacgaccctagttcctcccttcccaccctgtctcgctacttcgtggtacggagacgagacgtccaccgtacctacgttccggaccggtaccacgtaacgtaaaagttacgttaacgaccgttggttacggccgtttagtacgtacgaacggaccgaacggaaaaccggaacgggaacctacccgacgtacctaccgtagtacttaacgtaacgtaacgttcgttaccgttaagttacggaagtacgggtccgggtaacctaggtaacgtaacggttcgacggtcggtacgtaggtacggagttcgggtaacggagtacgtaacgttcgtaccttccgtaaccctaacgtacgttacgaccgtacggtccgtacgtaccgacgttaccggtagtttacttaacgggtttttacgtttaccgttaaccttttaaacgtttaccggttaaccgtaaccgttaaccctaaacgttaacttaacgtttaactttacggtttacggtaacggttacccggtacgggtaacggtaacggtaaccggttaaggacgtaaaccgttaccggaaacgttacggtacggtacgtcggtactaacctccgttaactacgtttacgtcccttacgttaccccgttccctcgtacgttaccg

SEQ ID NO: 9843 - DNA, 671 bp, Homo sapiens
  misc_feature: GYAE6OF01CIX9K.53.73.G07.1.454.CMB.1.raw
  modified_base (232)..(232): a, c, t, g, unknown or other
  misc_feature (232)..(232): n is a, c, g, or t
  modified_base (314)..(314): a, c, t, g, unknown or other
  misc_feature (314)..(314): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcgggggctgagatgaagaagccgtggggcctcagtgatgattttccgngccacgacatcgtggactaccaccttccaccgtaccttcccttaatactagttcgggtacgacgacggcccccgtggaccgnggggtcttggaggtggatgggtactaactaccgaaccgtggtggtggacttcgtaactaagttacctacgaacgaggaagaagtggaccggtaacggggacccttaaacttacccgagtacggaacccgaaggaacgaaccgtaccggtacccaacggtaacgtaacacgttactacgagtgggagtgacgcacggccgtaggagtactcggtacggtaacggaccgacggtacctagttacggttattacgtcggtacgtacgtacgttaggtttaaggttacggttaaccgttaaaccggttaaccttaaacgttaacgttttagttttacgtacccgtaccggtaaaccccggg

SEQ ID NO: 9844 - DNA, 1197 bp, Homo sapiens
  misc_feature: GYAE6OF01EVKB4.53.73.G07.1.454.CMB.1.raw
tcagcgcgtatacacacgaccggtgctcgatttagctctacgctcagggggagtcagacccagtcaggacacagcatggacatggagggtccccgctcagctcctggggcctcctgctgctctggctccgaggtcgacaaatgtgacatccaagatcgacccagttcctcccttcccaccctgtctgctacttcgtcggacgggaagaacgtacggtatacctacccgttctaaccgttcgggacccgggacgaaacggaaccgtaaaacgttaaacgttaaaccggtacccggtttaggggttacgggtacccgttagggtaactaccgaacggaaccgaaaaaccggaaaaacccggaaacggggtaaaaccgtacccccggttaaaggtaaccccgtacccttaaggtaacttaaaccggttaagtaaaccggttaaaccgtttaccgtttaaacgttttaacggaaccggtacggggttaccggggtaaccgtaacgtaaccgttaaacgggttaccggaagggtaccgggttacgtacgggttaacggggtacgttacggggttaaacggggtaacgtaaacgggttaaacgttttacccgtaaccgttacccttaacggtaaaacctaaggttttaaacccgacggtaacggttaccccgacgggtaacccgtaaccgtacgtttaacgggttaactttaacgggttttaacgttttaaaccggtaaccctttttaaaaccgttttaacgtttttaaaaccccggtaaccggtaaaaccccgtttaaaaccgttaaaacccggggtttaaaaccgttttaaaaccgggttttacccgggtttttaaccggttttaaaaccgggggggtacccccccggggtttttaaaaaccggggggtaaaacccccgggttaaaaaccgggggggttaaaaccccgggtaaaacggggggtttaaaaacccgggttaaaaaaccgttaaaaaacccgggtaaaaaccccgggtttaaacggggttaacccggggttaaaacccggggttacccggtaaccccggttaaaccccgtttaaaacccgttaaaccccgggttttaccgttttaaaaccccggggttaccctttttaaacccccggggtttaccctttaaaccccccggttttacccccgaaacccggtttttaaaccccggg

SEQ ID NO: 9845 - DNA, 666 bp, Homo sapiens
  misc_feature: GYAE6OF01A25VY.53.73.G07.1.454.CMB.1.raw
  modified_base (237)..(237): a, c, t, g, unknown or other
  misc_feature (237)..(237): n is a, c, g, or t
  modified_base (285)..(285): a, c, t, g, unknown or other
  misc_feature (285)..(285): n is a, c, g, or t
  modified_base (310)..(310): a, c, t, g, unknown or other
  misc_feature (310)..(310): n is a, c, g, or t
tcagcgcgtatacacacgaccggtgctcgatttagctctacgctcagggggatcatccaacaaccacatcccgttctctacagaagcctctgagaggaaagttcttcaccatggactggacctggagggtcttctgcttgctgtcagtagctccgaggtgctcgctcccaggtgccagctggtacaagtcgggggctgagagtgaagaagccgtaggggcctcagtgatgatttccngtcacgacatctgactacaccttcaccgactcctatacatgggacacncggcccctaggacaggggtcttggnggtgacgtgggtactaatccgaacccgtaggtggtacgattacgtacgaagttaccgtacacgacggagtaacgtgaccgacggggtaacctaattacccgagttacgaacccgaggtaacgacctacggtcccgaaacggtaacgtaaccgtaggttacctaacgtacgttaggggtaaccgggtagaacggaccgacggtacccgtaggaacgttataccgtacgggtacgaccggtacgggacctaagtacgttagttacggtgtacggacggtaatttacggttagttaacggggaaccttacgtaaacctacgttaaactttaagttttccggtacgtacggtaaacccgg

SEQ ID NO: 9846 - DNA, 629 bp, Homo sapiens
  misc_feature: GYAE6OF01D8QQW.53.73.G07.1.454.CMB.1.raw
  modified_base (229)..(229): a, c, t, g, unknown or other
  misc_feature (229)..(229): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagcctggggcctcagtgatgatttccngcacgacatctaggatacaccttcaccgtacctcccttatacattggtacgacacggccccgtggacgaggggtcttggagtggagttcgggtacttaacgtacgtaaacccgttaggtggtaggacttacgtaacgtaaacgtttactaccgaaccgaaggaaacgaagtcggacgaacgggtacccgtaaatttacccgagtacgacccgtaaggacgaccgacgttaccaacgtacgtaacgacgtcgtacagtacggagtagacgacagtccgagagactcgtacggacggtacgacgtaccgtagtgtaacgttcgtggtacgtacggtacttacgttaggtcggtaagttaccgtaacttaactaaagtttatttacggtctacggtaacccgg

SEQ ID NO: 9847 - DNA, 709 bp, Homo sapiens
  misc_feature: GYAE6OF01BF9QO.53.73.G07.1.454.CMB.1.raw
  modified_base (189)..(189): a, c, t, g, unknown or other
  misc_feature (189)..(189): n is a, c, g, or t
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagagaaagttcttcaccatggactggacctggagggtcttctgcttgctgtcagtagctccgaggtgctcgctccgaggtgcagctgtacagtcggggntgagagtagaagagccgtgggcctgagtagatgtactttccgngaccgaacgactagtcgtacggtaactacctacccttaccgaaccctacctttaccctttaatacgttaaggttacggtaccgaccgaccggtccccgtagggaccggagggtcgttaggtaggtcggtagttcggtactaactaccgtaaccgttaggtggtacgtatacgttaactaacgttactaccgaacgaagagtaagtcggacggaacggtaccgtaaacttacagtacgaacgagtaaccacgtacccgtaacgacgtaacgtacagttaccgtacgtaggtggtaacggtagacgagtacggacctagacgtagtaccggtaaggaccgtaacggccgtaacgtagttaccggttaacgttagtcgtaacgtacggttacttttaggtaacggtttaggtaacccgtttaacgtaaaccgtttaacgttttaattttacgtttcgttaaaccgtccgtaaacccgggg

SEQ ID NO: 9848 - DNA, 849 bp, Homo sapiens
  misc_feature: GYAE6OF01DX4X9.53.73.G07.1.454.CMB.1.raw
tcagcgcgtatacacacgaccggtgctcgatttagctctacgctcaggggatcatccaacaaccacatcccttctctacagaagcctctgaggaggaaagttcttcaccatggactggacctggagggtcttctgcttgctgtcagtagctcgaggtcgctcgctcccgaggtgcagtctaggtacaggtcggggctgagagtagaaggacgccgtacggggcctacgagtgattgtactttccgagacacgactagtacgtaggactacctaccttaccgaacccgtaccttacccttatactaggttacgggtaaccgaccgtaccgggtccccgtaggggacggtacggggtcttagggtacggtaggtacggttagggtacctaacgtaccgtaacccgttagggtcgggtacggtaccttacgttaaacgtaacgttacctaccgaacgtaacggaacgtaacggtcggacggaaccggggtaaccctaaacgttaccgtaacgtaaccggaaccgtaacggaaccgtaaccgtacccggttaacccgaaacggttaaccggtaaaccggtaaccgttaccccggttaagtacggggttaacggggacggtacgggtaccgacgtaccggttaccgtaagggtaacgtaccggttaacggtacgggtaaccggaccggttaacccggtacgttaagtttacccgggttaagtttccgggttacgttacgggttaaccggtttaccgtttaacggggtttaacggttaaccggtaaaccgtttaacgtaacccggtttaaactttaaacgttttcgtttaacggtaccgtaccggggtaaaccgg

SEQ ID NO: 9849 - DNA, 711 bp, Homo sapiens
  misc_feature: GYAE6OF01ECPRD.53.73.G07.1.454.CMB.1.raw
  modified_base (249)..(249): a, c, t, g, unknown or other
  misc_feature (249)..(249): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctcccgaggtgcagctggtacaagtcgggggctagagagtaggaaagaacggccgtcggggtccctcgtagtgtattgtacttttccgngaccgaccgaactacgtcgtaggtaactacctccttaccacccgtaccttacccttatactagtttacgggaacgaccgaccggtcccgtcggacgtaggggtcgttcggaggttaggtacgttacgggttaccttaacgtaccgtaacccggttgtaaacgtggttcggaaattaccgtttaaccaaacgtttaacgtacgaaacgtaagtacggaaagttacgggaccgttaaacgggtacccgtaaagtttaacccgaacgtagaacccgaacgaacggtaccaacgtacccaaccgaagttacaacgttactacggagtagggacggtcgacgtcagacctagtacgagtaccgtaggaccggaactacggtactacttaggtagttacgtaggtcgtacgtagttacgttagtacgtaacttacgactttaacgtaattacgtttacgtcgtaacgg

SEQ ID NO: 9850 - DNA, 778 bp, Homo sapiens
  misc_feature: GYAE6OF01DWUCK.53.73.G07.1.454.CMB.1.raw
  modified_base (564)..(564): a, c, t, g, unknown or other
  misc_feature (564)..(564): n is a, c, g, or t
  modified_base (727)..(727): a, c, t, g, unknown or other
  misc_feature (727)..(727): n is a, c, g, or t
  modified_base (773)..(773): a, c, t, g, unknown or other
  misc_feature (773)..(773): n is a, c, g, or t
tcagcgcgtatacacacgaccggtgctcgatttagctctacgctcaggggtagtcagacccagtcaggacacagcatggacatggacgggtcccccgctcagcctccgtggggcctcctgctgctctggcctcccgaggtcgacctaaatggtacgacactaccgagataccgaccctacgttcccttcccttaccctacccgttgtcctgacctagttccgtcggacggaacgaacgtacggtacctacctacccggtacctaccggttaccgggccgggacccaacggaaaccgtaaaagtttaacgttaaccggtaccggtttgggttaccggtaccgttaggtaaccacgaacggaaccggaaaaccggaaaccggtaaacgggaacccgtccccgtaagtaccctcgtagtaacttacgtaagttaacgtccttacgttaagttacgacggtacggtaccgtaccctagtacggtacggtcgacggtcgtacgaggtcgtaacgtcggtaggtaatacgttactacctacctaccgactaacgtagtcgacgctaccgntacgtaccgtagtaggtattacgttacttacaaccgtttagtacgtacgtaccaacgtactaaacgttacttagttacggttcggtaaccggtacggtaccgaaacggtaacgggtaacgttaagacggtaaacgtacgaaacggtcggtcgtaagccgtaanacccgtagttactccgttagtaccttccttacccgtccctaccgtntaccg

SEQ ID NO: 9851 - DNA, 148 bp, Homo sapiens
  misc_feature: GYAE6OF01BBRNY.53.73.G07.1.454.CMB.1.raw
  modified_base (135)..(148): a, c, t, g, unknown or other
  misc_feature (135)..(148): n is a, c, g, or t
tcagcgcgtatacacacgaccggtgctcgatttagctctacgctcaggggaccggtgctcgatttagacgacagctcagggcacgaccggtgctcgatttagcagacgtctgagcgggctggcaaggcgcatagnnnnnnnnnnnnnn

SEQ ID NO: 9852 - DNA, 629 bp, Homo sapiens
  misc_feature: GYAE6OF01D4VCS.53.73.G07.1.454.CMB.1.raw
  modified_base (169)..(169): a, c, t, g, unknown or other
  misc_feature (169)..(169): n is a, c, g, or t
  modified_base (229)..(229): a, c, t, g, unknown or other
  misc_feature (229)..(229): n is a, c, g, or t
  modified_base (350)..(350): a, c, t, g, unknown or other
  misc_feature (350)..(350): n is a, c, g, or t
tcagcgcgtatacacacgaccggtgctcgatttagctctacgctcaggggatcatccaacaaccacatcccttctctacagaagcctctgagagaaagttcttcaccatgactggacctggagggtcttctgcttgctgtcagtagcctccaggtgctcgctccaggtncagctggtacaagtcggggctgagatgaagaagccgtggggccctgagtgatgatttccngcacgacatctggatacaccttcaccgactcccttatacattggtacgacaggcccctggacgaggggcttggagtggatgggtctaactcaacctaggtggtgatctaactaacgttacncaacagaagaagtgaccgagggacctaaacttaccagtcgaaccaaggaacgaccaccgttccaaacgtacgtaactaagttacctacctaagtagggaggtggaagtccgaagtcccgtagaaggtactacgtggaacggaccgaccggtaccgaacgttggttaagtttacgtagggttacggtacgtacgtttaccgtttaagggttggtaaacgtttaaccgtaacctttaaactaaacgttttaacgtttttcgtacgtacggtaacccccggg

SEQ ID NO: 9853 - DNA, 706 bp, Homo sapiens
  misc_feature: GYAE6OF01A0OJF.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccgaggtgcagctggtacaagtcggggctgagataggaagaacgccgtggggcctcgagtgatgtactttccgtgaccacgactagtcgtaggactacctaccttccacccgtaccttacccttaataccgtagttacgggtaacgaccgaccgggtccccgtagggaccgtacggggtcttaggacggtggtaggttcgggtacttaacgtacccgtaaaccgttagggttggtacgtacttaccgtaacgtaacgtttacacgaacgaagtaagtaacgtcggaccgtaacggggtaacctaaacgttaccgaagtacgaaccgtaggaaccgtaaccgaccggttaaccaacggtaacgttaaccgtacggttacctaacgtaacggttagggaacgggtacgaacgcgtacggtaccgttaggacgtacgtcgtaggaccggacgacgtcctagttacgtacttacgtgacgtcgtacgtttgaacggttgttaacttacgtaacttaaacttagtttacgtttcgcgtaccgtaacgg

SEQ ID NO: 9854 - DNA, 742 bp, Homo sapiens
  misc_feature: GYAE6OF01DCL6A.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccaggtcgcgagctaggtacaaggtcgggggctgagataggaagagccgtcggggcctcgagtgatgtactttccgtgccacgactacgtcgtaggactaacctaccgtacacccgtaccttacccttatactagttagggaccgacgaccggccccgtaggacggtaggggtcttggaggttaggtagtcgggtacttaacgtaccgtaacccgtaggtgggtagacttacgtaaacgtaacgttaacctacgaacgaagaacgaacgtacgaccggaacgggacccgttaaactttacccgaagttccgaacccgaacggaaccgtaaccgaacccggtaaccgaaaccggtaacgttaaccgaacggttaccttaacggaggtagggtagggtacggacgacgtaacgtccgtaggtaactcggttaccgtaagggaaccgggaccgaccgggtaccgtagtttaacggttacgtttacgtggttacggtacgttaacgttaggtttaaggttacgtaacgtttaacgaacgtttaaacttaattttacgttttcgaccggtacgtaacccggg

SEQ ID NO: 9855 - DNA, 683 bp, Homo sapiens
  misc_feature: GYAE6OF01DJETZ.53.73.G07.1.454.CMB.1.raw
  modified_base (169)..(169): a, c, t, g, unknown or other
  misc_feature (169)..(169): n is a, c, g, or t
  modified_base (196)..(196): a, c, t, g, unknown or other
  misc_feature (196)..(196): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (325)..(325): a, c, t, g, unknown or other
  misc_feature (325)..(325): n is a, c, g, or t
  modified_base (331)..(331): a, c, t, g, unknown or other
  misc_feature (331)..(331): n is a, c, g, or t
  modified_base (334)..(334): a, c, t, g, unknown or other
  misc_feature (334)..(334): n is a, c, g, or t
  modified_base (379)..(379): a, c, t, g, unknown or other
  misc_feature (379)..(379): n is a, c, g, or t
  modified_base (418)..(418): a, c, t, g, unknown or other
  misc_feature (418)..(418): n is a, c, g, or t
  modified_base (485)..(485): a, c, t, g, unknown or other
  misc_feature (485)..(485): n is a, c, g, or t
tcagcgcgtatacacacgaccggtgctcgatttagctctacgctcaggggatcatccaacaaccacatcccttctctacagaagcctctgagaggaagttcttcaccatggactggactgggagggttcttctgcttgctgtcagtagctccaggtgctcgcctcccgnggtgcagctaggtaacaaggtcggggntgagagagaagagccggtgggcctgaggtgatgtactttacgngacaaccganattacgtgaactacctaccttaccaccgtacttacccttatactaggttcggaacacgtacgcccgtgagtacggntggagnggngtagactaatctaaccgtggtgtagtatactaacgtaacgttcanaacgagaagtaactggacgagggtaacctaacttacganaccgaacgagacgaccgtacgaccgtaagaacgtacgtacgttaccgaagtacggtagggtaggtanacgggtaccgtaggtaccctaagggtgtaagttacgggaacggaacgggttaaacccggacggtaaccgttaactttaaggttaaaccgttttcgacggtacggttaacggtaacctttagggttaggttaaacccgtaaagttaaaccggttacttaaagttaaacttttacgtttacgtacgtcccggtaaacggg

SEQ ID NO: 9856 - DNA, 906 bp, Homo sapiens
  misc_feature: GYAE6OF01AYFW0.53.73.G07.1.454.CMB.1.raw
tcagcgcgtatacacacgaccggtgctcgatttagctctacgctcagggatcatccaacaaccacatcccttctctacagaagcctctgagaggtaaagttcttcaccatgactggaccgtggagggttcttctgcttgcttgtcagtacgtccgtcccgaggtcgtctcgtcctaccccggtaggtgactacgcgttacggtaacgtaaggtccgggggctggaaggtagtaggaaagaacggtccggtcggggacctcgtaaggtgtattgttacctttctcgaccgacgactagttcgaggtactaacctaccgttccgtaacccgtaccttacccttaagtaaccgttaggtttaccggggaacctaccggtaacccgggttcccccgtaggggtaccgggtacgggggtacctttaggggaacggtttggggtaacggtttacgggttaaccttaaacgtacccgttaaaaccgggtttggttaacgggtacggtacttaacgttaacgttaaacgttaccaacgttaaacgaacggtaacgtaaggtacgaccggtaaccgggtacccgtaaagttaccaacggtacgaacgacgaaaccgtacgtaacggaccgtaacggtaacgtactacgttaacgtacgtagggtcgggtacgtcgggaaacgtcgaaccgttacggaacgtacggtacgttaccgaacggggtaacccgtaaccgggaccgtaaccctttaacgggtttaatttacccgggtttaacggttaaacggtccgggttaacgttccggggttttaaaacgttagggttaaaacccgttacgttaaacccggtttaaacgtaaacttttaaccgggttttaagtttaccccggtaaaaccgggttcggtaaaacccggg

SEQ ID NO: 9857 - DNA, 758 bp, Homo sapiens
  misc_feature: GYAE6OF01BCY19.53.73.G07.1.454.CMB.1.raw
  modified_base (186)..(186): a, c, t, g, unknown or other
  misc_feature (186)..(186): n is a, c, g, or t
tcagcgcgtatacacacgaccggtgctcgatttagctctacgctcaggggatcatccaaacaaccacatcccttctctacagaagcctctgagagaagttcttcacatgactggacctggaggtcttctgcttgctgtcagtagctccaggtgctcgctcccaggtgcagctggtacagtcggggntgagatagaagaacgccgtggggcctgagtgtatgtactttccgtagcaacgactatcgtggactaccacctttcaacccgtacttcccttaatacgtagttcgggtacgacgcggtccccgtagggactagggggtcttggaggtggagttgggtactaaactccgaacccgttaggtgggtaggtacttaccgtaaactaaacggtttaccctcgaaacgaaggtaagaaacgttggaccggtaaacgggggacccgttaaaacttttaacccgaagttacggaaacccgaacggtaaacggaaccgtaaccccggtaaccgtaaccccggtaaacgtaaccgaacgttaacctaacgtaacggttaggggaacgggtacggacggtcgaaccgtacccgtagaacgtagtacgtagggacggaccgaaccgggtacttagttacgttaccgtttacgttggttaccggacgtttacggttacgtttaggttaaacggttacggttaaacgtaaccgttaaacgttaaacttttaagtttttccgtaaccggtaaccgtaaaccccgggg

SEQ ID NO: 9858 - DNA, 711 bp, Homo sapiens
  misc_feature: GYAE6OF01BXGAH.53.73.G07.1.454.CMB.1.raw
  modified_base (236)..(236): a, c, t, g, unknown or other
  misc_feature (236)..(236): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccgaggtgctcgctcccaggtgcagctggtacaagtcggggactgagatagaagaagccgtggggcctcgagtgatgtacgtttccngcgacgactagtcgtagtactacctaccttaccaccgtaccttaccttatactagttacggacgacgccgccgtaggacggtagggtcgttaggaggtggtagtcggtactaactaccgtaaccgtagtggtacgtagtacgtaacgttaacgttacgacgaacgaaggagtaacgtcggacggtacgggtaaccgtaacgttaccgacgtacgaaccgtaacgaacgtaccgtaaccggtaccgtaacgtaacgttaaccgtacgtaccgtaacgtaggtacggggtaagtacggaacgacgtaacggtaccgtagtacgtacgtacggtacgggtaccggtaaccgaccggtacgttacggttacgttacgttacgttacggtacggtacgttacgtttacggttaacggttaacgttaaccgttaactaaccgttaactttaagtttacgtttacgtaccgtccggtaccgg

SEQ ID NO: 9859 - DNA, 673 bp, Homo sapiens
  misc_feature: GYAE6OF01B5L28.53.73.G07.1.454.CMB.1.raw
  modified_base (240)..(240): a, c, t, g, unknown or other
  misc_feature (240)..(240): n is a, c, g, or t
  modified_base (326)..(326): a, c, t, g, unknown or other
  misc_feature (326)..(326): n is a, c, g, or t
  modified_base (339)..(339): a, c, t, g, unknown or other
  misc_feature (339)..(339): n is a, c, g, or t
  modified_base (525)..(525): a, c, t, g, unknown or other
  misc_feature (525)..(525): n is a, c, g, or t
tcagcgcgtatacacacgaccggtgctcgatttagctctacgctcaggggatcatcccaacaaccacatcccttctctacagaagcctctgagaggaaagttcttcaccatggactggacctggagggtcttctgcttgctgtcagtagctccaggtgctcgctcccaggtgcagctggtaacaaggtcgggggctgagatagaaggacgccgtggggcctcgagtgatgtacttttccngccacgactattcgtggacttacctacccttcaaccccgtacttcccttaatactagtttcgggacaccgacggccccgtggacgnggggtcttagggnggttaggacgttgggtactaactaccgtaaccgttaggtgggtacgacttactaacgtaaacgtttacacaacgtaaggaacgtaagtacggaccggtaacgggacccttaaatttaacccgagttaccgacgacgaacgacaaccgtaccgacgtaacgtacacgtactaacgagtgggacggtnacgacgtagaccgtgacgtagtcgtacgggacgaacgccgtaccgtagttacggttacttacgtgttacgacggttactttacggttaagtcggttaaacttacgaacctttaagttaactttagttttaccgctacccgtaaccggg

SEQ ID NO: 9860 - DNA, 892 bp, Homo sapiens
  misc_feature: GYAE6OF01BGD2C.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctcccttcccacccttgtctgcactctgtcggagacagagtcaccgtcacttcggccggccagaccaaagtataacgaccgtggttggccgtggtatcagcgaagaaccgaggaaccgccctagacctcagtatactaataacgactacttaacgtttacgacgtacggtcgggtacccagttaccgtaacggttacgacggcggtaccgtaggtacggacgttacggacggggtaaccgtaggttaccggttacaccgttaccctaccgtaaacccgtaattaccggaccgtacgtacccgtacggtccgtaacggtccccgttagggttaacgtttacggtttaacgtttttacggtaaccctttaaaccgttttaaccttttaaacccggtaaccggttaaaccccctaaaacggttaacgtttaaaacccgtttaaacgtttttaaccgtttttaacccggggttacgggttaaccccgggttttaaccgggggaaaccccgggttaaaacgggggtaaaccccgggttaaagggggttaaacccgggttaaaaacggtttaaacccggtaaaaaccgggttaaaccggttaacggggtttaccggggttaaccctttaaccggggaaccccttaaacccggttaaccgtttaccggtttacccgtttacccgtttacccttaaacccccggttttccccctttaccccgggtaacccctttaaccg

SEQ ID NO: 9861 - DNA, 782 bp, Homo sapiens
  misc_feature: GYAE6OF01DVXW5.53.73.G07.1.454.CMB.1.raw
  modified_base (643)..(643): a, c, t, g, unknown or other
  misc_feature (643)..(643): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtacgctcctaggtcgctcgtcctacccgagggtgcgagtcgtaggtaacaacggtcggggcgtagagagtagaagacgtccggtcgggcctcgtagtagtatggtacttttccgcgaccaacgactagtcgtacggtaactaacctaccgtacctaacccgtacctttaccttaactaaccgttacggttacgggtaaaccgaccggtaaccgggtacccgtaggggaccgggtacggggtcgttagggtaggtcgggtaggttacgggttaaccttaacgttaacccgtaaccggttagggttacggtacgtacgttaacgttacgttaaacgttacacgtaacgaagtaacgtaagtcgaccggaacgggtaaccttaaactacgtaacgtacgaacgaacggaccgaaccgtaccggaaacgtaacgtaacgtaacggttacgtaaccgtacgtacgggtagggtacggtagaccgggcgtaacgtaccgaaggngtacgtaccgtaacgggacgtaaccgacgacgttacttagttacctttaggcgttacgacgttacgttagtttacgggttaacaaacttacgtaaacttacgtttaaacgtttcgttaaccgacgtcgggtaaacccgg

SEQ ID NO: 9862 - DNA, 718 bp, Homo sapiens
  misc_feature: GYAE6OF01AWVNR.53.73.G07.1.454.CMB.1.raw
  modified_base (411)..(411): a, c, t, g, unknown or other
  misc_feature (411)..(411): n is a, c, g, or t
tcagcgcgtatacacacgaccggtgctcgatttagctctacgctcagggggagtcagacccagtcaggacacagcatggacatgacgggtccccgctcagctccgtggggctcctgctgctctggctccgaggtgaccaatgtgacatccagactcgaccctagtcctccttccacccgtgtctcgctagtccgtggtacggtagacgacggtacgttccaccgtcctacgttcggcccggtacaacgacctaaagttacttaacggtccgttggtacgccgttaggtacgtcacgactaacggaaaccggtacgggaacctcccgttagacccgttctagtactacgttaacgtaacgtaccgttacttacgttacggaccgtaagggtccggtaccagttcgtaacgtnacggcggctaggtcgtctacggtaggaccgtagtcgtacctactacgaccctacgtatacggccttagccgttacgacttacgtcgttacggtactagtttaccgtttagaacccttaacgttccgttactaccggaaccttaaacgagttaacccttagttaccggtttagggacccgttaccgggtaccggaacgtaacgggaaccgtaaagggtaacaacggtaaccaaggtaccgtcgtacggaccgttaccatttcccgtagttccgtcggtacttcccgtaactccccgttagtcccgtta

SEQ ID NO: 9863 - DNA, 664 bp, Homo sapiens
  misc_feature: GYAE6OF01B3ZZ1.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctcccttccaccctgtctgcatctgtcggagacagacgtcaccgtcacgttcgccgggccagaccaaagtattaagaccgtggttggcctggtatcgagacaaggaaaccgaagggaaaccgcccctagacctcctagatactataacgacgtcttaactttagactaggtcgggtacccagtacgaaggttcgaggcggcaggtggagtcgtagggactaggtacgttctactctacaacctattacgctacgcctcgacagtcctaggtattagtattttacgactaactttattactacgaccctaataacgttaactaacttacgtttaggtacggtaaccggttaccgggtaaccggtaaacggggtaaccgtaaaggggttacggaaaacttaaccggaaaaccgtacggttagggtacggtacgtacggtacccgtaaccgtacttccgttacgttcctttaccgtacctttccccggttccccggtaccctacgg

SEQ ID NO: 9864 - DNA, 743 bp, Homo sapiens
  misc_feature: GYAE6OF01CO8ST.53.73.G07.1.454.CMB.1.raw
  modified_base (482)..(482): a, c, t, g, unknown or other
  misc_feature (482)..(482): n is a, c, g, or t
tcagcgcgtatacacacgaccggtgctcgatttagctctacgctcagggggagtcagacccagtcaggacacagcatggacatgagggtccccgctcagctccgtggggctcctgctgctctggcctcccgaggtgaccaaatgtgacatccagatcgacccagtcctcccttccaccctgtctgcatctggtacggagacagacgtccaaccgtctacgttcggcccgggccaacggacctaaaaggttacgttaacgaccgttgggttcggacgttagggtactcgaagaccgaaaacggaaaaccggaacgggaaaccgtccccgttaacggtaaccttccgtaggtaattcccgtaaagttaaacgtaccggttacttaacgtttacggacgtaggtccgggtaccctattacggacgttacgaggtcgtacgaggtaccgagtccggtaggacgtaggtacttcctaactcccgtanaacccttagttccgaccgtagtccctagcaaccggtctgtaacttcggttaattttagaacctacgtttaaccttactaccgaactaccgtaaagttaacttaacgtttacttggtaccgtacgggttaaccggaccggaaagggtaacccgtaaagggtacgtaaacgtaaccgaaacgtacggtggtacggtaccgtagacctaccgtaagttcccgtagttccctttaacgaccgtttcccgtacccgtcttaacccg

SEQ ID NO: 9865 - DNA, 149 bp, Homo sapiens
  misc_feature: GYAE6OF01EJGBX.53.73.G07.1.454.CMB.1.raw
  modified_base (122)..(122): a, c, t, g, unknown or other
  misc_feature (122)..(122): n is a, c, g, or t
  modified_base (130)..(130): a, c, t, g, unknown or other
  misc_feature (130)..(130): n is a, c, g, or t
  modified_base (140)..(140): a, c, t, g, unknown or other
  misc_feature (140)..(140): n is a, c, g, or t
  modified_base (145)..(149): a, c, t, g, unknown or other
  misc_feature (145)..(149): n is a, c, g, or t
tcagcgcgtatacacacgaccggtgctcgatttagctctacgctcagggcacgaccggtgctcgatttagcgagacgcgcagggcacgaccggtgctcgatttagatctgatagttgggtcngaggcggntggacaggcntaagnnnnn

SEQ ID NO: 9866 - DNA, 664 bp, Homo sapiens
  misc_feature: GYAE6OF01A6HKV.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaacgccgtggggcctcgagtgatgtactttcctgcacgacatctggataccaccttcaccgaccttcccttatactagttgggtacgacacggcccccgtggacgaggggcttggaggtggagttgggtactaacgtcctaaacccgttaggtggtaggactcgtaactaagttactactaacgaggaagtaagtcggacgacgggaccgtaaattacccaagttacgaaccgagaacgaccgtaccggttacccgaacggtaacgtaacgtacgttaccgtaacgagtagggagggtacgaggccgaggaccgtaggaagtacgtacgtagggacgggaacctaccgggacctacgttggttactttacggtaggtcggtacgtacttggtttaaggtcggttaacgttaaccgtaacttaacgttaattttagttttcgtaccgaccggttaaacccggg

SEQ ID NO: 9867 - DNA, 655 bp, Homo sapiens
  misc_feature: GYAE6OF01EUNAU.53.73.G07.1.454.CMB.1.raw
  modified_base (193)..(193): a, c, t, g, unknown or other
  misc_feature (193)..(193): n is a, c, g, or t
  modified_base (231)..(231): a, c, t, g, unknown or other
  misc_feature (231)..(231): n is a, c, g, or t
  modified_base (572)..(572): a, c, t, g, unknown or other
  misc_feature (572)..(572): n is a, c, g, or t
  modified_base (579)..(579): a, c, t, g, unknown or other
  misc_feature (579)..(579): n is a, c, g, or t
tcagcgcgtatacacacgaccggtgctcgatttagctctacgctcaggggatcatccaacaaccacatcccttctctacagagcctctgagaggaagttcttcaccatggactggacctggagggtcttctgcttgctgtcagtagctccaggtgctcgctccgaggtgcagctggtacagtcggggctgagntagaagacgccggtgggcctgagtgagtgtactttccnggacacgactagttcgtaggtactaccaccttccaacccgtacttaccccttaatacgtacggttacgggtacaccgtaccggtccctagggacgtagggtcctaggaggtggagttggtactaacgtacgaaccgttggtggtacggacttaccgtaataacgttccacgaagtaaggaacgtaacgtcggacccgaaggggtaaccctaacgttaaccgaagttaccggaacgaacggtaacgaccgtacccggtaccgaacgtaagttacgtaacgttacgtaagtacggtagggacgtcgaacggctaacgtcgtagagtacgtcgagtacgacgcnctagttntacgtactggactacgtgttacggttgtacgtacgtacgtaacttaacttacgtttagtttacgcgactaaccggg

SEQ ID NO: 9868 - DNA, 787 bp, Homo sapiens
  misc_feature: GYAE6OF01A5H1W.53.73.G07.1.454.CMB.1.raw
  modified_base (83)..(83): a, c, t, g, unknown or other
  misc_feature (83)..(83): n is a, c, g, or t
  modified_base (172)..(172): a, c, t, g, unknown or other
  misc_feature (172)..(172): n is a, c, g, or t
  modified_base (596)..(596): a, c, t, g, unknown or other
  misc_feature (596)..(596): n is a, c, g, or t
  modified_base (605)..(605): a, c, t, g, unknown or other
  misc_feature (605)..(605): n is a, c, g, or t
tcagcgcgtatacacacgaccggtgctcgatttagctctacgctcagggatcatccaacaaccacatcccttctctacagaancctctgagaggaaagttcttcaccatggactggacctggagggtcttctgcttgctgtcagtagctcaggtgctcgctcccgaggtgcngcgtggtacgtaaggtcggggctgaagtagtaggaaaggaacggtccgtacggggcctacgtagtcgtatagtactttccaggaccaacgtacgtactacgtaggaactaaccgtaccttacccaccgtaccttaccttaataacgtaggttacgggtacgaaccgaccgggtaccccgtagggacggtacgggtaccgtttaggaggttggaacggtttacgggtaactaaccttaaccgtaacccggttaggtacggtacggtaacttaacctaaacgttaagttacctaacgaacaaggtaacgtagtacgaaccgggtaacggtaaccgtaattaaccgaagtaccgtaaccgaacggaacggtaaccttaaccggacctaacggtaacgtaacacgtacgttaacggaagtgggaaggngacgtacgngttaccgagtaacggtactacggacggaaccggtacgtaacgggtacttaaggttacgtttaacggttattaccggttaggtacggttacgtttacgggttaaggtttcgttaaaacgtttaaacccgaaactttaaccgtttaaagtttactttaacgggtaccgtaacgggtaacccggg

SEQ ID NO: 9869 - DNA, 712 bp, Homo sapiens
  misc_feature: GYAE6OF01ERX72.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgcctcccgaggtgcagtcgtaggtacaggtcgggggctaggagagtagaagacgccgtggggcctgagtgatcgtacttccgtgacacgactatcgtagactacctacccttaccgacccgtaccttacccttaatacgtacggttacgggtaaccgaccggtaccggtcccccgtaggggacccggtagggggtccttgggtacggtggggtagtcgggttacctaacgtaccgtaaccggttaggtcgggtagtacttactaacgtaacttctacaacgagaacgtagcggaccgtaacggtaccgtaaataccgagtacgaacgaagactaccgaccggtaaccgtaacggacgtaacgtactaaccgtacgtaggtagggacgtacgacgtcgacgtcgtaggtaacgtcgttacgacgggtaacgacgacgtaccgtagttcgttaacgttaccggtgaccggtcgtttaacgttggtttaaggtcgttaaaccgtacttaaaccgttaattacgttttagtttaccgtaccgtacgtaacccggg

SEQ ID NO: 9870 - DNA, 647 bp, Homo sapiens
  misc_feature: GYAE6OF01AQSB1.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgccagctggtacaatcggggctgagatgaagagccgtggggcctcagtgatgatttccgtgcacgacatcgtggacacaccttcaccgacctccttatactatgggtacacacggcccctggacagggtcttcggagtggagtcgggtactaactccaacccgtggtcggtggtacttacctaacgaagttacctcaacctaagacgaattcggacgtaacggggacccgtaaatttacccgagtacgaacccgtaggacgaacaacggtcccgaacgtaacgttacaacgttactaacgacgtgggacggtagacgtcgaggccctagggaacgattcccgtaggtacgggaaccgtaccgggacctagtacggttacgttacgttgtacggtacggtatttaccgttaggtacggttaacttaaaccggaaccttaaacgtaactttacgttttcgtacgtaaccggtaccccgg

SEQ ID NO: 9871 - DNA, 693 bp, Homo sapiens
  misc_feature: GYAE6OF01B9Z15.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagcgtggtacaagtcgggggctgagatagaagaacgccgtggggcctcgagtgatgtactttccgtgcgacgactatcgtaggactaccctaccgttaccacccgtacccttacccttaataccgtagttacgggtaccgaccgtacccgggtcccctagggacggcggggtcttagggtacggtggtagttcgggtacttaactacccgtaacccgttagggtcggtaggtacttactaacgtaagttccgactaacgaagaagaagtcggacgacggggtaactaactacgaagttacgacagaacgaccgaccgtaaccgacggtaactacgtaacgtctagtagtgggtagtacggtacgacgtacgcgtaggagtacgtacgtacggacggaccgtacggtaccttagttacgttacgtttaccgtgtcgtacgttcgtttacggtaggttcggttaataacccggttaattaaccgttaattttacccttggtaccgtacccggttaaccgggg

SEQ ID NO: 9872 - DNA, 757 bp, Homo sapiens
  misc_feature: GYAE6OF01A93P3.53.73.G07.1.454.CMB.1.raw
  modified_base (229)..(229): a, c, t, g, unknown or other
  misc_feature (229)..(229): n is a, c, g, or t
  modified_base (744)..(744): a, c, t, g, unknown or other
  misc_feature (744)..(744): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagccgtggggcctcagtgatgatttccngcacgactatcgtaggactacctaccctttccgaacccgtaccttccccgttaataccgtagtttacggggtaaccgaccgtaccgggtaccccccgttagggaaccgtagggggtccttagggaggttacgggtaagttcggggttaaccttaaaccgtacccgtaaaccccgttagggttacgggtacgggtaacttaccgttaaaccgttaaaacgtttacccgtacgaaaccgtaggaaacgtaagtacggaacggtaaccggggtaacctaaactttacccgaagttaccggaacccgaaggaaccgtaaccgaacccggttaccgaaaccggtaaggtaaccgtacggttaccgtaacgtaggttacggggaacggttacgacggtaccgacgtcccgtaggtaacgtacgtacgtacgggaacggacccgtacgggaccctagtacgtttaagtcttggtcgtacgtattacgtaggtagttaactacgtacttaacgtatttagttntcgccggtaaccg

SEQ ID NO: 9873 - DNA, 717 bp, Homo sapiens
  misc_feature: GYAE6OF01ET745.53.73.G07.1.454.CMB.1.raw
tcagcgcgtatacacacgaccggtgctcgatttagctctacgctcagggggagtcagacccagtcaggacacagcatggacatgagggtccccgctcagctccgtgggctcctgctgctctggctccgaggtcgaccaaagtgtagactatcccaagatacgaccctagtcctacccttccacctgtctgctatcgtgtcggagacgagtagtaccaccgtctacgtcgccggacaacgactaaagtataacgacgttaggtcgcgttgtactacaacgagaaacaaaaccgtacgggaaacgccctagacctccgtatacttagtaagtaacgacgttacttacttaacgacgtagggtcggtaccagttacgaaagtcgagcggctaggtcgactcgacggataggtactacgtactcctaagaacctagtacgaccgtacgtcgtcgtacctagtccgttaggtattagttaaccgtttacgaaccttaaacgtttagttaacccgtacgtaccaaaccgttaaacttaaacgtaagtttaccggttttaggaaccgggtttaccggttaaccgggaacggttaaacgggaaacgtaaaggggtaaaccttaaaacggtaaccgtaaaacgggtaacgtaggtccgtacgtaccgacctaaccgtaccgttctacgttacgttaccgtacctttcccgtacccgtaacttaccg

SEQ ID NO: 9874 - DNA, 866 bp, Homo sapiens
  misc_feature: GYAE6OF01ACF3O.53.73.G07.1.454.CMB.1.raw
  modified_base (855)..(855): a, c, t, g, unknown or other
  misc_feature (855)..(855): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctcctccaccctgtctgcatcgtggtcggagacagacgtccaccgtctaccgttcggcccgggtaccagacctaaaagttacgtaacggtaccggttgggttacggtccgttagggttactaccgacggtaaccaacgggtaaaaacccggaagggggaaaccgtaccccccgtaaggaccttaccgtagtaacgttaccttaacgttaacgtaccgtttaccttaaccgtttaggaaccgtacgggttccgggttaccccgtataccggtaacgggttccgaacggccgggtacgtaaggttacggaacgttcgtacggggtaaccgtacggtacggtttaccacgttacctaaccgaccttacggtttacgacccgtaaggtccccgtagtaccgtaaccggtcgttaacggttacgttacgtttaaccgttttacggaaacccttttaacctttaaacgttttacgacccggttaaccgaaacgtttacgttaaacctaacgtttttacggttcgttaccgggttacccggttaccgggaaccggtaaacggggttaacgtaaacggggttacgtaaaaaccgtcgaaaaccgggttcgtaacgggtttccgaacggttaccgacccttaacgtaaccgtttccgttaacgtttccccttaacgtttaaccccttcccggttaaccccgtntttaaccccgg

SEQ ID NO: 9875 - DNA, 744 bp, Homo sapiens
  misc_feature: GYAE6OF01DUQWU.53.73.G07.1.454.CMB.1.raw
tcagcgcgtatacacacgaccggtgctcgatttagctctacgctcagggggagtcagacccagtcaggacacagcatggacatgagggtccccgctcagctcgtggggctcctgctgctcgtggcctcccgaggtcgaccaaatggtcgacactccaagatcgaccctagtcctccgtcccaccctgtctgctagtcgtggtacggacgacgagtacgtcaccgtcaccgttcggccggaccaacgacctaaaggttactaacggccgttgggttacggtcctaggtactcgaaggaccgaaaacggaaaccggaaggggaaaccctccccgtaacgtccttccgaagtacttaaccgtaagtaaacgttcgtaccttaagttacggacgtacgggtacggtacccaagtcgttaacggtcgacgggacgtacgtaggtacggacttacggggaggaaacctcgggttaacctttaacaccgttactacccgtaaacgtacgtttaaacgccgtacggtcccgtagaccgtacgtccgttagtagttaggttacttcgaaaccttacgttacttaccgtacgaaccttaacgttagtaactacggtttacgtttcgggaccgttaccgggtacggtaacggtaaccgggtaataacgggataaacgtacgtaaacggtgtacgggtacgacgttcggacttactagtcgttctacccttacgccctttacccggtccagtaccg

SEQ ID NO: 9876 - DNA, 873 bp, Homo sapiens
  misc_feature: GYAE6OF01BSLUT.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcgggggctgagataggaagaagccgtggggcctcagtgatgtatttcctgcacgactatcgtaggactacctaccttccacccgtaccttcccttaatacgtagttcgggtaccgaccgtacgggtcccccgtagggaccggtacgggggtccttagggaggttacgggtacgtttacgggggttaccttaaacgttaccccgtaacccggttaggttcgggttacggtaacgtttaccgttaaacgttaaacgggttttaaccctaccgaacgtaacgggtaaagtaaacggttcggaacccggtaaacgggggtacccttaaaaccgtttaacccgtaagttaccgggaaacccgtaacggaaccggtaacccgtacccggttaaccccgaccgggtaaacggttaaaccgacgggtttacccgtaacgttaggtacgggggtaacggttacggaacggtaccgaaccggtaccggtaggtaacgtacggttaccggttaacgggaccgggtaacccggtaacccgggtccgttaacgtttaacggttacgtttaaccggttgggttaacggttacccgttacgttttaccgggtttaagggttacgggttaaacctttaaacccggtaaactttaaacgtttaacgttttaacggtttttccgaaccgtaaccggtaaccccgggg

SEQ ID NO: 9877 - DNA, 705 bp, Homo sapiens
  misc_feature: GYAE6OF01DQ0KK.53.73.G07.1.454.CMB.1.raw
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (547)..(547): a, c, t, g, unknown or other
  misc_feature (547)..(547): n is a, c, g, or t
tcagcgcgtatacacacgaccggtgctcgatttagctctacgctcaggggatcatccaacaaccacatcccttctctacagaagcctctgagaggaaagttcttcaccatgactggacctggaggtcttctgcttgctgtcagtagctccaggtgctcgctcccgagtgcagctggtacagtcggggctgagatagaagacgccgtggggcctcgagtnatgctttccgngacacgacagtcgtagactacctaccttaccgacccgtaccttcccttatacgtgttacggtacgaccgacggccccgtggacgaggggtctggaggttggtacgtcggtactacgtaccacccgtaggtcggtgtatactacgtaacgttacacgtacgaagaagtacgtacggacggtaacggggtaccgttaaacttaaccgaacgtacgggaacgaacgtacgtaacccgaccgttaacccgacgtaacggttaacacggtaccttaagacgggtagggtaggtggaaccgacgtaccggccgtaggaacgtntacggtaggacgggaccctaccgggtaacttattcgggttaactttcgtagggtttaccgacggttaactttaggggtttaggttacccggtaaacgtttactaaacccgttttaattaaaccgttttgtttaacccgtccgaacggtttaacccggg

SEQ ID NO: 9878 - DNA, 712 bp, Homo sapiens
  misc_feature: GYAE6OF01CRI7M.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagcgtggtaacagtcgggggctgagatgaagaagccgtcgggcctcagtgatgtactttcctgacacgacatcgtaggactactaccttcacccgtaccttacccttaagtacctagttacgggacgaccgaccggccccgtgggacgacggggtcttaggagtgggacgttacgggtacttaaactaccgtaacccggtagggttcggtacggtaacttacgttaaccgtaaagttttaacccgacaaacgtaggtaaacgtaacgttacgggacgaaacggggtaaccctaaacttaaccgaagtacgaaaccggtgaaccgtaaccgtacgtaccgaaacgtacgtaactacgtctacggagttacgggagtcgactaccgacggtcctaggaacgtatacggtaagacggaccgtaccggtactagttcgttaaacttcgagggttcgcgttaacttgggtttaagtcgggtaaacttttacccgggaatttaaacgttaagtttttacgtttcggaaccgtccggtaaacccggg

SEQ ID NO: 9879 - DNA, 787 bp, Homo sapiens
  misc_feature: GYAE6OF01CKZ6O.53.73.G07.1.454.CMB.1.raw
  modified_base (192)..(192): a, c, t, g, unknown or other
  misc_feature (192)..(192): n is a, c, g, or t
  modified_base (239)..(239): a, c, t, g, unknown or other
  misc_feature (239)..(239): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggntagagataggaagaagccgtggggcctcgaaggtgatgacttttccngacacgacatcgtggactacctaccttacaaccgtaccttacccttaagtaaccgtaaggtttacggggtaacgacgaccggtcccccgtagggaccgacggggtctttaggaaggtgggtagttacgggtacctaaagttacccgtaaacccgttagggtaggtaggtaccttacgtaaacgtaaacgtttaacctacaaacgaaaggtaacggtaacgtacggacgtaacggggtaaccccttaaattaacccgaagttacgaaccgaaggacgtaaccaccggtacccgtaacggtaacgtaacgtaacggttacaaccgtaggtaagggacggtagaacggacacggtaccgtagtaaacgtacgtacgtaacgggaacggaaccgacgggtaaccgtagttaacgtttaacgttaacgttggtacgggtaaccgttaacggtttaaccggttaagggtttacggtaaacgtttaaaccgtaaaccgtttaaacgttaaaagtttttacggttttttacgaacccggttaccggtaaacccggg

SEQ ID NO: 9880 - DNA, 797 bp, Homo sapiens
  misc_feature: GYAE6OF01AHL58.53.73.G07.1.454.CMB.1.raw
  modified_base (278)..(278): a, c, t, g, unknown or other
  misc_feature (278)..(278): n is a, c, g, or t
  modified_base (530)..(530): a, c, t, g, unknown or other
  misc_feature (530)..(530): n is a, c, g, or t
tcagcgcgtatacacacgaccggtgctcgatttagctctacgctcaggggatcatccaacaaccacatcccttctctacagaagcctctgagaggtaaagttcttcaccatggactggacctgggagggtcttctgcttgctgtcagtacgctccgaggtcgctccgccttcccgagggttcgctaggtcgttaggtaacgtaacgggtcgggggtctaggaagtagtaaggaaacggacggccggtcggggcctacgtaggtgtatgttaccttccncgaccacgatactcgtagtaacctcctaccttccgaaccgtaccttaccttaagtacgtacggttacgggtaaccgtaccgaccgggtaccccggtagggaaccggtggttcgttaggtacggtaggtaggttacggtaacctaaccgtaccgtaaaccggtgggttggtacgttacctaacgttaacgttaacgttaccgaacgaacgtaaggacgtaacggtcgaacggtaacggtacctaactaccganaaccgacgacggaacaccgtaaccgtacgaaacgtaacgtactaacggttacaacgggtaggtacgggacgacgacgcgtacgtaccggagtacgtaacggtcggaacgggaaccggtacctacgggtataaccggttaggttaaccgttacggtggttaacgtagtttaccggttaggttaacggttaaccggttacttaaaaccgggttactttaaaaggttttcctttaaggggtttacccaacccggtacccggttaaacggg

SEQ ID NO: 9881 - DNA, 835 bp, Homo sapiens
  misc_feature: GYAE6OF01EWOC9.53.73.G07.1.454.CMB.1.raw
  modified_base (380)..(380): a, c, t, g, unknown or other
  misc_feature (380)..(380): n is a, c, g, or t
tcagcgcgtatacacacgaccggtgctcgatttagctctacgctcgagggggagtcagacccagtcaggacacagcatggacatgacgggtcccccgctcagcctccgtgggctcctgctgctctggcctcccgaggtcgaccaagtgtagacactaccgagtactacgaccctacgttccctccctttacccacccgttggtctagacctatccgtcggtacggaagaccgagtacgtcccgtaaccgtcctacgttccgggaccccggtaccaacgtaaccgtaaaaggttaacttaaccggtccggtttcgggttccggcctttagggtaactaccgaacggaaccgaaacggaaaacccggaacggggtaaacccnccccgttaaggtaccctacgttagtaacttaccgtaaagtaaccgttaccgttacctttaacgttaacggaccgtaacgggttccgtaccctaaggttacgtaacggttcgacgggtacgtacgtaaggtcgttacgtacggtaacgggaaccttaaggttacccgtaaccgtacctttaccgaacccgtttaaaccgtattaacccggaccgtaccgtaccgtaccgtaccgtacgtaccgttagttacgttacgtttaacgtttaacgtaacctttaacgtttaccgttaactaaccgtaactaaccgtacttaactactttacggtacggttacggttaccggtaccggaacggtaaccggtaacgaacggttacgaaacgtaacgaaccgtagtacggtcgtactcgacctacgtcttacgtccgtcttacacccttcgtaccccgtgtac

SEQ ID NO: 9882 - DNA, 766 bp, Homo sapiens
  misc_feature: GYAE6OF01BK4G4.53.73.G07.1.454.CMB.1.raw
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgcctcccgaggtgcagcgtaggtacgaaggtcggggctgagagtagaaggacggccgtcggggcctcgaggtgattgtactttccgtgcacgactatcgtagtactacctaccttccgacccgtaccttacccttaagtacgtaggttacggtaccgaccgaccggccccgtaggacggagggtcttggaggtggtagtacggtactaacgtaccgtaaccgttaggtggtacgtattacgtaactaacgttactacgtaacgaaggtaagtacgtacggacggtaacggaaccgttaaaccgttaaccgacgttaacgaaccgtaagaacgtaccgtaccggtaacacggtaaacgtactacgtacgtaacgtggtacgggagtacgacgacgtcggtaccgtagacgtacgttcgaacgggaccggtaaccgtaaccgtacgttaacgttggttaaccgtttacggtacgggttaccgtacggtttaaccgtttaaggttaccggggtttaactaaacccggttttaaacccgtaaacgttttaaaccgttttaaaacgtttttacgggtttacccgtacgggtaaaccccgttaaacccggggg

SEQ ID NO: 9883 - DNA, 770 bp, Homo sapiens
  misc_feature: GYAE6OF01BI3RJ.53.73.G07.1.454.CMB.1.raw
  modified_base (249)..(249): a, c, t, g, unknown or other
  misc_feature (249)..(249): n is a, c, g, or t
  modified_base (568)..(568): a, c, t, g, unknown or other
  misc_feature (568)..(568): n is a, c, g, or t
tcagcgcgtatacacacgaccggtgctcgatttagctctacgctcaggggatcatccaacaaccacatcccttctctacagaagcctctgagaggaagttcttcaccatggactggacctgggagggtcttctgcttgctgtcagtagctccgaggtgctcgcctcccgaggtgcagcgtaggtacaaggtcgggggctggagagtaggaaggacgccggtcggggcctgaggtgattgtactttccgngacgaacgtacatcgtagtactacctacccttaccgacccgtaccttacccttatacgtaggttacgggtaccgaccgtacccgggccccgtagggaccggtacggggtcttagggacggtggtacgttcgggtacttaacgtacccgaaccgttaggtaggtacggtacttaccgtaagttaaaccgttactaccgaacgacggtaagtacggtacgggaccgaacggggtacctaaaccttaccgagtaaccggaccgtaaggaacccgaaccgtacccggtaccgtaaacgtaaccgtaacgtaaggttcctaagnggttaacgggaggtacgcgacgacggtccgtaggccttagacgggtacgaccgggtacgaaccggttactacggttacgtttaagttcggttaccggtaggtccgttaacggttttacggttaaggtacggttaaacttaaccggttaaaccttttaacgttagttttaccggtttacgtacccgtaaccgggtaaaccggg

SEQ ID NO: 9884 - DNA, 774 bp, Homo sapiens
  misc_feature: GYAE6OF01BY6VE.53.73.G07.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (355)..(355): a, c, t, g, unknown or other
  misc_feature (355)..(355): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcggggntgaganagaagagccgtggggcctcgaggtgatcgtacttttccgtgaccaaccgactatcgtacggtatacccgtaccctttaccgaaccccgtaccctttcccttaactaacttaggtttaccggggtaaccgacgaccgggtcccccgtagggaaccggnggggtactttggagggttaggtaggtcgggtttaactaaccgttaccgtaaacccgttagggttcgggtacggtaacgtttaccgttaaacgttaaacggtttactaacccgaacgtaaggaacggtaaactcgggaccgaaaccgggggtacccgttaaaactttaccgaagtaccggaaccgaacgaaccggaaccgtaaccgtacccgaacgttaacgtaaccgtaacgtaccgtaacgaggttaggggtaggtaggacgacgtacggtaccgtggacggtaatcggaggacgggaaccgaccggacctagttaagttacgtacgttgtacgacggtacgtttcggttaggtcggtaaacgttaaccgtaaccgttaaattaattttaaccggtttcgtcgtaacccgggtaccgg

SEQ ID NO: 9885 - DNA, 1061 bp, Homo sapiens
  misc_feature: GYAE6OF01EYL4B.53.73.G07.1.454.CMB.1.raw
tcagcgcgtatacacacgaccggtgctcgatttagctctacgctcagggggagtcagacccagtcaggacacagcatggacatgacgggtccccgctcagctccgtggggctcctgctgctctcggcctcccgaggtcgaccaaaagtgtacgactactaccgagaactacgacccgtagttcccttcccttacccgacccttgttccgtcgactacgttcgtcgggtacgaacgaacgaacgtacgtaccgtaaccgttcgtaccgttacgggacccggtaccaacgtaaaccgtaaaagttaacgttaaaccggtaccggtttcggggttacgaccgtttaggtaacgttaccgaaacggaaccggaaaacggtaaaaacccgggaaacgggtaaaacccgtaccccgttaaacgtaccgttaccgttaagtaaccgttaacgttaaaacggtaaaccggtttaacccgtttaaccgtttaacggtttaaccggaaccggttaaccggggtttccgggtaacccttaacgggttaaaccggtaaaccgggtttaccggaaccggtacgggtaccggtaaagggtttcggtaaaccggttaccggggtaaacggtaacgttaacggtttaccggttacctaaccccggtttaaacgtaccgttaaaacccggtagtttaacccggaaccgtaccgggttaaccgtacggtacccgaacgttaccgttaacggttaagtttaacgtttaacgtttaacgtaaaccgtttaacgtttaaaccgtttaccgaaccgtaaaccgtaaaccgttaaaccgtttaaaccgttaagtttaaccggttttgggaaaccgggtttacccggtaaacccgggtaacgggtaaaaccgggtaaacgttaaacgggtaaacgttaaaccgtaaaaccggttaaacgttaaccggtaacggttcccgtaacgggtacccgttaaaaccgtacccgttaagtttaccccgtttaccgtttacccgttaacccgttacccctttaccccgggttaaccctaccggtttaaaccgg

SEQ ID NO: 9886 - DNA, 651 bp, Homo sapiens
  misc_feature: GYAE6OF01EEZTC.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgctcccaggtgcagctggtaacagtcggggctgagatagaagaggccgtgggcctgagtgatgtacttccgngcgacgacagtcgtgaacaccgtacccttcacccgtaccttacccttatactagttggtaaccgaccgacggccccgtaggaccgtaggggtcttggacggtggtacgtcgggtactaaactccaaccgtaggtggtgtactacgtaacgtacgtactacgaagtaagagtaatcggacgtaacgggtaccgtaatacctagtacgaacgtaagacgaacctacgtaccgaacgagtaaccgtagtactacgaggtaggtaggtgacgcacgtccgtagacgtactacggtaggacgtaccgaccggtactagttagttacgttagtggtaccgtagtacgtttacgttaaggtgggttaaaccttaacggtaaacttaacgttaacttttagtttacgtacccgaggttaacccggg

SEQ ID NO: 9887 - DNA, 740 bp, Homo sapiens
  misc_feature: GYAE6OF01ADOIC.53.73.G07.1.454.CMB.1.raw
tcagcgcgtatacacacgaccggtgctcgatttagctctacgctcaggggatcatccaacaacctacatcccttctctacacgaagcctctgaggaggaaagttcttcaccatggactggacctggagggtcttctgcttgctgtcagtagctcaggtgctcgctccaggtgcagctggtacagtcggggctgagatgaagacgccgtggggcctcagtgatgtatttcctgcgacgactagttcgtaggactacctaccgtttccaacccgtaccttacccctttaatacctagttacgggtaaccgtacgaccgggtcccccgttagggaccgacggggtcctttagggaaggttcgggtaacgtttcggggtaccttaaacgtacccgtaaaccccgttagggttcgggtacgggtacttaccgttaacgtaaacggtttacctaccgaacgtaacggaaggtaacgttcgggaccggtaacggggtaacccgtaaacgtttacccgacgttaacggaacctaggaaccgtaaccgtaccgtacccgtaacggtaacgtaacgtacggttactacgtaggtacgggaacgggtacgacggccgaacgtccgtacggagtaccgtacggtacggaccggtaccgtaccggcctagttacgtaacttcgtacgtacgtaccgtattacgttaggttcgaaccttaacacttacttaattcttttacgctaacgtaccgg

SEQ ID NO: 9888 - DNA, 1016 bp, Homo sapiens
  misc_feature: GYAE6OF01BJQ5O.53.73.G07.1.454.CMB.1.raw
tcagcgcgtatacacacgaccggtgctcgatttagctctacgctcaggggatcatccaacaaccacatcccttctctacagaacgcctctgagagaaagttcttcaccgggggggatggactggaccgtggagggtcttctgcttgctgtcagacgcctccgaggtgctcgcctcccgaggtgacgagtcgtaggtaacgaacggtcggggctagaagagtaggaaggacggtcccggtacggggtccctagtaggtagtagtacgttacgttttcccgtacggaccgaaccggtaactacgttcggtaacggttaaccttaaccccgttacccttacccgtaaccccgtttaccctttaaccccgtttaagtaaccggttaacggttaccggggtaaccaacccggtacccgggtccccggttacgggtaacgggtacgggggttaccgttaggggtacgggtaggggtttacggttacgggttaaccttaacgttaaccccgaaaccgggtttgggttagggttaaccggtaacttaacccggtaaacgttaaccgtttaaccgtacccgaaagtacggtaaacgtaccggtacggtaaacccggggtaacggggttaaccccttaaaacgttaccggtaacgggaaacccggaaccggtaacggaaaccccggttaacccgtaaccccggttacccgggtaaaacgtaaaccgggtttaacgttaacccggttaaccggtaaccggttaggggttacggggtaacggggttaacaccggtaaccgggtaacccttaccggggtaacgttaacggttacccgggtttaaggaaccccggggttaaacgggtaaccccgtaaccgggttaaaccttaggttttaccggtttaaacccggtttgggtacgggttaccgtaagggttttaaacttccggggttttaaaagggtacccggttaactttaaacgaaccctttaggttacgttttaagtcgacccgggtaaccggttacg

SEQ ID NO: 9889 - DNA, 665 bp, Homo sapiens
  misc_feature: GYAE6OF01CNAAS.53.73.G07.1.454.CMB.1.raw
  modified_base (351)..(351): a, c, t, g, unknown or other
  misc_feature (351)..(351): n is a, c, g, or t
  modified_base (423)..(423): a, c, t, g, unknown or other
  misc_feature (423)..(423): n is a, c, g, or t
  modified_base (507)..(507): a, c, t, g, unknown or other
  misc_feature (507)..(507): n is a, c, g, or t
  modified_base (522)..(522): a, c, t, g, unknown or other
  misc_feature (522)..(522): n is a, c, g, or t
  modified_base (538)..(538): a, c, t, g, unknown or other
  misc_feature (538)..(538): n is a, c, g, or t
  modified_base (579)..(579): a, c, t, g, unknown or other
  misc_feature (579)..(579): n is a, c, g, or t
tcagcgcgtatacacacgaccggtgctcgatttagctctacgctcaggggatcatccaacaaccacatcccttctctacagaagcctctgagaaggaagttcttcaccatggactggacctggagggttcttctgtcttgctgtcgagtacgctccgaggtcgcctcgcctcccgaggtcgcagcgtaggtaacgacggtcggggctaggagagtaggaagacgccggtgggtcctgagtgatcgtactttccgagacgacgactagtacgtacgactaacctacttacccgaacctacttacctacgtacgtaggttcggaaccgaccgtacccggtcccgaggaaccgngggtactaggaggtaggtacgtacggtactaacctacctaacggtgtcggagtaactacgtaaagaacttanacaagagtaagagtcgacgacgggtaacctaagtaccagtaccgaacgacgaactacccgactacgaaggtacgtacacgttangaaggtggaacggtnacggacgagacgtagngaagtacgaagggcgaacgacgtacgtatagttagtaacgnggtacgacgttgttacgaagtttacggaaatttaccgtaacgtttacgttaaacgtttttggaccaaaccgggtccgtaaaccggg

SEQ ID NO: 9890 - DNA, 929 bp, Homo sapiens
  misc_feature: GYAE6OF01ALZKK.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgcttgtcagtacgccgtccgagggtcgtcctacggccttcccgagggtcgcgaggtcgtagggtaacaaggtcgggggctaggaagagtaaggaaacggaccggtcccggtcggggtccctagtacggtaggtattcggttaccgtttccgtacgaccaacgtaacacgtttacggtacggtaaccttaccctacccgttacccgtaacccgttacccttacccgtttaataaccgttagggtttaaccggggtaaccgtacccggaccgggttaccccggtcggggaaccggggttacggggttaccgttaggggtaacggttcgggggtaacggtttacgggttaacccttaaccgttaaacccgggtaaaccggttggggttaacgggttacggtaaacctttaccgtaaacggtttaaaccgttaccgtaacgaaacgaacggtaagacggtacgaaccgggggaaccggtaaaccgtttaaactaaccgtacggttaaccggaacggtaacggtaaccggtaaccggtacccgtaaccggtaaaccggttaacgtaacgttaacgggttacctaagggtaaccggggtagggtacggtaccgggaacgtacggttaccgacgtaggtaacgtcggtaacgggtagtaacccggagggtaaccgtaccgtaggtttaccggtacgttacggttacggtaccgtacggttaacgtttacgggttagtacgttaaccgttacgaagtttaaacctttagttaccgtttacgacggtaccggtaaaccggg

SEQ ID NO: 9891 - DNA, 744 bp, Homo sapiens
  misc_feature: GYAE6OF01EDEPJ.53.73.G07.1.454.CMB.1.raw
  modified_base (598)..(598): a, c, t, g, unknown or other
  misc_feature (598)..(598): n is a, c, g, or t
tcagcgcgtatacacacgaccggtgctcgatttagctctacgctcagggggagtcagacccagtcaggacacagcatggacatgagggtccccgctcagctccgtggggcctcctgctgctctcggcctcccaggtgaccaaatgtgacatccagatcgaccctagtcctccgttccaccctgtctgctacttctcggtaccggagacaggtacgtccgacccgttcaaccgttcggaccccgggaccaaggtaccgtaaaagttacttaacggtaccgttgggttcggccgttaggtactacgagaccgaaacggaaaaccggaacgggaaacctccccgtaagtacctaccgtagtaacttacgtaaagtaacgtacgttacttaacgtttaggacgtagggtcgggtaccctaagttacgaacggttcgaacggtccggtacgtaggtcgggttacgtacggtagggaactaggtaacgttcctaccttcctaccgtaactaggttacgaccgacgtccgttacgaccgtacggccttaggtacctttgttaacggtttcaacctttaacgtttactaaccgtcaacccgttaanaacgttaactttaagtttacgttgggtaaccgggttaccggttaccgggaacggtaaacggtacggtaaaggtacgtaaacgaccgtaaacgtggttacgaggctacgactctagttctacgttcttacctcgtcccgtctctacg

SEQ ID NO: 9892 - DNA, 764 bp, Homo sapiens
  misc_feature: GYAE6OF01B6F5C.53.73.G07.1.454.CMB.1.raw
  modified_base (133)..(133): a, c, t, g, unknown or other
  misc_feature (133)..(133): n is a, c, g, or t
  modified_base (157)..(157): a, c, t, g, unknown or other
  misc_feature (157)..(157): n is a, c, g, or t
  modified_base (590)..(590): a, c, t, g, unknown or other
  misc_feature (590)..(590): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttntgcttgctgtcagtagctcaggtnctcgctcccgaggtgcagcgtacggtacgaggtcgggggactggagtagtaggaaacggaacgtcccggtcgggggccctagaggtaggtactagttaccgtttccgtaggaccgaacgtactacgtcgtacggtaactaacccgtacccttaccgaaccccgttaccctttacccgtttaataaccgttacgggttacgggtaacccgaacccggtaccgggtacccccggtagggaaccgggtcggggtactttggggacgttagggtacgttcgggttaccttaacgtacccgtaacgtacggttggtacgtactacgttaacgtaagttaaccctgtaacgaagagtacgtacggacgggtaccggtaacgtaacttacgacggtacgaaccgagaacggaccgtaccgtaccgtaacggttaccgtanacgttaccgtaggtaggttacgggacggtgaacggtacgaggcccgtgaacgttagcgtaacgggtagaaccgccggtattccgtagttaacgtgttcggtacgtaccgtattacggttagtagtacgttaccggattaaactttacgtttattacgaaccgttccgtaaccgg

SEQ ID NO: 9893 - DNA, 762 bp, Homo sapiens
  misc_feature: GYAE6OF01BO0ZN.53.73.G07.1.454.CMB.1.raw
  modified_base (177)..(177): a, c, t, g, unknown or other
  misc_feature (177)..(177): n is a, c, g, or t
  modified_base (202)..(202): a, c, t, g, unknown or other
  misc_feature (202)..(202): n is a, c, g, or t
tcagcgcgtatacacacgaccggtgctcgatttagctctacgctcaggggatcagtccaacaaccacatccccttctctacagaagcctctgagaggtaaagttcttccaccatggactggacctgggagggtcttctgcttgctggtcagtagctccaggtgctcgctccaggtcncagctggtacaagtcggggctgagntgaagagccgtgggcctgagtgatacggtatttcccagctaacgacgtactcgtggtactacctaccttaccacccgaaccttacccttaataccgtagttgggtaccacgacggcccccgtaggaacgtacggggtcttaggaggttacggtaggtacgggttaccaaacgtccgttaaaaccccgtagggttcgggtagtaaccgttccttaaacgaaacggtttaacgttaccgaaacctaggaaacgtacggtacgaccggtacgggtaaccggtaaacttaccggtacgtaacggacccgtaagacgtacctaacccggttccaacggtaaccgttaactaacggtttaccacggtaacggtaacgggttacgggtggaaccggcgtacggtaccccgtaggtaactaaccgttccggtaaggggtaacgaaccgggtacccgggaaccttagtaacggttttagtacgtacggtcgtaccgtattacgggtttacggtaggtaacctaacgttacggtaaaccttagttagtttactaccggtacgttacccgg

SEQ ID NO: 9894 - DNA, 727 bp, Homo sapiens
  misc_feature: GYAE6OF01EQJ1E.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctcaggtgctcgctcccaggtgcagctggtacaagtcggggctgagatgaagagcctggggcctcgagtgatgtactttcctgcacgacatcgtggataccacctttccaccgaccttacccttatactagttacgggtacgaccacgggccccgtgggacgtagggggtcttcgggtaggtcggtagtgggtactaacgtacaacccgttaggtgggtagacttctaactaacgttactacactaggaagtaagtgacgagggtaccgtaaacttaccgagtacgtaacccgtaaggacgtaaccgtaccgtcccgaaacgtaacgtaccggtaagttacccgtaagtaacggttcgggaagggtacggtaacggacggacggtaccggtaggaaccggtagtaacgttacggggaacggtaacccggtaacccggacgtaagtttacgttaacggtttacggttacggttactaccgggttactttcgggttaaggttcgggttaaaccgttaaaccggtaaaccgtttaacttaaacgttttaggttttacgtacccgttaacggtaaacccgggg

SEQ ID NO: 9895 - DNA, 766 bp, Homo sapiens
  misc_feature: GYAE6OF01CVTC3.53.73.G07.1.454.CMB.1.raw
tcagcgcgtatacacacgaccggtgctcgatttagctctacgctcaggggatccatccaacaaccacatcccttctctacagaagcctctgagaggaaagttcttcaccatggactggacctggagggtcttctgcttgctgtcagtagcctccgaggtcgctccgcctacccgaggtgcagcctaggtacgaaggtcgggggctggaagtagagaaaggaacgtccggtcggggcccttagaggtagtagttcggtactttccgcgacgaacggactagttcgtaggtaacctacccttaccctccgaaccctccttaacccttaagtacgttacggttcggaaccgacgaccgggtccccgtaggtaacggtcgggtcttaggaggttggtagttcggtaactaacgtaccgtaaccgtaggtcggtagtaccttaacgtaacgttaacgttacgaccaacgaaaggtaacgtaagtacgggaccgtaacgggaaccttaaacgtaccgaacgtcgaacgtacgaaccgtcgtaacccgaacgtaacggtaacgtaacgtaacgtaccgtaagtaggtacggggtaagacgggacaaccgtacggtccgtaaggtacgtacgttacgaacgggacggtaaccgacgttacgattaccgttacgtagttcggtagtaccgtaagtttggttaacgggttataaccgttaaacccgttaagttaaactttaacgtttattaacggaacccgtcggttaacccgggg

SEQ ID NO: 9896 - DNA, 682 bp, Homo sapiens
  misc_feature: GYAE6OF01AONOR.53.73.G07.1.454.CMB.1.raw
  modified_base (237)..(237): a, c, t, g, unknown or other
  misc_feature (237)..(237): n is a, c, g, or t
  modified_base (635)..(635): a, c, t, g, unknown or other
  misc_feature (635)..(635): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgctcccaggtgcagctaggtacagtcggggctgagatgaagtagccgtaggggcctcgagtgatcgacgtttccgngccgacgcactcgtaggactaccgtaaccttccgaacctaccttacccgttaacgtactaacggttaggggttaccgtaaccggtaccggcccccgttagggtaccggtaggggtccttagggtaaggttagggtacgttcggggtaaccttaacgtacccgtaaaccccggttaggttacggtacggtacttacttaaaccgtaacgttacgtacaacgtaacggtaaggtaacgtcgacgtacgggtacccgttaagtaccagtacgaccgtagacacgtaccgtaccagtaacgtacacgtactacgagtaggtaccggtgtaacgctacgcgtagcgtaacgtcggtagacgacggtacgtacgtacgtggtaaccttagccgttgtaaccgtntcggtaggtctaacgttacacttactagttattacgtcgtacgtacg

SEQ ID NO: 9897 - DNA, 758 bp, Homo sapiens
  misc_feature: GYAE6OF01E3TKG.53.73.G07.1.454.CMB.1.raw
  modified_base (172)..(172): a, c, t, g, unknown or other
  misc_feature (172)..(172): n is a, c, g, or t
  modified_base (197)..(197): a, c, t, g, unknown or other
  misc_feature (197)..(197): n is a, c, g, or t
  modified_base (231)..(231): a, c, t, g, unknown or other
  misc_feature (231)..(231): n is a, c, g, or t
  modified_base (237)..(237): a, c, t, g, unknown or other
  misc_feature (237)..(237): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtncagctggtacaagtcggggctgagntagaagacgcgtgggcctcagtgatgtactttcngcacgnagtcgtagactacgaccttcaccgtctccctatacgtagttcggaccacgaccggtccccgtaggaccgtacggggtccttagggacggttaggtacgttacggggttaacctaaccgttaccccgtaaaccccggtttggtcgggtaacggtacttaccgtaaacgttaaccggttacgtaccgtaacgaagggtacggtaacgttcggggaaccgtaccgggggtaacccttaaacgttaacccgtaagtaccgaaaccgacgtaacggacccgtaccggtaccctacggtaaacggttaaccgtacggttacccgtaacggtacggtaggggtaccggtagaccggtacgtacggtaccgtaggtaacgtaaccggtccgaagggtaaccgacccggtacgtaccgttaagtcgttaacgtcggtacgttaccgacgttacgttacggttacggtaacgttacgtaaaccgttaacttaacgttaatttacccgtttcgtaccgaccggttaaccggg

SEQ ID NO: 9898 - DNA, 674 bp, Homo sapiens
  misc_feature: GYAE6OF01E3GNH.53.73.G07.1.454.CMB.1.raw
  modified_base (515)..(515): a, c, t, g, unknown or other
  misc_feature (515)..(515): n is a, c, g, or t
  modified_base (593)..(593): a, c, t, g, unknown or other
  misc_feature (593)..(593): n is a, c, g, or t
  modified_base (615)..(615): a, c, t, g, unknown or other
  misc_feature (615)..(615): n is a, c, g, or t
tcagcgcgtatacacacgaccggtgctcgatttagctctacgctcaggggatcatccgaacaaccacatcccttctctacagaagcctctgagaggaagttcttcaccatggactggacctggagggtcttctgcttgctgtcagtacgctccgaggtgctcgctccaggtgcagctggtacaggtcgggggctggagataggaacgaacgtccggtcggggcctacgaggtgacgttacgtacttttccgacgacgaaccgacattcgtaggactaccgtacctccgaccgtaccttaccttaatactaggttacggacacgaccggtacccgtagggtaccgtaggggtcttaggacggtaggtacggttacggtactaacgtaccgtaaccgtggtaggtacgtactactacgtaacgtctacgagtagaacgtatacggacgtacggtaaccgtattaccagtacgacgtacgaacacgtaccgtacgacgtacgtacgtacgtaccgtanaggtaggagtacgacgtcaacgtcgaagtcgtatccggtagaaccggtaccggactcgtattgttactacgttacggngtaacgttctttaggttaacgngttaaccgtaacgttaccgttaatacgtttttaaagtccgaaccggtaacgttaccggg

SEQ ID NO: 9899 - DNA, 662 bp, Homo sapiens
  misc_feature: GYAE6OF01CNXGJ.53.73.G07.1.454.CMB.1.raw
  modified_base (353)..(353): a, c, t, g, unknown or other
  misc_feature (353)..(353): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctaggatacaccttcaccgtacttcccttaatacagttgggtacgacgacggcccctggacagggcttgagtggatggtactaactcaacctgtggtgactctaacagttacncacagacgaagtcgacgacgggtacctaacgttaccagtcgaaccaaggtacgaaccgtaccggttaccgaacgtaagttaacgtaacgttaccgttaacgaaggttacgggaaggttacggaacggtacgacggtacccgtaggtaacgtacggtacgttaggaacgggtaccgtaaccgggtaccctagttaacggttacgtttaacgttggtacggtacgtaacgttacgtttaacgggttcggttaacgtttaacgtaaaccgttaacttaaacgtttagtttttacgacgtacggtaaccccgg

SEQ ID NO: 9900 - DNA, 821 bp, Homo sapiens
  misc_feature: GYAE6OF01B3COU.53.73.G07.1.454.CMB.1.raw
tcagcgcgtatacacacgaccggtgctcgatttagctctacgctcgaggggatcatccaacaaccacatcccttctctacagaagcctctgagaggaagttcttcaccatggactggacctgggagggtcttctgcttgctgtcagtcgctccgaggtcgctcggcctccgaggtgcgagcgtcggtacaaggtcggggctaggagagtagagacgccgtcggggccttaggagtcgaagttgtacttttccgagaccgacggtacgtacgttccggtaggttaacctacccgttacccttaccgaaccggttaccctttaacccgttaactaaccggttaaggtttcccggggaaaactaccggtacccgggtaccccccgtaggggaaccggtacggggtcttacggtagggttcggaacgggttcgtaaccgttaacgtaccggtaccggtaggtacggggtctaacgtaacgtacttaacggttcgaaccaacgtaaggtaacgtaaacgtcggggaccgacgggtaacctaaacggttccaacgggtacccgtaacgaggtaaccgaccgtaacgtacccaacgtaacggtacacgttacgtacgtacgtacgggtagtacgacggacgacggtaccgtagtaagtaccgtacggtaacgggttacgaacgggtaaccgtacccggtaatcccgggtttaagtacccggttaggtaccggtaacggttcggtttaaccggtaagggttccgttaccggttaactaaacccgggtttattaacggttttaccgtaacgtccggtaccgtaaccgggg

SEQ ID NO: 9901 - DNA, 746 bp, Homo sapiens
  misc_feature: GYAE6OF01AYHWW.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctaggtacaaggtcgggggctggagagtaggaagaacgccgtcggggtcctcgaggtgatgtactttcctagaccacgacacttcgaggtactaccacccttccgacccgtaccttacctttaataccgtaggtttacgggaaccgaccgaccgggccccgtagggaccgtaggggtctttagggacgggttagggtacgttacggggttaacctaacgttaacccgtaaaccccggttagggttagggtacggtacgttaccgttaaacgtaacgtttaccgtacgaacgaagaacggaacgtcgggacggacgggtaacccgtaaactttaccgaagtacgaaccgagaacgaccgtaccgtaccgaacgtaagtacacgttaccgaagtggtaagggacggtacggagaccgtacgccgttaggaacgtagtaccggtaggaacgggtacgaccggtacttagttacggttagttacgtggtacggtacgttcggttagttacggtaggttaactaacccgtaactttaacttaacgttttagttaaccgtccgtaacggtaaccggg

SEQ ID NO: 9902 - DNA, 665 bp, Homo sapiens
  misc_feature: GYAE6OF01AVCKP.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgtactttcctgcacgacatcgtaggactacctaccttaccacccgtaccttaccccttaatactagttggggtaccgaacaccgggccccgtgggacgaggggtcttggagtgggtagtcgggtactaacgtaccgtaaccgttggtacggtaggtacttacgtaacgtaaacgtttaccacaacgaggtaagaagtcggacgacgggacccgtaaacttaccgaagtacgaaccacggaacgaccgtaccgtaccgacggtaacgtacgtacgtactacgaggttagggaggtacgacgacgagccgtaggaactagtcgtaggacggtaaccacggtactagttcgtattccgtggtcgcgttacggttaccttaggtacgggttaacttaaccggtaacttaacgttaagtttagttttacgaccgtacgtaacccggg

SEQ ID NO: 9903 - DNA, 614 bp, Homo sapiens
  misc_feature: GYAE6OF01BIIGY.53.73.G07.1.454.CMB.1.raw
  modified_base (193)..(193): a, c, t, g, unknown or other
  misc_feature (193)..(193): n is a, c, g, or t
  modified_base (421)..(421): a, c, t, g, unknown or other
  misc_feature (421)..(421): n is a, c, g, or t
  modified_base (477)..(477): a, c, t, g, unknown or other
  misc_feature (477)..(477): n is a, c, g, or t
tcagcgcgtatacacacgaccggtgctcgatttagctctacgctcaggggatcatccaaacaaccacatcccttctctacagaagcctctgagaggaaagttcttcaccatggactggacctggaggtcttctgcttgctgtcagtagctccaggtgctcgctccaggtgcagcgtggtaacgaagtcggggntgagatagaagagccgtgggcctcgagtgtatgtactttccgtagcaacggactagttcgtaggaacttacctacctttaccgaaccgtaccttacccttaatacgtaggttacggaaccgaccgtaccggtccccgtagggacggtggggtcttaggaggtcggtagttcggtacttaacgactaaccgttaggtggtacgtactacgtaatacgtacacgagaganagtcgacgacggactatacgagtacgacgagtacgaccgtacgacaagacgtaacngtacgtacgaggtaggacgtgacgcagtcgtagagtacgtacgacggacggacgtaccgtacttagtcgttaagtcgtgtaccgtgtagttcgttagacgtactacgtacttaacttagtttatcgtagccgtacgg

SEQ ID NO: 9904 - DNA, 859 bp, Homo sapiens
  misc_feature: GYAE6OF01EM6PG.53.73.G07.1.454.CMB.1.raw
tcagcgcgtatacacacgaccggtgctcgatttagctctacgctcgagggggagtcagacccagtcaggacacagcagtggacatggacgggtccccgctcacgctccgtggggctcctgctgctcgtcggcctcccgaggtcgaccaagttgtgacataccagacttaccgaccctacgttcccttccccgtttacccctacccgttcggtcctcgtacctacgttccgttaggtaccgggaacgacggtacggtaacgtccgtaacccgtaccgttaccggttccgggaccccggtaaccgtaaccggtaaaccgtaaaaggtttaaccggttaaccggttaccgggtttacggggtttacggtaccggtttacggtacgtaacgaacggtaaccggaaaaccggtaaaacccgggaaacgggtaaacccgtacccgtaaccgttaccgtacggtacggttaactaaccgtttaaaggtaaccggtaccgtttacttaaccggttacggaacggttcggggttaccggtacctaacgtaccggtacggttacgacggtcgtacgtaggtacgtacggtacgtaggaacgtagacttaccgacttacgtacgtaacgtacgtaccggtcgacgtccgtacgtcggtaactcggtactagttacgttacttacgtaaccttatttacgtacgactaacgtaacgttagtaacttacgttcggttacgacggtaaccgtaccgggaaacggtacggtaacaaggtaacgtaacgtaaacgtacgtacgacgtaccggtataaccgtacgtcttaccgttcgttaccttacgttaccgtaacccttcccgtactcgttacg

SEQ ID NO: 9905 - DNA, 698 bp, Homo sapiens
  misc_feature: GYAE6OF01EE9PH.53.73.G07.1.454.CMB.1.raw
  modified_base (154)..(154): a, c, t, g, unknown or other
  misc_feature (154)..(154): n is a, c, g, or t
  modified_base (234)..(234): a, c, t, g, unknown or other
  misc_feature (234)..(234): n is a, c, g, or t
  modified_base (273)..(273): a, c, t, g, unknown or other
  misc_feature (273)..(273): n is a, c, g, or t
  modified_base (296)..(296): a, c, t, g, unknown or other
  misc_feature (296)..(296): n is a, c, g, or t
  modified_base (510)..(510): a, c, t, g, unknown or other
  misc_feature (510)..(510): n is a, c, g, or t
tcagcgcgtatacacacgaccggtgctcgatttagctctacgctcaggggatcatccaacaaccacattcccttctctacagaagcctctgagaggtaaagttcttcaccatggactggaccgtggacgggttctttcgtgtcgttcgcgttcnggttccagttacgcgttcccagggttcgccttccgcgttcccgaggttgcctaggcctagggttaccggaattcgggggnttaggaagacgtaggaacgtagggccctggggaccttancctagtggtacttgagtttaccngctacgacgtatcctacggctaccgaccttcctaaccgtacttccttaggtacactcggtacccgtacgtaacgggccccgtacggtacgaggggtaccttaggtacggtaggtaaccgtacggtacgtaacgtacgtaccgtacgtacggtacgtacgtacgtacgtaacgtacgtacgacgtaggacgtaacgtacgacgtacggacgtaangtacgtacgtacgtacgacgacgacgtacgtacgacgagtacgtacgtacgtacgtacgtacggtacggtacggtacgacgacgtacgtacgtacgtacgtacgtacgtacgtacgcgtacgtacgtacgtacgtacgtacggtcgtacgtacgtacgttacgtacgttaagttacgtacgtagtacg

SEQ ID NO: 9906 - DNA, 605 bp, Homo sapiens
  misc_feature: GYAE6OF01B7D43.53.73.G07.1.454.CMB.1.raw
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (395)..(395): a, c, t, g, unknown or other
  misc_feature (395)..(395): n is a, c, g, or t
  modified_base (425)..(425): a, c, t, g, unknown or other
  misc_feature (425)..(425): n is a, c, g, or t
  modified_base (429)..(429): a, c, t, g, unknown or other
  misc_feature (429)..(429): n is a, c, g, or t
  modified_base (578)..(578): a, c, t, g, unknown or other
  misc_feature (578)..(578): n is a, c, g, or t
  modified_base (601)..(601): a, c, t, g, unknown or other
  misc_feature (601)..(601): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaatgtgacatccagatcgaccctagtcctccttccacccttgtctgcactctggtcggagaccagacgtcaccgtcacgtcggccggcacgtaccgaaagttacgtaagaccgtggtcggtccgtaggtatcgagacgtaacgaaaccgacgggaaacctcccgtaagacctccgtagcttacgtaagtaacgtacttacttacgttagacgtacgggtcggtaccagtacgtaggtnacgcggngagtgatcgaggacngtacgtcatcctacactagtacgcactcgntacncgtacttgacttgtacgtttcaccgtaacttgtaccacgtacaagtactaagtaacttggtttcgacggttacggtaccgaccggtaaggactaagggtaagaactacggaaacgtcgtaggtcgacgtacacgttacgagttccgttntacctacctaattccgacccgtntacg

SEQ ID NO: 9907 - DNA, 739 bp, Homo sapiens
  misc_feature: GYAE6OF01EY6JC.53.73.G07.1.454.CMB.1.raw
  modified_base (196)..(196): a, c, t, g, unknown or other
  misc_feature (196)..(196): n is a, c, g, or t
tcagcgcgtatacacacgaccggtgctcgatttagctctacgctcagggggagtcagacccagtcaggacacagcagtggacatggagggtccccgctcagctcctggggctcctgctgctctggctcccaggtgccaaatgtgacatccagatcgacccagtcctcccttccaccctgtctgcatctggtcgganacagacgtcgaccgtctacgtcggcccggaccagtacctaaagtagtaacgtaccgttgggttcggtccgtggtactaccgaacggaccgaaaccggaaaacccggaacggggaaaccgacccccgtaagtaccctaccgttagtactactaagtaacgtacgttccttaactttagaccgtagggtcgggtacccagtacgaaggttcaggcgcgaggtgtagtcgacggactagtacgtcactcctacgtaactagtacgacgtaccgtcctagacccgtacgtaccgttagttacgttagtttaccgtttacgaaacctttaacctttaacgttacctaaccggtaacctaacgtaacgtttaacttaacgtttaacggttcggttaacgggtaccgtaccgggtaaccggtaacgggtaaccgtaagggtaacgtaaaacgtaccgtaaaacggtacggttacgggtacgtaccgaacctacgtacccgtagttacttcgttaaccttccggaccctttaccgtccccgtaagttaccg

SEQ ID NO: 9908 - DNA, 687 bp, Homo sapiens
  misc_feature: GYAE6OF01DWGJB.53.73.G07.1.454.CMB.1.raw
  modified_base (239)..(239): a, c, t, g, unknown or other
  misc_feature (239)..(239): n is a, c, g, or t
tcagcgcgtatacacacgaccggtgctcgatttagctctacgctcaggggatcatccaacaaccacatcccttctctacagaagcctctgagagaaagttctcacatgactggacctggaggtcttctgcttgctgtcagtagctccaggtcgctcgctcccgaggtgcagtcgtaggtacgaggtcggggctagagagtagaaggacgtcgtggggtctcgtagtgatgtactttccngaccacgacagtacgtagtaactacctaccctaccgtacccgtaccttcctaactacgtacggttaggtaaccgaccgtaccggtcccgtacggacggacggggttcgtacggagggtaggtacggttacgggtaacccttaacgtacccgtaaccggttaggttcgggtacgtaacttacgttaactaacggtttacacgtagacggtaaagtagtcgggaccgtaacggtaccgttaactaaccggacgtacggaagaacgacggaacctccgaaacccgtagtaacgtacgttactacgtacggtaaggtcgggtagtacgcgtacgcgtcctagacacgtaggactacgggtacaccgtatgttacgtagtcgtgtacgtagttaccgttaggtacgttagtacgtactaacttaacgttatttcgttaacgccgacgtaacgg

SEQ ID NO: 9909 - DNA, 723 bp, Homo sapiens
  misc_feature: GYAE6OF01A216M.53.73.G07.1.454.CMB.1.raw
  modified_base (213)..(213): a, c, t, g, unknown or other
  misc_feature (213)..(213): n is a, c, g, or t
tcagcgcgtatacacacgaccggtgctcgatttagctctacgctcaggggatcatccaacaaccacatcccttctcgtacagaagcctctgagaggaaagttcttcaccatggactggacctggagggtcttctgcttgctgtcagtagctccaggtgctcgctcccaggtgcagtcgtgtaccaagtcgggggctgagagtgaagaagccgnggggcctagacgtgatgtacttcctgacacgacatcgtggactaccaccgttcaccgactacccttataccagttcggtaccgacgaccggccccgtggacgtaggggtcttggaggtcggataggggtactaactaccgaaccgttaggtcggtaggtacttaccgtaactaacggttactacgaacgagtacgaagtcggacgacgggtacccaaagttccgagtacgaccgaagacgacacggtaccaacgtacgaacgtgtacctaacgtggtacggaggtacggacgaccgtacggtcccgtaggtaaccgtaggtacggtaacgggtacgggtaacccggtacccgggtaccgttagttaccggtttaacgttacgtttacgggtaccggtacggtttacggttaacggtttaacgggtacgggtttaaacgttaaacccgttaaaccgtttaaaccgttaattttaaccggtttaccggttaaccgtacgggttaaacccggg

SEQ ID NO: 9910 - DNA, 1186 bp, Homo sapiens
  misc_feature: GYAE6OF01BUMGK.53.73.G07.1.454.CMB.1.raw
tcagcgcgtatacacacgaccggtgctcgatttagctctacgctcagggggggagtcagacccagtcaggacacagcatggacatggaggggtccccgctcagctccgtggggctcctgctgctctcggcctcccgaggtcgacctaaatggtacgacactccaaggactaccggacccctacgttcccttccccttacccctaccccgtttacggttccgttacggacctacgtttccggttacggggttaccggggaaacggtaaccggaacggtacggttaccccggtaaccccggtttacccgttaccggtttccggggacccccgggggacccaaacgggtaaaccccgttaaaaacgggttttaaacgtttaaaaccgggtacccggggttttcggggggtttccgggtaccccgtttacgggggttaaaccttaccgaacggggaaacccgtaaaaccgggaaaaacccggggaaaacggggggtaaaaccccgtacccccgtaaacggttaccccgttaccggttaaccggtaacgtttaaccggttaaaagtttaaaacccggggttaacccggttttaaacccgttttaaacccgggtttttaaacgggtaacccgggttaacgggggttttacccggggggttaaccccttaaacggtttaacccggggttaaacgggttaccggaacggggtacccgggtacgggtaacggggtttacggggtaacggttaccgggggtaccgggtaaacggtacggtttaacccgtttaacctaacccgtttccccgtaaccgtaaaacccgttaggttaacccggaaccgtacccgggtcccgttacggacccggttacggtacccggttaaggttacttaacggggttttaactttaacccggtaaactttaaccttttaaccggttaaccacccggtaacctaacgttaacctaaccgtttaacgtttacgggttttaccggggttaccgggttaacccggggttaaccggggaaccggggttaaaccggggtaaaccgggttaaggtaaaccgggtaaaactaacccggttaaacgggtaccggtagggttaaccggtcgttaccggtaacccgtcctaagtttccccgttacgtttacccgttacccgttaccgtttacccgtcccgttccgttaacg

SEQ ID NO: 9911 - DNA, 787 bp, Homo sapiens
  misc_feature: GYAE6OF01DDH2W.53.73.G07.1.454.CMB.1.raw
  modified_base (269)..(269): a, c, t, g, unknown or other
  misc_feature (269)..(269): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttggctgtcagtacgcctccgaggtgcctcgcctcccgaggtgcgagcgtaggtacgaaggtccggggggtctggagtagtaggaaacgtaacgccggtcgggggcctacgtaggtgtagttcgtacttttccngaccgaacgactatacgtacggtactaaccctcccgttacgaacccgtacccttcccttaactacgtacggttacgggaccgaccgaccgggtccccgtgggaacgggtcggggtcgttagggacggttaggtacgttcgggtaacttaaaccgtaccgtaacccggttagggtcggtggtaaccttacgttaaaccgttaacgggttacctacaacggtaaggaacgtagtaccgggaccgtaacggggaaccttaacgtacctaagtccgtaacgacggacgaccgtacgaaccgacggtacacgtacgtcgtacgaggtagggacgtggaccgacgtacgccgtagtacgtacgtacgtcggaacggtaccgtaccggtacgttagttacgttacggttcgtaggttaacggtcgtaaccggttaggtttaacgggcgtttaaacggttaacccggttaaactttaaccgttaaggtttacttttaccgggaaccggtaacccgggttaaccggg

SEQ ID NO: 9912 - DNA, 784 bp, Homo sapiens
  misc_feature: GYAE6OF01BUOEH.53.73.G07.1.454.CMB.1.raw
  modified_base (672)..(672): a, c, t, g, unknown or other
  misc_feature (672)..(672): n is a, c, g, or t
  modified_base (758)..(758): a, c, t, g, unknown or other
  misc_feature (758)..(758): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccgaggtcgcctccgccgtcccgaggtcgcgagtcgtaggtacgtaacgggtcgggggtctaggacgtagtaggaaacgacggtccggtcggggaccttagaggtgtaacgttcgtacgtttccgacgaccgaacgtactacgtcgtaacggtacctaacccttacccgttcccgtaaccccgttaccctttacccgtttaaagtccggttaacgggtttaccggggaaccgaacccggtaacccggggtcccccggttaaggggaccggttacgggggttccgttaggggaacgggttagggtacggttacgggttaaccttaaccgtaccgttaaaccggttagggtggtacggtacttacgttaaacgtacgttacacgaagtacggaagtagccggtacgacggtacctaacgtaccgagtaaccgaagaccgacgtaaccgtaccgtaaccgaacgtaaccgttacgtacgtaacgtaacgagggtacgggtagtacgacgtgactccgaggtacngtccggagaccgtacgcgtactatcgttacgtacgtgtacgtgtttacgtagttacggtagttaaccttcggtaactttaacgttnttaaccggttcaaacgtcggtaacgg

SEQ ID NO: 9913 - DNA, 821 bp, Homo sapiens
  misc_feature: GYAE6OF01AS91F.53.73.G07.1.454.CMB.1.raw
  modified_base (229)..(229): a, c, t, g, unknown or other
  misc_feature (229)..(229): n is a, c, g, or t
  modified_base (237)..(237): a, c, t, g, unknown or other
  misc_feature (237)..(237): n is a, c, g, or t
tcagcgcgtatacacacgaccggtgctcgatttagctctacgctcaggggatcatccaacaaccacatcccttctctacagaagcctctgagaggaaagttcttcaccatggactggacctggaggtcttctgcttgctgtcagtagctccaggtgctcgctcccaggtgcagctggtacagtcggggctgagatagaagagccgtgggcctgagtgatgtactttccngcacgacngtcgtggactacctacctccaccgtaccttaccttatactaggttacggtacgaccgaccggtccccgtagggaccggtacggggtcttagggaggttgggtacggttcgggttaccttaacgttacccgtaacccggttagggttacgggtacgtacgttaccgttaaacgtaaacgtttaacctaccaacggtaacggtaacgtaacgtcgggaaccggtaacccggggtaaccgttaaacgttaaccgaacgttaccggaaccgtaacgtaaccggaaccgtaacccggtaaccgtaaaccggtaaccggttaacgtaacggttaccgtaacggtaacgggttaaggggtacgttaggaccggtaccgtaacgggtacccgttaaggtaccggtaagttaccgggtaagggtaaccggaacccggtaaccggtaccggttaagtttaccggttaaacgtttccggttacggttaccggtaacgtttacgtttaaggttaacggttacggttaaacgtttaacccgtaactttaaacgtttaacggttttagtttaccggtaccgtacccgggttaaacggg

SEQ ID NO: 9914 - DNA, 879 bp, Homo sapiens
  misc_feature: GYAE6OF01BIE1M.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcggggctgagatgaagagccgtggggcctcagtgattgtactttcctgccacgactattcgtaggtaactaaccctaccctttccgaacccgtacctttacccctttaatacgtagtttcggggtaaccgaccgaccgggtccccctagggacggtacgggggtcttgggacgttgggaggttcgggtacttaacgtaccctaaacccgttagggttgggtacggtacttacctaacgttaacgttaccacgtaaccgaaggtaacggtaagtcggaccgaacggggtaacccgtaaactttaacccggaaggttaccggaaaccgaacgggtaaaccgtaaccccgtaacccggtttaaccccgaaaccggttaaacggtaaccgttaaccgggtttacccttaaaccgggtacgggtttacgggggaaacgggtttacgggaacggtacccggtaacgggtaaccccgggttaagggtaaaccgttaaccgtttaccgggttaacgggggaacccggggttaacccggaacccgggttaccctagtttaacggttttaacgttaccgtttacgggtaccggtaccgtttacggtttacggtttaacggggttaggttaaaccgtttaaaccgtaaaccgtttaaacgttaacgtttttaagttttaccggccggttaaaccggtaacccgggg

SEQ ID NO: 9915 - DNA, 827 bp, Homo sapiens
  misc_feature: GYAE6OF01BFBB5.53.73.G07.1.454.CMB.1.raw
  modified_base (148)..(148): a, c, t, g, unknown or other
  misc_feature (148)..(148): n is a, c, g, or t
  modified_base (196)..(196): a, c, t, g, unknown or other
  misc_feature (196)..(196): n is a, c, g, or t
  modified_base (328)..(328): a, c, t, g, unknown or other
  misc_feature (328)..(328): n is a, c, g, or t
tcagcgcgtatacacacgaccggtgctcgatttagctctacgctcaggggatcatccaacaaccacatcccttctctacagaagcctctgagaggaagttcttcaccatggactggacctgggagggtcttctgcttgctgtcagtanctccgaggtgctcgcctccgaggtgacagctaggtacgaggtcggggntagagtagagaagacgtccggtcggggacctgtagtagacgttgttactttccagaccgtacgacttacgtcggttacgtaaccttaccccttaccccgttcccgaaccccgttacccttacccgttttaanaacggtttaccgggttacggtaacccgaccggcccgggtaccccgtaggggacggtaggggtccttaggggtaggttagggacggttcggttaactaaccctaccgtaaccggttagggtcggttacgtacttaaccggtacctaacgtttcccaagtacgagtaacgtaggtacggacccgtaaagggttacccgtaaactttaaccgaacgtaccggtaaccgaaacggttaaccgaaccgttacccggtaaacccggtaacgtaccgtaaggtaccgttacggtacgtagggtacgggtaggtagaccgacgtaccgcgtacggaacgtccggtaagtaggggtaacccgaccggtaccgttacgtagttaacgtttcgttccgtacggttaacggtacgttttacggtttaccttaaggggttacccgttagttaaacccgttaaagtttactttaaagtttttacggttacgtacccgggtaccgtaaccgggg

SEQ ID NO: 9916 - DNA, 704 bp, Homo sapiens
  misc_feature: GYAE6OF01B3M5A.53.73.G07.1.454.CMB.1.raw
  modified_base (359)..(359): a, c, t, g, unknown or other
  misc_feature (359)..(359): n is a, c, g, or t
  modified_base (507)..(507): a, c, t, g, unknown or other
  misc_feature (507)..(507): n is a, c, g, or t
  modified_base (516)..(516): a, c, t, g, unknown or other
  misc_feature (516)..(516): n is a, c, g, or t
  modified_base (666)..(666): a, c, t, g, unknown or other
  misc_feature (666)..(666): n is a, c, g, or t
  modified_base (694)..(694): a, c, t, g, unknown or other
  misc_feature (694)..(694): n is a, c, g, or t
tcagcgcgtatacacacgaccggtgctcgatttagctctacgctcagggggagtcagacccagtcaggacacagcatggacatgagggtccccgctcagctccgtggggcctcctgctgctctggcctccgaggtcgaccaatgtgactatccagatcgaccctagttccttcccttccctacccgttggtctgccacgttcgtagtcggaacgaacgtaggtacgtcctaaccgttcctacggttccggcccgggaccaacggtaacccgtaaaaggttaacgtaacggtaccggttgggttccggtccgttaggtaactcgaacgtaaccgaaacgtaaaacccggagggtaacccnccctaagtccgtcgtaactatacgtaaagtaccgtacgttacgttaacgttacggagtcgggtaccggtaccaagttacgtaggtccgtaggcgtacgagtaggacgttggcggaataagttcgtctacgtcctaacaccgtagtacncgtcgacgngacctggtactagtcttagttcttacgtacttattacgtcactaactaagtctaacttgttacgtgggtaccgtacggtccgtaaacggacgggtaccgagtaagaaccacggtaacgtagtcgtaggtacctggaaccctgttacccgngtttaaccgctttaccgaccgtttcccnctacggttac

SEQ ID NO: 9917 - DNA, 594 bp, Homo sapiens
  misc_feature: GYAE6OF01DV3JG.53.73.G07.1.454.CMB.1.raw
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (356)..(356): a, c, t, g, unknown or other
  misc_feature (356)..(356): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgatttcctgcacgacntctggatacnccttcaccgactcccttaatacagttggaacacacggcccctaggacgaggggcttggagtggatgggtactaatccaacctaggtggtggatctacaagttactnacaagagaatgcgagggctaataccatcgaacagtacgacacgtaccgaagtacgtaacagtacctaacgtagtagggacggtagacgcgaagcccgttaggaagtacgttaccgtagggaacggaacgaccggacctagttagtaactttagtcgtaggtaccgtaacgtttcttaggttaggtaaacgttacgtaaaccttaagtaaactttattttacggactaccgtaacccgg

SEQ ID NO: 9918 - DNA, 623 bp, Homo sapiens
  misc_feature: GYAE6OF01AG9UI.53.73.G07.1.454.CMB.1.raw
  modified_base (281)..(281): a, c, t, g, unknown or other
  misc_feature (281)..(281): n is a, c, g, or t
  modified_base (357)..(357): a, c, t, g, unknown or other
  misc_feature (357)..(357): n is a, c, g, or t
  modified_base (376)..(376): a, c, t, g, unknown or other
  misc_feature (376)..(376): n is a, c, g, or t
  modified_base (439)..(439): a, c, t, g, unknown or other
  misc_feature (439)..(439): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagacagacgtccaccgtcacgttgccgggccagaccaaagtattaagaccgttgggttcggccttggtatcgagcaagaaaccgagggaacncccctagacctcctagactactaataacgtactcttacttagactaggtcgggtccagtacgtagttcgacgcggngaggtgatcgaggacagtntcactcacactatacgcagcctgacacgtctagtatcgttatttcgacttaacttacgttacncgtaacctaacgtataactaacgtttcggtttaggtacggtaccggttaccgggaccgtaacgggtaccgtaagggttacgaaacgttaccgaaacgttacgtaggtaccgggcttaccggacctaccgttacgttccgtttcgttaccctttctaaccttttccccgtaccccgtcgttaccg

SEQ ID NO: 9919 - DNA, 756 bp, Homo sapiens
  misc_feature: GYAE6OF01BH3QH.53.73.G07.1.454.CMB.1.raw
  modified_base (241)..(241): a, c, t, g, unknown or other
  misc_feature (241)..(241): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgcctcgcctcccgaggtgcagcgtggtacaggtcgggggctgagataggaaagagccgtggggcctgagtgagtgtactttccgngaccacgacatcgtaggactacctaccttaccacccgtaccttacccttatacgtagttcggggaaccgtacgaccggtccccgtagggaaccgtggggtcttaggacggttggaagttcgggtacttaacgtaccgtaaccggttaggttcgggtagtacttaccgtaaacgtaacgtttaccctacaacgaaggaaacgtaacgttcggaaccggtaacggggaaccctttaaacgttaaccacggttacgaacccgaaggtaaccgaaccgtaccggacccgacgtaaacgtcctaacgttacaacggtaggtacgggagtacgagaccgtggacctaggactacggttacgacgggtacggaccgtacgaccgttagtttggttaacgttcgtacggtacgtacggttaagtttaccgggtttaacgggaacgtttaaccgtttaaccgtaacgtttaaacgtttacgtttttaaccggtttcgtaaacgggtacccggtaaaccccgggg

SEQ ID NO: 9920 - DNA, 698 bp, Homo sapiens
  misc_feature: GYAE6OF01BMZDQ.53.73.G07.1.454.CMB.1.raw
  modified_base (237)..(237): a, c, t, g, unknown or other
  misc_feature (237)..(237): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgctcccaggtgcagctggtacaagtcggggctgagataggaagaacgccgtggggcctgagtgatgtactttccgngacacgacatcgtaggactacctaccttccacccgtaccttcccttaatacgtagttacgggtaaccgaccgaccgggtccccgtagggaccgtagggggtcctttagggacggttaggacggttacggggttaccttaaacgtaccccgtaaacccgttagggttcggtaggtaaccttaccttaacgtaaacgtttacctacaacgtaaggtaagaagtcgggacgaaggggtaccctaaaagtttacccgaagtaccgaaccgaaggacgaaccgaccgttaccgaacgaacgtaacgagtacctacgtagtgggaggtagaggacgacggtacgtggaagtacgtcgtagggaacggaccgacggtacctagttagtacgtttacgtggtacgtacgtattgttacggtagtacttaacgtaacttaacttaatttagtttacgcgtacgtacccgg

SEQ ID NO: 9921 - DNA, 634 bp, Homo sapiens
  misc_feature: GYAE6OF01EI8YD.53.73.G07.1.454.CMB.1.raw
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgctttgctgtcagtagctccaggtgctcgctcccaggtgcagctggtacaagtcggggctgagatagaagagccgtgggcctcgagtgatgtactttccngcacgacatcgtaggactaccaccttccaccgtaccttacccttatactagttacgggtaccgacgaccggtccccgtgggacgaggggtcttggaggtggagtcgggtacttaacgtacccgtaaaccgttaggtggtacggtaacttaccgttaaccgtaagtttacctacgaacgtaaggaagtaacgtcggaccgaacggggtacctaaacttacagtacgaccgagaacgaccgaccgtacgaacgtagtactagttaccacgtaggtaggtaggtgacgcgacgtccgtagagtacgtcgagggacgaccgcgtacagttagtagttacgtgtcgtcgtagttagttaggacgttacgtacaacgttacttatttagtttcgccgtacggtacccg

SEQ ID NO: 9922 - DNA, 846 bp, Homo sapiens
  misc_feature: GYAE6OF01DJ6QG.53.73.G07.1.454.CMB.1.raw
  modified_base (320)..(320): a, c, t, g, unknown or other
  misc_feature (320)..(320): n is a, c, g, or t
tcagcgcgtatacacacgaccggtgctcgatttagctctacgctcgagggggagtcagacccagtcaggacacagcatggacatgacgggtcccgctcagctccgtggggctcctgctgctctggcctccgaggtcgactaagtgtgacactaccgagtacgtcgacctacgttccttcccttccctaccgttgtcctgcgtacttcgtacggtacggacgacgtacgacgttaccgtaccgttcgtaccggttccggaccggaccgtaacgtaaccgtaaagttacgttaacggtcggttcggtcggtaccgttggtanaccacggaacctaaacgggaaccgaaccggtaaaccgtcccttagtcctaacttacgtaacttcgtaaagtacgttaacgttacgtttaacgtaggacgggttccgggtacctacaacggttacgtacgtacggcgacgtaggagtcgtacggtacggacggaacttcgtactccttacctaacgacttcggtaacgtacggacctacggtcacgttaccggtacgtgttaaacggttactttaacgtttaccgtaacttaaaccgtttaacgtttacccaacggttaccgtaaacgtaaccgttaacgtttaacggtttacggttaacgggtttacgggtacccggtaacccggtacgggtaaaacggacgggttaaacggtaagaaacgtaaacccgggtaaacgtaacggtttcggaaaccggtccgtaaccggtttacttaaccggttccttaccggttttacgaccccccttttaacggttacccgttaaccccgtttccctaaaccgttcgggttaaacc

SEQ ID NO: 9923 - DNA, 758 bp, Homo sapiens
  misc_feature: GYAE6OF01EY9FK.53.73.G07.1.454.CMB.1.raw
  modified_base (718)..(718): a, c, t, g, unknown or other
  misc_feature (718)..(718): n is a, c, g, or t
tcagcgcgtatacacacgaccggtgctcgatttagctctacgctcagggggagtcagacccagtcaggacacagcatgggacatgacgggtccccgctcagctccgtggggcctcctgctgctctcggctcccaggtgaccaatggtcgacacttccagactcgaaccctagttcctcccttccacctggtctgccattccgtggtaccggacgtacgaacggacttccaccggttccacggttcggaccccgggacaacgtaaccgtaaatactaacggtccgtttacggggttacggtccgtaggtactacgagtaaccggtaacgtaaaccggaacggggtaaacctcccccgttaaagtacccgtaccgtagttactaccgtaaggtaacgtacgtttacgttaacgtttaacgaccggtacgggtaccgggtacctacggtacggtaacggttcgacgtcggaccgttaggcgtacgtacggtacaacgtaggtaacgtctacgttacctacgaactcgggttaaccacgtaccgctacgtcacgtcgtagttatacgttaacttagtaaaccgttaacttacgtaacgtacgaaccttaagaccgttaactaaccggtttatacgggtacgtaccggtaccgggtacgaaacgggtactaacggtaagtaaccgagtaacgaacgtggtacgtacgactaccggacccttanacggtttctacgttacgaccttcccgttcgaacggttacg

SEQ ID NO: 9924 - DNA, 787 bp, Homo sapiens
  misc_feature: GYAE6OF01E3S9Y.53.73.G07.1.454.CMB.1.raw
  modified_base (171)..(171): a, c, t, g, unknown or other
  misc_feature (171)..(171): n is a, c, g, or t
  modified_base (190)..(190): a, c, t, g, unknown or other
  misc_feature (190)..(190): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (606)..(606): a, c, t, g, unknown or other
  misc_feature (606)..(606): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtcgctcgctcccggtncagctggtacagtcggggntgagatagaagacgccgtgggcctgagtgatgtactttccngcacgacntcgtgactacctaccttccaccgaccttccctatactagttcgggtacgacgacggccccgtgggaccggagggtccttaggaggttggagttcgggttactaactacctaacccgttaggtcgggtagtaactaccgttaacgtaaccgtttacacgaacgaagaacgaacgtcggacggtaaaccgggaacccttaaacgttacccgtaagtaccggaacccgtaacggaaccggaacccgtaacccggtacccgtaaaccggtaacggttaaaccgtacgttaacccgttaaccggaagggttcggggtaacgggttaggaacgtaccggtaccgtaccgttagggaacgttacgttaaccggngggtaaacccgggtaaccggaacccggttgttaaccgttagtttaaccgtttacggtggtttaaccggacgttaacggtttaccggtttaagggttaacgttaaccggtttaaaccgttaccttaaaacgtttaacttttaggttttaccgaaccggtaacccggtacccggttaaagggg

SEQ ID NO: 9925 - DNA, 182 bp, Homo sapiens
  misc_feature: GYAE6OF01B0M56.53.73.G07.1.454.CMB.1.raw
  modified_base (174)..(182): a, c, t, g, unknown or other
  misc_feature (174)..(182): n is a, c, g, or t
tcagcgcgtatacacacgaccggtgctcgatttagctctacgctcagggcacgaccggtgctcgatttagctctacgctcagggcacgaccggtgctcgatttagctctacgctcagggcacgaccggtgctcgatttagcagacgtctgtcgcgggctggcaaggcgcatagnnnnnnnnn

SEQ ID NO: 9926 - DNA, 761 bp, Homo sapiens
  misc_feature: GYAE6OF01B590Q.53.73.G07.1.454.CMB.1.raw
  modified_base (486)..(486): a, c, t, g, unknown or other
  misc_feature (486)..(486): n is a, c, g, or t
  modified_base (513)..(513): a, c, t, g, unknown or other
  misc_feature (513)..(513): n is a, c, g, or t
tcagcgcgtatacacacgaccggtgctcgatttagctctacgctcagggggatcatccaacaaccacatcccttctctacagaagcctctgagaggaaagttcttcaccatggactggacctgggagggtcttctgcttggctgtcagtacgctccaggtcgctcgcctcccgaggtgcagcgtaggtacaaggtcgggggctggagagtaggaaagacggccggtcggggcctacgaggtgtagttggtactttccgtcggaccacggtacacttcgtaagaaccttaccctaaccttacccacccgttaaccttaccccttaagtaccgtaggttccggggtaacccaccggcggtcccccggtagggacggtacggggtcttaggcgggttaggagtacgggttaacctaaccgtaccgtaaccggtggtaggtacgtaaccttacgtaaacgtaacgtttacacgaacgtaagaacgtaacncgggtaacgacggtaacctacgtaacngtacgacacgacgtacgaccgtaccaaggactacgtacgtacgtacgaggtaggacggtggacgtacgtacgccgagtagtacgtacgggagtaaccgggaccgaacggtacccgtaagttacggttaacgttacggtacgtacggtacgttacggttaaggttacggttacgggtaaaccgtttaacgttaaaccttttaaagtttaacggttttactttacggaaccgtccgggttaaacccgggg

SEQ ID NO: 9927 - DNA, 811 bp, Homo sapiens
  misc_feature: GYAE6OF01B4ZLA.53.73.G07.1.454.CMB.1.raw
  modified_base (259)..(259): a, c, t, g, unknown or other
  misc_feature (259)..(259): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagcctccgaggtgcctcgcctcccgaggtcgcacgctaggtaacaggtcgggggctgagtataggaaagacgtccggtggggtcctacgtaggtgtattggtaacctttccgngtaccgaacgatacgtcgtaggtaaccttacccgtacctttacccgaacccgttaacccttcccgtttaataaccgttagggtttaccggggtaaccgaccgtaccgggtcccccgtagggaaccgggtcgggggttacgtttaggagggttagggttacgtacgggttaacccttaagttaaccccgttaaacccggtgggttagggttaacggtaccttaaccggttaaacctaacggttttacccgtacgaacgtaaacgtagtaacgtcggtaccggtaaacgggtaccgtaaactttaaccaccggtacgaaccggaagtaccgtaaccgaaccgtaccgaacgagttaacgacgttacaacggtgtacgggtagtcgacgcgacgtacctggaacgtacgtccggacgggtacgacccggacgtacgtacgttagttacttaacggtcgtagttaccgtagtttaccggtaaggtttggtaaaccgtttacccttaacgttaacttttaagtttaccggtttacgttacccgacgggtaaaccggg

SEQ ID NO: 9928 - DNA, 911 bp, Homo sapiens
  misc_feature: GYAE6OF01B1ASZ.53.73.G07.1.454.CMB.1.raw
  modified_base (239)..(239): a, c, t, g, unknown or other
  misc_feature (239)..(239): n is a, c, g, or t
tcagcgcgtatacacacgaccggtgctcgatttagctctacgctcaggggatcatccaacaaccacatccctttctctacagaagcctctgaggaggaagttcttcaccatggactggacctggagggggtcttctgcttgtctgtctagtagtccgtccgagggtcgtccgttccggccttccccgagggttcgacgacgtcggttacggttaaccgtaaacggggtcccggggggtntggtaaggagtaacggaaggtaaccggtccgggtcgggggtccctacgtaaggtggtacttcggttaaccttttccgtcgaccgtaccgacgtacgttcgtaggtaacttacccgtacccttacccgtaacccgtaccctttacccgttaattaccgttacggtttacggggtaccggtaaccggtacccgggtaccccggtacgggaaccgggtaggggttccgttagggtagggttacggtaggttacggtaacttacgtacccgtacggtaggttggtacgtacgttaactaacgtaacttactacgacgtaacggaatacggacgaccggtaacggaaccttaacgtacctagtaccgtaacaacggaaccgtaaccggtacccgtaaactaacgggttaactaaccggtaacgttaccgttaacgggtaacgggttacggggtaacggggttacaaccgggtaccggttaacggtacccgtaagggtccgttaacggtacggtaagggaacccgggtaaccggacccggttacttacgggtttaactttaccgggttacggtttaccggcgttaaccggttaggttttaacccggttaggttaaaccgtaacgttaaccttacggtaactttttagttaacgtttcccgaacggtccgggtaaccgg

SEQ ID NO: 9929 - DNA, 809 bp, Homo sapiens
  misc_feature: GYAE6OF01BW87F.53.73.G07.1.454.CMB.1.raw
tcagcgcgtatacacacgaccggtgctcgatttagctctacgctcaggggatcatccaacaaccacatcccttctctacagaagcctctgagaggtaaagttcttcaccatggactggacctggaggtcttctgtcttgctgtcagtagcctcgtaggtcgctcgtcctcccgaggtcgctacggtcgttaggtacgtacggtccggggtactaggagtagtaaggaaacggacggtccggtcgggtaccctagtaggtgtagttacgttaccgttttccaggtaccgaccgtaactcgtacgtacgtaacctacccgttaccgtacccgtacccgttaccttaccgttaagtacgttacggttaccggaacccgtaccggtacccggtacccggtacggtaccggtacggggttacgttagggtacggttaggtacggttaacggttaccgtaaccgtacccggttaacggttagggtacggttacgtaacgttaaccgtaaacgttaacgttaccgtaacgtaagaacggtaacgtagtaccgggtaccgtaaccggttaccttaaacgtacgacgtaccgaccgtacgaaccgtaaccgtaaccgtaacgtaacgtacgtaacgtacgtaccggtaagtacggtaggacgtacgacgtacgtacgacggtagtacgtacgtacggaacggtaccgtaccgtacgtacgtttacgttagtaccgttcggtacgtacgttacgttagtttacggttaacgtcttaacgtaccttaattacgttactttacggtcgccggtaacgtacg

SEQ ID NO: 9930 - DNA, 811 bp, Homo sapiens
  misc_feature: GYAE6OF01AVQ6U.53.73.G07.1.454.CMB.1.raw
  modified_base (268)..(268): a, c, t, g, unknown or other
  misc_feature (268)..(268): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccgaggtcgctcgcctcccgaggtgccagctggtaacgaggtcgggggctaggagtagtaggaaaggacgcccggtcggggtcctacgtaggttggtaagttcgttacgttttccgngaccgtaaccgactacttcggtaaggtaactacccctaaccttacccgaacccgttacctttaccctttaaagtaccggttaggttcggggtaaccgaaccggaccggggtcccccggtaaggggtaccgggtaacgggggttcttagggacgggttggtacggtttacgggtaactaaacgtacccgtaaacccgttagggtagggtaacgtctaactaactaaacgtacctacgaagtaacggaagtaacgtcgaccggtaacgggtacctaaattaccgaagtaccgaactaacggaacgaccgtaacggtaccgtacgtaacggtaacgtaccgtacgtaacgtagggtacgggacggtagaacgtccgacgtaccggtagtacggtaacgttcggtaacgggtacggaccgtaaccgtacgttaggtaacgttacgttagtcggtacgtaggtttaaccttaggtaacgggttacgttaacgtacgttaaacctttaacgttaattttaccggttaactcccggaaccgggttaccgg

SEQ ID NO: 9931 - DNA, 776 bp, Homo sapiens
  misc_feature: GYAE6OF01DXKOR.53.73.G07.1.454.CMB.1.raw
  modified_base (116)..(116): a, c, t, g, unknown or other
  misc_feature (116)..(116): n is a, c, g, or t
  modified_base (398)..(398): a, c, t, g, unknown or other
  misc_feature (398)..(398): n is a, c, g, or t
  modified_base (726)..(726): a, c, t, g, unknown or other
  misc_feature (726)..(726): n is a, c, g, or t
tcagcgcgtatacacacgaccggtgctcgatttagctctacgctcgagggggagtcagacccagtcaggacacagcatggacatgacggtccccgctcacgctcctggggctcctnctgctctggctccgaggtgccaatgtgacatccgaagcgtacgacccgtacgtccttcccttacccacccgttcgtctggtacctacgtcgtacggtaccggacggacgaggttaccgtaccgtacccggttcctaaccggtttaccgggccccgggaccgtaaaccggtaccgtaaaacgttaacggtttaaccggtaccgttcggggttacgtacgttcgggtaaatccggacgaaccgaacggtaaaacgaccggtaacgtcccgaacgtacctcgtanaacgttactaacgtaacgtcgttaaccttagtaacgacggtacgggttaccggtacctagtacgttacggacgtacggacggtagtcggtagtacgtcggttaagggactaacgtacgttaccacgttaccacggtaacctgtaaccgcgacgttccggagcctacgtacgttatacgttaggttacttacggttactaaccttacgtaacctaccgtacgtaaccgtaactttaccggtagttacgttcggtaccggttaccggtacgtaaccggtacggtaacgtaacgggtaagaccgtaacgacgtaccgtggtagtccgtaanccctcggtactacgttcttaacggctttaccctacccgtcgtagtacccg

SEQ ID NO: 9932 - DNA, 831 bp, Homo sapiens
  misc_feature: GYAE6OF01C9VJP.53.73.G07.1.454.CMB.1.raw
  modified_base (320)..(320): a, c, t, g, unknown or other
  misc_feature (320)..(320): n is a, c, g, or t
tcagcgcgtatacacacgaccggtgctcgatttagctctacgctcagggggagtcagacccagtcaggacacagcatggacatgagggtccccgctcagctcctggggctcctgctgctctggcctccgaggtcgaccaaatgtgacatccagactacgacccagtcctcccttcccaccctgtctagcagtctggtcggagacagacgtccgaccgtctacgttcggaccggccaacgaccgtaaagtagttaacgtaccgtggttcgcgttggtataccagccgaaagaaaccgagggaacctcccgtagtacctcgngtattactaagtacgtaccgttattacgttaacgacggttacggtaccgggtacctagttacgaacggttaccgagggccggtacgtaggtacgtagtccggtaggacctaggttacctccgtaaccgtcttaaccaaccgttattaacgccgtaacgtccgtaggtaccgtaccgttaccgtaaggtttaactttcgggttttaaacgttttacccgaaccgtttaaacccgttttacgtaaccccggtttacaacccgttaaaccgggtactttaaacgttaccgttttaaccggtttcgggttaaacggttacccccggggtttaaccggaaaccccgggtaaacgggggaaacccggtttaagggaacccggttaaaaccttaaccggtaaacccggtaacggttcggccggtaaccggtacgttaaccctaacgtttacccgggtttacctttacgggttacccccttaacttacccttccccccgttacccgtacttaacccggg

SEQ ID NO: 9933 - DNA, 803 bp, Homo sapiens
  misc_feature: GYAE6OF01BHWKY.53.73.G07.1.454.CMB.1.raw
tcagcgcgtatacacacgaccggtgctcgatttagctctacgctcaggggatcatccaacaaccacatcccttctctacagaagcctctgagaggtaaagttcttcaccatggactggacctggagggtcttctgtcttgctgtcagtacgctccaggtgctcgctcccgaggtgccagcgtggtacgaacggtcggggctagagatagaaagacgccgtcgggcctcagtgagtcgtattcgacgacacgactagtcgtagtactacctacctttaccaccgtacctttacccttataactggttacggtaaccgtaccgtacccgggccccgtagggtaccggtaggggtccttacgggtacggtaggtacggttcggttaccttaaactaaccgttaacccgtagggtagggtacggtacttaccgttaaacgtaacgtttacccgactaacgtaagtaacggagtacggacgggaacgggtaaaccgtacttaaacccgtagtaaccggtaacccgaaggtaccgtaacccgtaacccgtaacccgaaacggtaaaccgttaccggtaaccgttaacctaacgtaacggttacggggtaacgtacggaaccgtaacgtacccggtacgtacggtaaggttagttaccggaacgggttaaggaacccgggttaacccgcttaacggttacgttaacgtttacgggttccgtaggtacccgttaggtttaccgttaagggtacgtttaacgttaaccgtaaacttttacgttaaactttgtttacgtgtacccgtaacggg

SEQ ID NO: 9934 - DNA, 674 bp, Homo sapiens
  misc_feature: GYAE6OF01D4YB0.53.73.G07.1.454.CMB.1.raw
  modified_base (192)..(192): a, c, t, g, unknown or other
  misc_feature (192)..(192): n is a, c, g, or t
  modified_base (542)..(542): a, c, t, g, unknown or other
  misc_feature (542)..(542): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggntgagatagaaggaagccgtggggcctcgagtgatgactttcctgacacgactatctggaactacctaccttccaaccgtaccttcccgttaataccgtagttcggggtaaccacgtacccgggtaccccgtagggaaccggtacgggggtcgtttgggacggttgggtaacggttacggggttactaaacgtacctaacccgttagggtcggttaggacgtactaaacgtaagtttacctacgaacgaagtaagaacgtgacggaacgggtaccgaaattaccaagtacgaaccgaagaacgaaccgacgtaccgtaacgacgtaacagtccgtaacgtagtaggaggtnaacgtcacgtcgagacgagtacgagtacggacgacgacgattacgtagttacgtagtccgagttacgttacgttagtacggtaatttaccgaaagttaccttaaatttgttttccgtaagtcggtaacccgg

SEQ ID NO: 9935 - DNA, 842 bp, Homo sapiens
  misc_feature: GYAE6OF01BJW17.53.73.G07.1.454.CMB.1.raw
  modified_base (312)..(312): a, c, t, g, unknown or other
  misc_feature (312)..(312): n is a, c, g, or t
  modified_base (766)..(766): a, c, t, g, unknown or other
  misc_feature (766)..(766): n is a, c, g, or t
tcagcgcgtatacacacgaccggtgctcgattttagctctacgctcagggggagtcagacccagtcaggacacagcatggacatgagggtccccgctcagctcctggggctcctgctgctctggcctcccaggtgccaaatgtgacatcctagatcgacccagtcctccttaccaccctgtctgctactcgtagtcggagacagacgtccaccgtcgaccgttcggcccgggaccacgacccgtaaaggtacttaacgtaccgttcggttcggccttggtactcgacgccaacgaaaccgaacgggaaaccncccgtaagtacctccgtagtaacttacgtaacgttaacggtaccgtttacttaacgtttacggacgtacgggttaccggggtacccctagttaccggtaaacggttcgaacgggccggtacgtaaggtcggtacgttacggtacggggaactaacggtaccgtttaccgtaccgttacccgtacgtaacccgtagttaccggacgtaccgggtacctcggaccctacggtaccgttaggtactttacgggtttaaccttttcggaaacccttaaagttttaccgttaaccgtacccggtaacccctaagttaaccgtttaacgttaaccgttttacgggttttggggtaaccgggttaacccgggtccgggtaacccgggtaaagggtaacccggtaaggtaaacggtaaacgtaacccgtaaaccgggtgtaccgggttaggaccgttaaccncccggttaaaccttacggtttcccttacgtttaccttacccggtaacctttcccccgttacccgtagttaaccggg

SEQ ID NO: 9936 - DNA, 744 bp, Homo sapiens
  misc_feature: GYAE6OF01CGQ7P.53.73.G07.1.454.CMB.1.raw
  modified_base (217)..(217): a, c, t, g, unknown or other
  misc_feature (217)..(217): n is a, c, g, or t
tcagcgcgtatacacacgaccggtgctcgatttagctctacgctcaggggatcatccaacaaccacatcccttctctacagaagcctctgagaggaaagttcttcaccatgactggacctggagggtcttctgcttgctgtcagtagctccaggtgctcgctccaggtgcagctggtacaagtcgggggctgagatagaagacgccgtggggccctnagtgatcgtatttcctgccacgactacgttcgtaggtaactacctaccctttccgaacccgtaccttaccctttaataccgtaagtttcggggtaaccgaaccgacgggtcccccgtagggacggtacgggggctttaggacggttgggtagtcgggttacctaaacgtaccgaaacccggttaggtcgggttagtacttaccgttaaactaacgtttacctacgaacgaagtaacgaagttacggaccggaaaccgggtaaccgtaactttaaccgaagttacggaacccgtaaggaccgtaacccgtacccgttaacccgaacggtaacgttaaccgtaacgttaccgtaacgtaggttaggggaggttaggacgtacgaacgtcgtacggtaacgtacgtcgtagggaacggtaaccgaccggtacttagttacgttacttacgtggtacggtcgttacttaggttacggttacgtacgttaagttaccttaataagttttactttcgtacgtccggtaaccgg

SEQ ID NO: 9937 - DNA, 856 bp, Homo sapiens
  misc_feature: GYAE6OF01DKUFN.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccagatcgacccagtcctccttccacctgtctgctatctgtcggagacagtcgtccaccgtctacgttcggcccgggtaccaacgaccgtaaaagttacttaacggaccgttgggttccggccgttagggttatacgacggaccgaaacggtaaaaacccggaaggggaaaccgtaccccccgtaaggtacccttaccccgttaggtaaccttaccgttaaacgtaaaccgggtaaccggtttaccgtttaaaccggttttaacggaaccggttacggggtttaccgggggttaccccctaaagttacccggtaaacgggtttaccgacgggcggtacgtagggttacgggtaacgtcggtacggggaactaaggttaccggttacctaccgttaccgttacccaaaccgtttacgtttaacggcctaaccggtcccgttacggccgtaacgtaccgtagttacgtttagttaacgttttcgaacctttaacttagttacccgtaaccgaaccctaacgtaacttaacgttaattacggtttacgtaacgggttacccggtttaccgggaaccgttaaacggggaaccgttaacgggtaacggtaaaactaaccggtaaaacggtaccggttaggaacggtctacggaccctaccgtacggttccttacggttccttaacgtcctttacccccggtcgttcccgttacg

SEQ ID NO: 9938 - DNA, 813 bp, Homo sapiens
  misc_feature: GYAE6OF01BA6GT.53.73.G07.1.454.CMB.1.raw
tcagcgcgtatacacacgaccggtgctcgatttagctctacgctcgagggggagtcagacccagtcaggacacagcatggacagtggacgggtccccgctcagcctccgtggggcctcctgctgctctggcctccgaggtcgaccaatggtacacactaccagataccgacccgtagttcccttacccttccctacccgttgtcctcgacctagttcggtacggtacggacacgacgtacgtccctaccgtacgtaccggtccgggacccggtacaaccgtaaccgttaaagtacggttaaccgtaccggttggtcggtccgttaggactcggaacgtaccgaaacggaaacggaccggacctacccgtagtaccctagtagtactacgtaagtaccggttcttacgttacgttaacgcggtacggtccgtacctagtacggtaggtcgaggtcaggtacgtgtacgagggtacggtactcggtaccttccaacttacgtacttaaacccggtgtcccgtaccgaccgtccgtacgtaccggtaccgttacgttaggtaacttacggtttaacttaaccggttaacctttaactttaccgtaaccgtaacccgtaacgtaacgttaaccgttaacgtttccggtttaacgttaccggtaacccggggttaacggtaccgggtaaccggtaaaacgggttaccggaaacggttaacgtaaaccgtaacgtaaccggttacggtaccggttacgtacgtactacccgtgtaacctcgtttactaccgttacctaccgtccccttaccgcgttacg

SEQ ID NO: 9939 - DNA, 829 bp, Homo sapiens
  misc_feature: GYAE6OF01DBCE7.53.73.G07.1.454.CMB.1.raw
tcagcgcgtatacacacgaccggtgctcgatttagctctacgctcagggggagtcagacccagtcaggacacagcatggacatgagggtcccccgctcagctcctggggctcctgctgctctggctcccaggtgaccaaatgtgacatccagatgacccagtcctccttccaccctgtctgcatctgtcggagacagtagcaccgtcacgttggacccgggcctaagaccctaaaaagttaagttaacggacccgttggggttcggacctagggtaatacgaacgaccaaacggaaaaccgaacgggaaaacgtcccccctaaagtaccgtaccgtaggtaacttaaccgtaaacgtaaacgtaaccgttaccttaaacgttttaacggaaccggtacggttaccggggttacccctaacgtaccgtaaaggttaccgaggaccggtcgtaaggttacggaacgttaccgtaagggaacgtaacggtacgttaccgtaaccttacctaccgtaaacccgtaagtttaccggaaccgtacggtacccgtagtacccgtaacggttccgtaagtaacgttacgtttaacgttttaccgaaccttaaacttttaaccgttaaccgtacgtaaaccctaaacgtaaacgttaacttaaaccgtttaggtttaccgggttaacggtaacccggtttaacgggaaccgtaaacgggtaaccgaaagggttacgaaaacttaaccggaaaaccgtaagtacggtacgtacgttacacccgtaactacgttaccgttacgttacttacctaattcccccgtttaccgacgttaaccg

SEQ ID NO: 9940 - DNA, 257 bp, Homo sapiens
  misc_feature: GYAE6OF01EYF7S.53.73.G07.1.454.CMB.1.raw
  modified_base (166)..(166): a, c, t, g, unknown or other
  misc_feature (166)..(166): n is a, c, g, or t
  modified_base (221)..(222): a, c, t, g, unknown or other
  misc_feature (221)..(222): n is a, c, g, or t
  modified_base (224)..(257): a, c, t, g, unknown or other
  misc_feature (224)..(257): n is a, c, g, or t
tcagcgcgtatacacacgaccggtgctcgatttagctctacgctcagggcacgaccggtgctcgatttagctctacgctcagggcacgaccggtgctcgatttagctctacgctcgagggcacgaccggtgctcgatttagctctacgctcgagggcacgacggtnctgatttagagacactctcggctagttctcggagcgggctggcgaagcgtcatgnnannnnnnnnnnnnnnnnnnnnnnnnnnnnnnnnnn

SEQ ID NO: 9941 - DNA, 731 bp, Homo sapiens
  misc_feature: GYAE6OF01BZU5P.53.73.G07.1.454.CMB.1.raw
  modified_base (187)..(187): a, c, t, g, unknown or other
  misc_feature (187)..(187): n is a, c, g, or t
tcagcgcgtatacacacgaccggtgctcgatttagctctacgctcgagggggagtcagacccagtcaggacacagcatggacatggagggtccccgctcagctccgtggggcttcctggctgcttctggctcccgaggtcgaccaatgtgacatccgagatcgaccgatcctcccttccacccgttntcctagctcgttcgtgacggaaacgaggtcgtccacgtccgtacgttcggacccggtaccacgtaacctaaagttagttaacggccgttagggtcggtaccgtaggtactacgaggtaaccgtaaaggaaaccgaggggaaccctcccgtaagcccttactaggtactaatacggtaaagtccgtcgtttaaacgtagtaccggtagggtaccggtaccctatacggttagtacgacgggtcgactggtcgtacgtggacggtagtacgtacgtcgtaccctcgactaagtagtcgacgtacgtccggactcgtacgtcttaggtacttaggttacttacgtacttacgtttctaccgacgtaacccgtaggtacttaacttacgttacgtcgggttacggacccggtacggaccggtaacgtaaaccggtagttaacgaacgtaaacccgggttagtacccgggttaggtaccgtacgttacgacggttaccttcgtcgtacggtttaccaccgtttccttacccccgttagccgtttaacgg

SEQ ID NO: 9942 - DNA, 797 bp, Homo sapiens
  misc_feature: GYAE6OF01AHZPF.53.73.G07.1.454.CMB.1.raw
  modified_base (217)..(217): a, c, t, g, unknown or other
  misc_feature (217)..(217): n is a, c, g, or t
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctccaggtgctcgcctcccaggtgcagctggtacagtcgggggctgagatgaagagccgtggggcctnagtgatgtactttccgtgacctacgactattccgtaggaacttacctaccctttccgaacccggtaccttaccctttaatacgtacggtttcggggtaaccgtaccgaccgggtacccccgtaggggaccgtaacgggggtccttagggacgggttagggtacgttacggggttaccttaaagttacccgtaaccccggttaggttacggggtacggtacttaccgttaaacgtaaaccgttttaccacgtaacgaaggtagtaaacgtcgggaacgtaacccggggtaccgttaaacttaaccgtacggttaaccggaacgtaacggaacggtaacccgtaccggtacccgtaacgggtaacttaaccggtacggttacctacggtaggtacgggaaggttaggaccggtagaaccggtccgtaagcggttaacgtcggacgggtacgaaccgacggtaccctagttacgtttacttaacgtcggtacttacggtcgtttaacggttaggtaggtaaccgtttaaacggttactaaaccgtttagttaaccgttttacggtaccgtacggtaacccggg

SEQ ID NO: 9943 - DNA, 781 bp, Homo sapiens
  misc_feature: GYAE6OF01ED0MA.53.73.G07.1.454.CMB.1.raw
  modified_base (725)..(725): a, c, t, g, unknown or other
  misc_feature (725)..(725): n is a, c, g, or t
tcagcgcgtatacacacgaccggtgctcgatttagctctacgctcagggggagtcagacccagtcaggacacagcatggacatgacgggtcccccgctcagcctcccgtggggcctcctgctgctctggctcccgaggtgaccaaatgtgacactccagatcgacccagttcctcccttccacccttgtctgcatcgtcggtcggacgacagacgtccaccgtctacgttcggcccgggaccacgaacctaaaggttaacttaacggtacgttcgggttacgggccgttaggtaacgtcaaggaccgaaacgaaaaacccggtaaggggaaaccctccccgtaacgtacctccgtactacttaacgtaacgttaaagtccgtttaaccttaacgtttaacgacgtaccggggttacgggtaccccaagtttaccgggtaaagttaccgacggacggtacgtaaggtcggtaactccgggtaggaaccgtaaggttacttcctacgttacctaccgtaactacgtacacgaccggtccgtacgtacgtaccgtcgttaagtaacttgtttaaccgtttcgtaaccttaacgttttaccgttacctaaccgtaacctaacgttaacgttaaactttacgttacgtttcgggacggttacccggtacgggtaaccgtaaaccggtaacgaaacggtacggtaaacgtaaacgaacggttagtaccggngtccgtacgacctacttacgtcgttacctcttactacccgttcctccgcttaccgg

SEQ ID NO: 9944 - DNA, 675 bp, Homo sapiens
  misc_feature: GYAE6OF01EK0QZ.53.73.G07.1.454.CMB.1.raw
  modified_base (199)..(199): a, c, t, g, unknown or other
  misc_feature (199)..(199): n is a, c, g, or t
  modified_base (249)..(249): a, c, t, g, unknown or other
  misc_feature (249)..(249): n is a, c, g, or t
  modified_base (259)..(259): a, c, t, g, unknown or other
  misc_feature (259)..(259): n is a, c, g, or t
  modified_base (571)..(571): a, c, t, g, unknown or other
  misc_feature (571)..(571): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccgaggtgcgagcgttggtaacaaggtccggggntggaagagtagaaggacggccgtggggcctcgaggtgatcgtacttccgngacacgactntcgtaggtactacctccgttaccacccgtaccttaccttagtacgttagttacggacgaccgccggccccgtggacggtggggtcgtaggtaggtggtcgtaggtactaacgtaccgtaacgttggtcggtagtacttactaacgtaacgttacgtacaacgtaaggaagtaacgcggacggtaaccgggtaaccttaacgttaaccgagtaaccgacgtaacgggacgtaacccgaccgtaaccgaacggtaactacgtacgttaaccgtagtacggtagggtagtacgacggctaacggcgtagacggtntacgggtacgacgtacgacgtacgtatacgttagtagtcgtaggtcttacgttggttagtggtaccttagtaacttacgttatttaggtctacgccggtaacgg

SEQ ID NO: 9945 - DNA, 904 bp, Homo sapiens
  misc_feature: GYAE6OF01CIT3W.53.73.G07.1.454.CMB.1.raw
tcagcgcgtatacacacgaccggtgctcgatttagctctacgctcgagggggagtcagacccagtcaggacacagcagtggacagtgagggtccccgctcagctcctggggctcctgctgctctggcctccgaggtcgacctaaagtgtagactactaccaaggtactaccgtaacccgtacggttccttcccctttacccgtaaccccgttcgtccgttacgacctacgttccgtaggtacggaacgtaacgacggtaccgtaccgacccgttacctaaccggttccgggaccccggtaaccgtaaaccggtaaccgtaaaacggttaacgtttaaccggtaccggttacggggttcggacgttttacggtaacgacctaacgggaaccgtaaaccggaaaaccggtaaccggggaaacccttaaccccggtacgtaaccgttccgttaagttaacgttaaccgtaaaacggtaaacggttacccgtttaacggttttaacggttaaccgaaccggggttaggtttacccggggaacccttacgtaaacgggttaccggttagggaaccgcgggttaacgtacgggttaaggttagtaccggagggtaactacgtacgtccgtaactactaccgtactttaacgcggactaccgcgtaccgacggtacctacggtagttaacgttcgtttaacgtttacgtaaccgttaacttaccgtttaccgtaacgtaaccgtaacgttaaccgtaactttaacgttacggtttaagggtaccgttaccggtaccggtacggtaaacgggtaacggtaacgtacgtaaacgtaagttaaccggtacgtacggtcgtacgaccgtacgtacctacgtaccttcgtactacgtccctaccgtacttctacgg

SEQ ID NO: 9946 - DNA, 704 bp, Homo sapiens
  misc_feature: GYAE6OF01CMODO.53.73.G07.1.454.CMB.1.raw
  modified_base (164)..(164): a, c, t, g, unknown or other
  misc_feature (164)..(164): n is a, c, g, or t
  modified_base (676)..(676): a, c, t, g, unknown or other
  misc_feature (676)..(676): n is a, c, g, or t
tcagcgcgtatacacacgaccggtgctcgatttagctctacgctcaggggggagtcagacccagtcaggacacagcagtggacatgagggtccccgctcagctcctggggctcctgctgctctggcctcccgaggtcgaccaaatgtgacatccagatcgaccngtcctcctccacctgtctgcatcgtggtcggagtacgagtcgtccaccgtcacgttcggccgggtaccaagacctaaagttactacggtcgttaggtcggtcgtaggtactaccgagaaccgaaacgtaaaccggaagggaaacccgtcccgtagaccttacgtagtactaacgttaacgtaacggtcctaactttaacgtaggtaacggtagggtccggtactagttaccaagggttcgacggacggtcgaggtacggtatcggtaggaactggttacctaactcgtaaccctgtaacctaggttacgacctacgtccgacgtacgccgtcgaggttacttacggtttacttacgtacttaacgttactacgacgtaactactaacgttaactagttctttacgggtaccggttcgtaaccggggtacgtacgggaataacgggtacgtaaacgaccgtaaggtagtcgtaacgggtcctaagccttaacggttcgttcgccgttttaccncttaaccccgttcctaccgtacttacgg

SEQ ID NO: 9947 - DNA, 750 bp, Homo sapiens
  misc_feature: GYAE6OF01EM7J7.53.73.G07.1.454.CMB.1.raw
  modified_base (158)..(158): a, c, t, g, unknown or other
  misc_feature (158)..(158): n is a, c, g, or t
  modified_base (253)..(253): a, c, t, g, unknown or other
  misc_feature (253)..(253): n is a, c, g, or t
  modified_base (457)..(457): a, c, t, g, unknown or other
  misc_feature (457)..(457): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtnctcgctcccaggtgcagctaggtacaaggtcgggggctagagagtaggaaacgacggccggtacggggcctacgaggtgtaagtgtactttccgngacacgacatcgtaggactaaccaccttccaacccgtccttcccttaatacttaggttcgggtaaccgaaccgccgggtcccccgtgggaaccggtgggggtcttaggagggttaggaggttcgggttactaacctaccgtaaacccgttagggtgggtacggtacttaccgtaacgtaacggtttaccacgaacgtagggaanaaggttcggacggtaacggggtaaccctaaacgttaccaaggttaccgaaccgaaggtaccggtaacgtacccgtaccgaacgtacgtaacctaggttaccctaacgtggtagggtacgaggacgccgtacgcgttaggactacgtacgacgggacggaccgtacggtaccctagtttacgtacgtttaggttaccgtgttaccggtaacgtttgttaacgggttacgtaacgttaaccgaacgtttaactttaacgttttagttttaccggtccgtaacccggtaacccggg

SEQ ID NO: 9948 - DNA, 940 bp, Homo sapiens
  misc_feature: GYAE6OF01ETZDJ.53.73.G07.1.454.CMB.1.raw
  modified_base (265)..(265): a, c, t, g, unknown or other
  misc_feature (265)..(265): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgcctcccgaggtcgcagcgtggtacaaggtcgggggctggagagtaggaacggaacggccggtaggggtcctcgtaaggtgtacgttcggttaccttttaccgnggaccgtaacggtaaccgtacgttcggtaggtaaccttaacccgtacccgtttacccgaaccccgttaaccctttaccctttaacgttaaccgttaggttttaaccgggggaacccgtaaccccgggtacccggggtacccccggtacgggggaaccgggtacggggggttaccgtttaggggaacgggttacgggtacggtttagggggtttaacccttaaaccggttaaccccgtaaacccggtttaggggtttacggggttaacgggtaacctttaaccgttaaaccgtttaaacgggtttaaccctaccgtaaacgtaaacgggtaaagggtaaacgttccgggaaacggggtacggggtaaaccccgttaaacgttacccggtaagttaaccggtaaccgtaacgggtaaaccgtaaccggtaaccccgtaccggtaacggtaaccgtaacggtactaaccgtaacggtaggtacgggtaggtacgacggtaccgtacgtacggttaggtaacgtataccggaacgggtaacgggtacccgacggtaccttacgttaaggttacgtttaggtaccggtcggttacgttacgtttacggttaggttacgggtaacttaaccgtaacgtttaaacttacgtttaagtttaccggtactaaccgggtaaccgg

SEQ ID NO: 9949 - DNA, 734 bp, Homo sapiens
  misc_feature: GYAE6OF01E2T43.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggcctggagggtcttctgcttgctgtcagtagctcaggtgcgtcgcctccctaggtgcagcgtggtaacgaacggtcggggctgagagtagaagaagccgtggggcctcgaggtgagtgttactttcccgtgaccgaacgactacgttacgtaggaacttaacccgtacccttacccaacccgtacccttacccttaataaccgttagttacgggtaccaccggaccggtccccgttagggaccgtaggggtcttggagggtacggtagtcgggttactaaccgtacccgtaacccggttaggttggtacggtataccgtaaacgtacgttacgacgtaacgaaggtaacgtaagacggaacggtaccgggtaacgtaaccttaacgacgacggaaccaaggtacgaaccgtacccgtaacgaacgtaagtaacgttacgtacgtaagtaggaggtaggtacgacgcgtaacggtccaggtagtacggtacgacgggaaccggtaaccggtaccgaacggttagttacgtttacgtaccgttggtacccgaggttacgttaggttacggtacgttaaccgaacgtttactaagttatttagttcaacgtacgtacccgg

SEQ ID NO: 9950 - DNA, 704 bp, Homo sapiens
  misc_feature: GYAE6OF01AS7ST.53.73.G07.1.454.CMB.1.raw
  modified_base (583)..(583): a, c, t, g, unknown or other
  misc_feature (583)..(583): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgcgtcgcctcccgaggtgcgagtcgtggtacgacggtcggggctagagagtgaacgagtccgtcggggctgagtgatgtactttccgcgacgacgactattcgtacggtaactaccgtacccttccgaacccgtaccctttacccgtttaataccgtaaggtttacggggaccgtaaccgtaccgggtcccccgtaggggtaccggtagggggttccttagggagggttacgggtaggtttcgggtaaccttaacgtacccgtaaccggttagggttcgggtacggtacttacgtaactaacggtttaccacgaacgaggtagaacgttcgggacgaacgggttaccgaaacgttaccagtaccgaacgagtacgaccgtacgtaccgaacgacgtactacgtacgacgtggtacggtagcggacncgtacgcgtagtacgtacgtcgacggacggacgacggtactagttacgtatcggtagtgtacgttgttacgaggttacggtactaagtacttaacgttatttacgtcgaccgtcggtacgg

SEQ ID NO: 9951 - DNA, 687 bp, Homo sapiens
  misc_feature: GYAE6OF01EECYK.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcagggggatcatccaacaaccacatcccttctctacagaagccctctgagaggaaagttcttcaccatggactggacctggagggtcttctgcttgctgtcagtagctccaggtgctcgctcccaggtgcagctggtacaagtcgggggctgagatgaagaagcctggggcctcagtgatgactttccngcacgacatcgtggactaccaccttaccaccgtaccttacccttatactagttaggggtaccacgacggccccgtgggacgaggggtcttaggagtggagtgggtactaataccaaccgttggtggtaggactactaacgtaacgtttaccacgaacgaagaacgtaagtggaccgtacggggaccgtaaaactttaccgaactacggaacccgaaggtaccgaaccgaaccgtacccgaaacgtacgtaaccgtacgttaccgtaacgaggttagggaggtacgacggaccgtacgccgttaggaacgtagttacgtacgggaacggaccgaaccgccgtaagttagttacgtttacgtaggtcgacggtactttacggttaaggttacggtaacctttaaccggaactttaaccttaaagtttaccgttttaggcccgtacggtaacccggg

SEQ ID NO: 9952 - DNA, 805 bp, Homo sapiens
  misc_feature: GYAE6OF01A4MQ5.53.73.G07.1.454.CMB.1.raw
  modified_base (212)..(212): a, c, t, g, unknown or other
  misc_feature (212)..(212): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccagatacgaccctagtcctcccttccaccctgtctgcatcgtgtcggagacagagtccaccgtntacgttcggccgggaccacgacctaaagttattaaacgaccgttgggttcggcctaggttatcgaagacgaacggaaaccgtaaggggaaaccgtccccgtaaggacccttccgtagtaacttacgttaacgtaaacggtaccgtttaacttaaccgttttaacggacgttacgggttccggggtaccctagttacggtaacggttcgacgggtcggacgtaggtacggtacgttcggtacgggtaacgtaggtacgttacctaaccgttacctacccgtaaaccttaacggtttaccgaccgtaaccgtcccgtaacgcggaccgtaccgtaggttacgttacgtttacgtttcgtaacttaacgttttaacttaacgaccgtaacctaacgttaagtaaccttaacggtttcgtttagggtaccggtaccggttacgggtaaccggtaaacgggtaacggtaaggtaaccggtaaaataaccggtaaacgtcggttacgggtacgtacggtaaccgacctaacccgttagttacccgtttacggtttacccttacccgttaccctttccccgtacccgttacgttacccgg

SEQ ID NO: 9953 - DNA, 774 bp, Homo sapiens
  misc_feature: GYAE6OF01BV3S7.53.73.G07.1.454.CMB.1.raw
  modified_base (192)..(192): a, c, t, g, unknown or other
  misc_feature (192)..(192): n is a, c, g, or t
  modified_base (241)..(241): a, c, t, g, unknown or other
  misc_feature (241)..(241): n is a, c, g, or t
tcagcgcgtatacacacgaccggtgctcgatttagctctacgctcaggggatcatccaacaaccacatcccttctctacagaagcctctgagaggtaaagttcttcaccatggactggacctggagggtcttctgcttgctgtcagtagctccaggtgctcgctcccaggtgcagctggtacagtcgggggntgagatggaagaacgccgtggggcctacgagtgacgtgtacttttccgngacgacgactagtcgtaggactacctaccgttaccaccgtacccttacccttaatacgtacgttacgggtaaccgaccgaccgggtccccgtagggaccggtaggggtccttagggtacggtaggtacggttacggggtaccttaaacgtacccgtaaacccggtggttcgggttaggtacttacgttaaaccgtaaagtttacctaccgaacgtaggaaacgtaagtcggtaaccgaacggggtaacctaaaccgtttaccgaagttaacggaacccggaacgtaacccgaaccgtaacccgtacccggaaagtaaacgtacgtaaacgttaccgtaacgagggttagggaacgggtagtacgccgtaaggtaccgtaggaacgtacgtcggacggacgggacctacggactagttacgttaacgttacgtcggacggttacgtacgttacgttaagggtgttaaaccggttaaccgtaaacttaacgttttaacgttttaccgtttcgtaaaccggtcccggtaaaccggg

SEQ ID NO: 9954 - DNA, 703 bp, Homo sapiens
  misc_feature: GYAE6OF01BEJ5E.53.73.G07.1.454.CMB.1.raw
  modified_base (237)..(237): a, c, t, g, unknown or other
  misc_feature (237)..(237): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgcctcgcctcccaggtgcagcgtggtacaagtcggggctgagatgaagacgccgtcggggcctcagtgatgtacttttccgngcacgtacatcgtggactaccaccttcgacccgtacttacccttaatacgtgttcggtaccgacaccgggcccgtagggacgtaggggtcttggaggtggacgttgggtactaacgtccaacccgttggtggtacgtactctaacgtaacgttactacgacagagtaacgtgaccggacggtaaccgtaactaccgagtacgaaccgagaacgacccgtaaccggtacctaacgaacggtaccgtaagttaccgtaagtacggtaggggtaagtcgaacggacgtacgtccgttagacgttacggtcgaacggggtaccgaccgtaccggaccttaggttacgttacgtttacgtacggtaccgggtacgttccgtttaacggttcgggttaacggtaactttaacccggaacctttaaaggttaacttttacggttttaccgtaccgtaccgggttaaccccggg

SEQ ID NO: 9955 - DNA, 753 bp, Homo sapiens
  misc_feature: GYAE6OF01BBTYA.53.73.G07.1.454.CMB.1.raw
  modified_base (95)..(95): a, c, t, g, unknown or other
  misc_feature (95)..(95): n is a, c, g, or t
  modified_base (186)..(186): a, c, t, g, unknown or other
  misc_feature (186)..(186): n is a, c, g, or t
tcagcgcgtatacacacgaccggtgctcgatttagctctacgctcagggggagtcagacccagtcaggacacagcatggacatgacgggtccccnctcagctcctggggctcctgctgctctggcctcccgaggtgaccaaatgtagacatccaagatcgaccagtcctccttaccaccctgtctncatcgtggtacggagacagacgtccaccgtcaccgttggcccggcacgacctaaagtactaacgtcgttggtggccttaggactcaacgacaacgaaaccggaggaaacctcccgtagaccttcgtatacttacctaaagtacgtaccgtttacttaacgttggaacgtcggggttaccggtccctaagtaaccggtaacggttacgacgggtccgggtactaagggttccgaagttcccgggtaaggggaactacgggttaacctttaacgaccctttaccggacctaaacggttattaaccgggcctacggtccgtacgtacgtaccgtacgttagttagttagttaacgtttaccgtaacttacgtttaacgttacggtactaacccgtaaggttaaacttaacgttaaccgtttacggttacggttaaccggtaccggttaaccgggaaccgggtaaacggtaacgggtaacggaacgtaacgtaacgtaacggtaccgttagtacggtactacggactacgtactacgttcttccgttactacgttccctacgtacgttccg

SEQ ID NO: 9956 - DNA, 140 bp, Homo sapiens; identical to SEQ ID NO: 9533
  misc_feature: GYAE6OF02IWJ8G.53.73.G07.1.454.CMB.1.raw
  modified_base (140)..(140): a, c, t, g, unknown or other
  misc_feature (140)..(140): n is a, c, g, or t

SEQ ID NO: 9957 - DNA, 147 bp, Homo sapiens
  misc_feature: GYAE6OF02F9X1B.53.73.G07.1.454.CMB.1.raw
  modified_base (138)..(147): a, c, t, g, unknown or other
  misc_feature (138)..(147): n is a, c, g, or t
tcagcgcgtatacacacgaccggtgctcgatttagctctacgctcagggcacgaccggtgctcgatttagctctacgctcagggcacgaccggtgctcgatttagcagacgtctgagcgggctggcaaggcgcatagnnnnnnnnnn

SEQ ID NO: 9958 - DNA, 138 bp, Homo sapiens
  misc_feature: GYAE6OF02ITUDU.53.73.G07.1.454.CMB.1.raw
  modified_base (138)..(138): a, c, t, g, unknown or other
  misc_feature (138)..(138): n is a, c, g, or t
tcagcgcgtatacacacgaccggtgctcgatttagctctacgctcagggcacgaccggtgctcgatttagctctacgctcagggcacgaccggtgctcgatttagcagacgtctgagcgggctggcaaggcgcatagn

SEQ ID NO: 9959 - DNA, 176 bp, Homo sapiens
  misc_feature: GYAE6OF02HGF2Z.53.73.G07.1.454.CMB.1.raw
  modified_base (174)..(176): a, c, t, g, unknown or other
  misc_feature (174)..(176): n is a, c, g, or t
tcagcgcgtatacacacgaccggtgctcgatttagctctacgctcagggcacgaccggtgctcgatttagctctacgctcagggcacgaccggtgctcgatttagtagtgtagattcgcggggatggcctcctcgagtctacagtgctctgagcgggctggcaaggcgcatagnnn

SEQ ID NO: 9960 - DNA, 139 bp, Homo sapiens
  misc_feature: GYAE6OF02IZT1K.53.73.G07.1.454.CMB.1.raw
  modified_base (138)..(139): a, c, t, g, unknown or other
  misc_feature (138)..(139): n is a, c, g, or t
tcagcgcgtatacacacgaccggtgctcgatttagctctacgctcagggcacgaccggtgctcgatttagctctacgctcagggcacgaccggtgctcgatttagcagacgtctgagcgggctggcaaggcgcatagnn

SEQ ID NO: 9961 - DNA, 154 bp, Homo sapiens
  misc_feature: GYAE6OF02HF9ZA.53.73.G07.1.454.CMB.1.raw
  modified_base (141)..(154): a, c, t, g, unknown or other
  misc_feature (141)..(154): n is a, c, g, or t
tcagcgcgtatacacacgaccggtgctcgatttagctctacgctcagggcgacgaccggtgctcgatttagtagtgtagattcgcggggatggcctccctcgagtctacagtgctctgagcgggctggcaaggcgcatagnnnnnnnnnnnnnn

SEQ ID NO: 9962 - DNA, 128 bp, Homo sapiens; identical to SEQ ID NO: 9785
  misc_feature: GYAE6OF02I1A7R.53.73.G07.1.454.CMB.1.raw
  modified_base (128)..(128): a, c, t, g, unknown or other
  misc_feature (128)..(128): n is a, c, g, or t

SEQ ID NO: 9963 - DNA, 138 bp, Homo sapiens; identical to SEQ ID NO: 9958
  misc_feature: GYAE6OF02GHK1H.53.73.G07.1.454.CMB.1.raw
  modified_base (138)..(138): a, c, t, g, unknown or other
  misc_feature (138)..(138): n is a, c, g, or t

SEQ ID NO: 9964 - DNA, 131 bp, Homo sapiens
  misc_feature: GYAE6OF02IB05H.53.73.G07.1.454.CMB.1.raw
  modified_base (131)..(131): a, c, t, g, unknown or other
  misc_feature (131)..(131): n is a, c, g, or t
tcagcgcgtatacacacgaccggtgctcgatttagctctacgctcagggcacgctcgatttagctctacgctcagggcacgaccggtgctcgatttagcagacgtctgagcgggctggcaaggcgcatagn

SEQ ID NO: 9965 - DNA, 112 bp, Homo sapiens
  misc_feature: GYAE6OF02GXW0M.53.73.G07.1.454.CMB.1.raw
  modified_base (89)..(89): a, c, t, g, unknown or other
  misc_feature (89)..(89): n is a, c, g, or t
  modified_base (112)..(112): a, c, t, g, unknown or other
  misc_feature (112)..(112): n is a, c, g, or t
tcagcgcgtatacacacgaccggtgctcgatttagctctacgctcagggcacgaccggtgctcgatttagcactcgcacgttgggtttnagcgggctggcaaggcgcatagn

SEQ ID NO: 9966 - DNA, 110 bp, Homo sapiens
  misc_feature: GYAE6OF02HQCJC.53.73.G07.1.454.CMB.1.raw
tcagcgcgtatacacacgaccggtgctcgatttagctctacgctcagggcacgaccggtgctcgatttagtgacatctcgcagttctgagcgggctggcaaggcgcatag

SEQ ID NO: 9967 - DNA, 141 bp, Homo sapiens; identical to SEQ ID NO: 9544
  misc_feature: GYAE6OF02HLX9J.53.73.G07.1.454.CMB.1.raw
  modified_base (141)..(141): a, c, t, g, unknown or other
  misc_feature (141)..(141): n is a, c, g, or t

SEQ ID NO: 9968 - DNA, 505 bp, Homo sapiens
  misc_feature: GYAE6OF02JYWU6.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgactaacttattactgaccaacagtacaatactttgtaggtacgttcggacctaagggaccaaggtaggaaatacaaacgactgtaggctgacacatctgtcttcatcttccgctac

SEQ ID NO: 9969 - DNA, 141 bp, Homo sapiens; identical to SEQ ID NO: 9544
  misc_feature: GYAE6OF02GLE9O.53.73.G07.1.454.CMB.1.raw
  modified_base (141)..(141): a, c, t, g, unknown or other
  misc_feature (141)..(141): n is a, c, g, or t

SEQ ID NO: 9970 - DNA, 113 bp, Homo sapiens; identical to SEQ ID NO: 9537
  misc_feature: GYAE6OF02GT8EQ.53.73.G07.1.454.CMB.1.raw
  modified_base (113)..(113): a, c, t, g, unknown or other
  misc_feature (113)..(113): n is a, c, g, or t

SEQ ID NO: 9971 - DNA, 146 bp, Homo sapiens
  misc_feature: GYAE6OF02FV0NH.53.73.G07.1.454.CMB.1.raw
  modified_base (113)..(146): a, c, t, g, unknown or other
  misc_feature (113)..(146): n is a, c, g, or t
tcagcgcgtatacacacgaccggtgctcgatttagctctacgctcagggcgacgaccggtgctcgatttagtatctgatagttgggtctgagcgggctggcaaggcgcatagnnnnnnnnnnnnnnnnnnnnnnnnnnnnnnnnnn

SEQ ID NO: 9972 - DNA, 494 bp, Homo sapiens
  misc_feature: GYAE6OF02GCPCI.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtgatctgggacagagttcactctcaccattagcagcctgcagcctgatgatttgcaacttattactgccaacagtacaatactttgtggacgttcgaccaagggaccaaggtggaaatcaacgactgtggctgcaccatctgtcttcatcttccgctac

SEQ ID NO: 9973 - DNA, 157 bp, Homo sapiens
  misc_feature: GYAE6OF02GXE5E.53.73.G07.1.454.CMB.1.raw
  modified_base (155)..(157): a, c, t, g, unknown or other
  misc_feature (155)..(157): n is a, c, g, or t
tcagcgcgtatacacacgaccggtgctcgatttagctctacgctcagggcacgaccggtgctcgatttagctctacgctcagggcacgaccggtgctcgatttagtatctgatagttgggttcagcggcggtcgtcggacgaggccgatagtagnnn

SEQ ID NO: 9974 - DNA, 144 bp, Homo sapiens
  misc_feature: GYAE6OF02GHXC4.53.73.G07.1.454.CMB.1.raw
  modified_base (137)..(144): a, c, t, g, unknown or other
  misc_feature (137)..(144): n is a, c, g, or t
tcagcgcgtatacacacgaccggtgctcgatttagctctacgctcagggcgacgaccggtgctcgatttagtacacgtgattagggattgggtgatagggtacgcactcgtctgagcgggctggcaaggcgcatagnnnnnnnn

SEQ ID NO: 9975 - DNA, 502 bp, Homo sapiens
  misc_feature: GYAE6OF02G3BM8.53.73.G07.1.454.CMB.1.raw
  modified_base (484)..(484): a, c, t, g, unknown or other
  misc_feature (484)..(484): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaagcccctagactcctgatctataagacgtctactttagacagtggggtcccatcaaggttcagcggcagtggatctgggacagagttcactctcaccattagcagcctgcagcctgatgattttgctaacttattactgccaacagtacaatactttgtggtacgttcggaccgtaagggaccaaagggtgaaatcaaacgactgtggctgcaccatcngtcttcatcttccgctac

SEQ ID NO: 9976 - DNA, 497 bp, Homo sapiens
  misc_feature: GYAE6OF02H06DV.53.73.G07.1.454.CMB.1.raw
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgaatttgcaacttattactgtcaacnggttnattacttacctcggacttttggccaggggaccaagctggacgtcagcgaactgtggctgcacatctgtcttcatcttcccg

SEQ ID NO: 9977 - DNA, 504 bp, Homo sapiens
  misc_feature: GYAE6OF02H0NCL.53.73.G07.1.454.CMB.1.raw
  modified_base (337)..(337): a, c, t, g, unknown or other
  misc_feature (337)..(337): n is a, c, g, or t
  modified_base (464)..(464): a, c, t, g, unknown or other
  misc_feature (464)..(464): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtgatctanaagttactcacagagaatgcagggccaattaccatgaccagagacacgtccagagtacagtctacatggaggtgagcagcctgagatctgaggacacggccagtgtattactgtgcgaattcttagnggtaatttacgaacttacaattattttacgtcagtacccg

SEQ ID NO: 9978 - DNA, 505 bp, Homo sapiens
  misc_feature: GYAE6OF02JCZ5M.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatcgtgggacagagttcactctcaccattagcagcctgcagcctgatgatttgctaacttattactgaccaacagtacaattactttgtaggacgttcggaccaagggaccaaggtagaaatcgaaacgtactgtggctgcaccatctgtcttcatcttcccgctac

SEQ ID NO: 9979 - DNA, 176 bp, Homo sapiens; identical to SEQ ID NO: 9959
  misc_feature: GYAE6OF02H0ECC.53.73.G07.1.454.CMB.1.raw
  modified_base (174)..(176): a, c, t, g, unknown or other
  misc_feature (174)..(176): n is a, c, g, or t

SEQ ID NO: 9980 - DNA, 107 bp, Homo sapiens
  misc_feature: GYAE6OF02GNGJ4.53.73.G07.1.454.CMB.1.raw
  modified_base (87)..(87): a, c, t, g, unknown or other
  misc_feature (87)..(87): n is a, c, g, or t
tcagcgcgtatacacacgaccggtgctcgatttagctctacgctcagggcacgaccggtgctcgatttagtacacgtgattagggancgggctggcaaggcgcatag

SEQ ID NO: 9981 - DNA, 526 bp, Homo sapiens
  misc_feature: GYAE6OF02H388M.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaagcccctagactcctgatctataagacgtctactttagacagtggggtcccatcaaggttcagcggcagtggatctgggacagagttcactctcaccattagcagcctgcagcctgatgtatttgactaactttattacttgaccaacagtacaattactttgaggtacgttcggaccaagggtaccaaagggtaggaaataccgaaacgtactggtaggcttgacaccaatcgttagtcttcacttccttccccgctacg

SEQ ID NO: 9982 - DNA, 493 bp, Homo sapiens
  misc_feature: GYAE6OF02F5C14.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactccccttatacattgggtacgacaggcccctggacaggggcttgagtggatgggtctaatcaaccctagtgtggatctacaagttactcacagagaatgcagggccgaattaccatgaccagagacacgtcacgagtacagtctacatggagtgagcagcctgagatctgaggacacggccagtgtattactgtgcgatcttagtgtattacgactactaattatttgtcagtcc

SEQ ID NO: 9983 - DNA, 507 bp, Homo sapiens
  misc_feature: GYAE6OF02G2DH9.53.73.G07.1.454.CMB.1.raw
  modified_base (407)..(407): a, c, t, g, unknown or other
  misc_feature (407)..(407): n is a, c, g, or t
  modified_base (500)..(500): a, c, t, g, unknown or other
  misc_feature (500)..(500): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacacggcccctggacaggggcttggagtggatgggtctaatcaaccctaggtggtggatctacaagttactcacagagaatgcagggccgaattaccaatgaccagagacacgtcacgagtacagtctanagtggaggtgagcgagcctgagatcgtagaggacacgcagtgtattactgtgcgtatcttaggtgtaattacgactaactaattatttcgtanagtaccg

SEQ ID NO: 9984 - DNA, 511 bp, Homo sapiens
  misc_feature: GYAE6OF02FFNC3.53.73.G07.1.454.CMB.1.raw
  modified_base (204)..(204): a, c, t, g, unknown or other
  misc_feature (204)..(204): n is a, c, g, or t
  modified_base (430)..(430): a, c, t, g, unknown or other
  misc_feature (430)..(430): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtnacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgtattttgactaactttattactgaccaacagtacaattactttgnggtacgttcggaccgaagggaccaaggtagaaatacaaacgactgtggctgacacctatctgtcttcactcttcccgctac

SEQ ID NO: 9985 - DNA, 143 bp, Homo sapiens
  misc_feature: GYAE6OF02HQL9L.53.73.G07.1.454.CMB.1.raw
  modified_base (136)..(143): a, c, t, g, unknown or other
  misc_feature (136)..(143): n is a, c, g, or t
tcagcgcgtatacacacgaccggtgctcgatttagctctacgctcagggcacgaccggtgctcgatttagtacacgtgattagggattgggtgatagggtacgcactcgtctgagcgggctggcaaggcgcatagnnnnnnnn

SEQ ID NO: 9986 - DNA, 507 bp, Homo sapiens
  misc_feature: GYAE6OF02IXGBZ.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgctaacttattactgaccaaacagtaacaattactttgtaggtacgttcggaccaagggaccaaggtaggaaatacgaaacgactgtggctgacacatctgtctcatcttcccgctac

SEQ ID NO: 9987 - DNA, 494 bp, Homo sapiens
  misc_feature: GYAE6OF02F7IUJ.53.73.G07.1.454.CMB.1.raw
  modified_base (465)..(465): a, c, t, g, unknown or other
  misc_feature (465)..(465): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgtaacttattactgccaacagtacaatactttgtggtacgttcggccaagggaccaaggtgaaatcaaacgactgngctgcacatctgtcttcatctcccgcatc

SEQ ID NO: 9988 - DNA, 501 bp, Homo sapiens
  misc_feature: GYAE6OF02FIEJY.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgcaacttattactgccaacagtacaatactttgtggacgttcggccgaagggaccaaagtaggaaatacaaacgactgtggctgcaccatctgtcttcatccttcccgctac

SEQ ID NO: 9989 - DNA, 139 bp, Homo sapiens; identical to SEQ ID NO: 9960
  misc_feature: GYAE6OF02HICB8.53.73.G07.1.454.CMB.1.raw
  modified_base (138)..(139): a, c, t, g, unknown or other
  misc_feature (138)..(139): n is a, c, g, or t

SEQ ID NO: 9990 - DNA, 225 bp, Homo sapiens
  misc_feature: GYAE6OF02G1N63.53.73.G07.1.454.CMB.1.raw
  modified_base (176)..(176): a, c, t, g, unknown or other
  misc_feature (176)..(176): n is a, c, g, or t
  modified_base (216)..(225): a, c, t, g, unknown or other
  misc_feature (216)..(225): n is a, c, g, or t
tcagcgcgtatacacacgaccggtgctcgatttagctctacgctcagggcacgaccggtgctcgatttagctactacgctcagggcacgaccggtgctcgatttagctctacgctcagggcacgaccggtgctcgatttagctctacgctcagggcacgccggtgctcgatttagngacatctcgcagttcttgagcggcgtgcgaagcgcatagnnnnnnnnnn

SEQ ID NO: 9991 - DNA, 181 bp, Homo sapiens
  misc_feature: GYAE6OF02GVA1M.53.73.G07.1.454.CMB.1.raw
  modified_base (174)..(181): a, c, t, g, unknown or other
  misc_feature (174)..(181): n is a, c, g, or t
tcagcgcgtatacacacgaccggtgctcgatttagctctacgctcagggcacgaccggtgctcgatttagctctacgctcagggcacgaccggtgctcgatttagctctacgctcagggcacgaccggtgctcgatttagcagacgtctgtagcgggctggcaaggcgcatagnnnnnnnn

SEQ ID NO: 9992 - DNA, 500 bp, Homo sapiens
  misc_feature: GYAE6OF02I25MA.53.73.G07.1.454.CMB.1.raw
  modified_base (382)..(382): a, c, t, g, unknown or other
  misc_feature (382)..(382): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgaccaganacacgtccacgagtacagtctacatggagtgagcagcctgagatctgaggacacgccatgtattactgtgacgatcgttagtggtatttacgacttacaattattttgtcagtacccg

SEQ ID NO: 9993 - DNA, 508 bp, Homo sapiens
  misc_feature: GYAE6OF02FSL2E.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatcgtgggacagagttcactctcaccattagcagcctgcagcctgatgtatttgactaacttattactgaccaacagtacaatactttgtagtacgttcggaccaagggaccaaggtaggaaatcgaaacgacgtgtggctgacaccatctgtcttcatccttccgctac

SEQ ID NO: 9994 - DNA, 540 bp, Homo sapiens
  misc_feature: GYAE6OF02GSCW8.53.73.G07.1.454.CMB.1.raw
  modified_base (334)..(334): a, c, t, g, unknown or other
  misc_feature (334)..(334): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgctcccaggtgcagctggtacaagtcgggggctgagatgaagaagcctggggcctcagtgatgatttcctgcacgacatctggatacaccttcaccgacttcccttatacattgggtacacacggcccctggacaggggcttggagtggatgggtctaatccaacctggtggnggatctaacaagtttactcaacagagaatgcgagggaccaattaccatcgaccagagacacgtccaacgagtacagtactacagtggaggtgagcagcctagagatcgtagacggacacggcctagtagttacttacgtgtagacggtaattcgtttaaggtcgtaatttacgacttaacgtaatttattttgtaccagtacccgg

SEQ ID NO: 9995 - DNA, 593 bp, Homo sapiens
  misc_feature: GYAE6OF02IQEZV.53.73.G07.1.454.CMB.1.raw
  modified_base (195)..(195): a, c, t, g, unknown or other
  misc_feature (195)..(195): n is a, c, g, or t
tcagcgcgtatacacacgaccggtgctcgatttagctctacgctcagggggagtcagacccagtcaggacacagcatggacatgagggtccccgctcgagctcctggggctcctgctgctctggctcccgaggtgccgaaatgtgacatccagatgacccagtctcccttccaccctgtctgctatctgtcggancagagtcaccgtcacttcgccgggccagccaaagtattaagaccttggttggcctggtatcagcagaaaccgagggaaacgcccctaagacctcctgatctataacgacgtctaacttagacaggtgggtcccatcaaggttcagcgcagtggatcgtgggacaggacgttcactctaccacattacgcagcctgcagcctgattgtatttcgactaactttaagttaactcgaaccctaagaacgttaacctaattactttaggtaggtaaccggtttccggaaccgtaaacgggtaacctaaagggttaggaaaactaccgaaaccgacgttaggtcgggtaactgtacctaacctatcgttacgttacttactacttcccgttcccggactaacg

SEQ ID NO: 9996 - DNA, 518 bp, Homo sapiens
  misc_feature: GYAE6OF02HWG6B.53.73.G07.1.454.CMB.1.raw
  modified_base (304)..(304): a, c, t, g, unknown or other
  misc_feature (304)..(304): n is a, c, g, or t
  modified_base (403)..(403): a, c, t, g, unknown or other
  misc_feature (403)..(403): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctgggcctcagtgatgatttcctgcacgacatctggatacaccttcaccgactccccttatacattgggtacgacacggcccctggacgaggggcttgngtggatgggtctaatcaacctgtggtgatctacaagttactcacagagaatgcagggccaattacatagaccagagacacgtccacgagtacagtctanatggagtgagcagcctgacgtatcgagaggacacggcctatgtacttacgtgtgtacgtattacgttaggtaggtacttacgtacttaactaattattttagtaccagtacccgg

SEQ ID NO: 9997 - DNA, 503 bp, Homo sapiens
  misc_feature: GYAE6OF02IDARD.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgctaacttattactgccaacagtacaattactttgtaggacgtttcggacctaagggacctaaggtaggaaatcgaaacgactgtgctgcacatctgtcttcatctcccgctac

SEQ ID NO: 9998 - DNA, 185 bp, Homo sapiens
  misc_feature: GYAE6OF02GNLRX.53.73.G07.1.454.CMB.1.raw
  modified_base (162)..(185): a, c, t, g, unknown or other
  misc_feature (162)..(185): n is a, c, g, or t
tcagcgcgtatacacacgaccggtgctcgatttagctctacgctcagggcacgaccggtgctcgatttagcagacgtctgtcgcgggctggcaaggcgcatagctgcctggtcaaggactacttcctcgtactgcgctgagcgggctggcaaggcgcatagnnnnnnnnnnnnnnnnnnnnnnnn

SEQ ID NO: 9999 - DNA, 512 bp, Homo sapiens
  misc_feature: GYAE6OF02JU8K5.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcaagcgcagtgatctggacagagtcacgtctcaccattagctagcctgcagcctgatgatttgactaacttattactgaccaacacgtacaatactttgtggacgttcgacaaggaccaagtaggaaattacaaagactagtacggctgacaccgaatctcgtcttacgaactccttcccgctaac

SEQ ID NO: 10000 - DNA, 505 bp, Homo sapiens
  misc_feature: GYAE6OF02I851D.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaacctagtggtggatctacaagttactcacagagatgcagggccgaattaccatgaccagagacacgtccacgagtacagtctacatggaggtgagcagcctgagatcgagaggacacggccagtgtattactgtgcgtattcgttaggtgtattacgacttacaattagttttcgtacagtacccg

SEQ ID NO: 10001 - DNA, 522 bp, Homo sapiens
  misc_feature: GYAE6OF02HVHMA.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggcagccaaagtattaagacctggttgcctggtatcagcagaaaccagggaaagcccctagactcctgatctataagacgtctactttagacaggtggggtcccatcaaggttcagcggcagtggatcgtgggacagagttcactctcaccattagcagcctgcagcctgatgtatttgactaactttattactgaccaactagtactaattactttgtaggacgtttcggaccgtaagggacctaagggtagaaatacgaaacgactggtggctgcactatctgttcctctacttcccttccgcctacg

SEQ ID NO: 10002 - DNA, 496 bp, Homo sapiens
  misc_feature: GYAE6OF02HNQLQ.53.73.G07.1.454.CMB.1.raw
  modified_base (380)..(380): a, c, t, g, unknown or other
  misc_feature (380)..(380): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcgggggctgagatgaagaagcctggggcctcagtgatgatttcctgcacgacatctggatacaccttcaccgactcccttatacattgggtacacaggcccctggacaggggcttgagtggatgggtctaatcaaccctagtggtggatctacaagttactcacagagaatgcagggccaattaccatgaccaganacacgtccacgagtacagtctacatggaggtgagcagcctgagatcgtagaggacacggccatgtattactgtgcgatcttagtgattacgactactaattattttgtcagtaccg

SEQ ID NO: 10003 - DNA, 567 bp, Homo sapiens
  misc_feature: GYAE6OF02IRO6B.53.73.G07.1.454.CMB.1.raw
tcagcgcgtatacacacgaccggtgctcgatttagctctacgctcaggggggagtcagacccagtcaggacacagcatggacatgagggtccccgctcagctcctggggctcctgctgctctggctcccaggtgccaaatgtgacatccagaggacccagtctccttccaccctgtctgcatctgtcggagacagagtcaccgtcacttgccgggccagccaaagtattaagacctggttggcctggtatcagcagaaaccagggaaacgcccctagactcctgatctataagacgtctactttagacaggtgggtcccatcaaggttcagcggcagtggatcgtgggacagagttcactctcacatagcagcctgcagcctgatgtatttgactaacttattactgaccacagtaactaattacttgtggtacgttacggaccgtaaagggacccgaaagggtacggaaactaaccgaaaacgtaaccgttagtacgggtcgtcgtacccacctaacgtcgttacgttacttaccgtacttcccgttaccccgtaccctagttccg

SEQ ID NO: 10004 - DNA, 536 bp, Homo sapiens
  misc_feature: GYAE6OF02IDFBB.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtgggcctcagtgatgatttcctgcacgacatctggatacaccttcaccgactcccttatacattgggtacacaggcccctggacgaggggcttggaggtggagtgggtactaatccaaacctggtggtggatctaactaagttactcacagagaatgacgagggacctaattaccatcgacagacgacacgtccacgagtacagtctacagtggagtgagcagcctgagatcgtaggaggacacggcctagtcgttatcgtagtgacgtattacgttaggtagtaacgttacgacttaactaatttagttttcgtacgacgtacccgg

SEQ ID NO: 10005 - DNA, 595 bp, Homo sapiens
  misc_feature: GYAE6OF02H8557.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgttgctctggctcccaggtgccaaatgtgacatccagatgacccagtctccttccaccctgtctgcatctgtcggagacagagtcaccgtcacttgccgggcagccaaagtattaagacctggttgcctggtatcagcagaaaccagggaagcccctagactcctgatctataagacgttctaactttagacagtggggtcccatcaaggttcagcggcagtgatcgtggacagagtcactctcactattagcacgctgcagcctgactgtatttgacttaacttattacgtacgaccaactaacgttaactaaattacgtttggtacggttaaccggtttcggaccgtaaacgggaaccgtaaaggttacggtaaacgtaaccgtaaaacgtaacgtaggtacggtacgtcggaaccgaacctaacgttcgttacggttccttaacgtacctttcccgttaccccgtaccctagttacccg

SEQ ID NO: 10006 - DNA, 558 bp, Homo sapiens
  misc_feature: GYAE6OF02I93LZ.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtgggtcccatcaaggttcagcggcagtggatcgtggacagagttcactctcaccattagcagcctgcagcctgatgtatttgactaacttattactgacctaacagtaactaattacgtttggtacggtacgtttccggacgtaacggggaccgtaaagggtacggaaactacgaaacgtacgtggtacggctacggacctaaccgtattccgttggttaccttccgtatcccgtttacccgaccttacg

SEQ ID NO: 10007 - DNA, 518 bp, Homo sapiens
  misc_feature: GYAE6OF02FS56K.53.73.G07.1.454.CMB.1.raw
  modified_base (514)..(514): a, c, t, g, unknown or other
  misc_feature (514)..(514): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgctaacttattactgaccaacagtaactaattactttgtaggtacgttcggaccgtaagggaccaaaggtaggaaatacgaaacgtacgtgtaggtctgacacctatctgtcttcatccttcccnctac

SEQ ID NO: 10008 - DNA, 579 bp, Homo sapiens
  misc_feature: GYAE6OF02HZ673.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctaataagacgtctactttagacagtggggtcccatcaaggttcagcggcagtggatctgggacagagttcactctcaccattagcagcctgcagcctgatgtatttgctaacttattactgaccaactagtaacaattacgtttagtaggtaccgtttcgggacctaaaggggaccctaaagggtacggaaaattacgaaaaccggtaacgttggtacgggcttacggacctaacccgtaagttccgttaggttacctttaccgtaactttcccgtttaccccggcccttaacg

SEQ ID NO: 10009 - DNA, 495 bp, Homo sapiens
  misc_feature: GYAE6OF02I14EB.53.73.G07.1.454.CMB.1.raw
  modified_base (342)..(342): a, c, t, g, unknown or other
  misc_feature (342)..(342): n is a, c, g, or t
  modified_base (349)..(349): a, c, t, g, unknown or other
  misc_feature (349)..(349): n is a, c, g, or t
  modified_base (482)..(482): a, c, t, g, unknown or other
  misc_feature (482)..(482): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactccccttatacattgggtacgacaggcccctggacaggggctgagtggatgggtctaatcaacctgtggtgatctacaagttcncacaganaatgcagggccaattaccatcgaccagagacacgtaccacgagtacagtactacagtggaggtgagcagcctgagatcgtgaggacacggccatgtattactgtgcgtatcttagtgattacgactactaatntttagtcagtccg

SEQ ID NO: 10010 - DNA, 500 bp, Homo sapiens
  misc_feature: GYAE6OF02GUNPC.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtgatctacaagttactcacagagaatgcagggccaattaccatgacagagacacgtccacgagtaacagtctacatggaggtgagcagcctgagatcgtgaggacacggccatgtattactgtgcgtatcttagtggtattacgacttactaattattttgtcagtacccg

SEQ ID NO: 10011 - DNA, 568 bp, Homo sapiens
  misc_feature: GYAE6OF02I52Y0.53.73.G07.1.454.CMB.1.raw
  modified_base (267)..(267): a, c, t, g, unknown or other
  misc_feature (267)..(267): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggtggcctggtatcagcagaaaccagggaaancccctagactcctgatctataagacgtctactttagacagtgggtccatcaaggttcagcggcagtgatcgtgggacagagttcactctcacctattagcagcctgcagcctgatgtatttgactaacgtttattactgacccaataacgtaactaacttacgtttgtacggtaccggttcgggaccgtaaggggaacctaaaggggttacggaaaatccgaaaaccgtacgttggtacggtcttacggaccaacccgtattccgtacgttcctttacaccttccgttcccccgacttacg

SEQ ID NO: 10012 - DNA, 509 bp, Homo sapiens
  misc_feature: GYAE6OF02IKJJT.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactccccttatacatttgggtacgacaggcccctggacaggggcttgagtggatgggtctaatcaaccctagtggtgatctacaagttactcacagagaatgcagggccgaattacatgaccagagacacgtccagagtacatctacatggaggtgagcagcctgagatcgtagaggacgaccggccaatgtaattactgtagtcgaattcttagtggtaattacgactaactaattattttgtcagtacccg

SEQ ID NO: 10013 - DNA, 508 bp, Homo sapiens
  misc_feature: GYAE6OF02IOYHG.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggaactggagggtcttctgcttgctgtcagtagctccaggtgctcgctcccaggtgcagctggtacaatcgggggctgagatgaagaagcctggggcctcagtgatgatttcctgcacgacatctggatacaccttcaccgactccccttatacattgggtacgacaggcccctggacaggggcttgagtggatgggtctaatcaacctgtggtgatctacaagttactcacagagaatgcagggccgaattaccatgaccagagacacgccacgagtacagtctacatggaggtgagcagcctgagatcgtgaggacgacggccatgtattacgtgtgtcgtattcttaggtgaatttacgaacttactaattattttacggtctagacccg

SEQ ID NO: 10014 - DNA, 514 bp, Homo sapiens
  misc_feature: GYAE6OF02F44BF.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgtatttgctaacttattactgaccaacagtacaattactttgtaggtacgtttcggccgtaagggaccaaggtaggaaatcgaaacgactggtggctagcaccatcgtgtcttcatccttcccgcctacg

SEQ ID NO: 10015 - DNA, 183 bp, Homo sapiens
  misc_feature: GYAE6OF02H5SMD.53.73.G07.1.454.CMB.1.raw
  modified_base (158)..(158): a, c, t, g, unknown or other
  misc_feature (158)..(158): n is a, c, g, or t
  modified_base (161)..(161): a, c, t, g, unknown or other
  misc_feature (161)..(161): n is a, c, g, or t
  modified_base (167)..(167): a, c, t, g, unknown or other
  misc_feature (167)..(167): n is a, c, g, or t
  modified_base (177)..(177): a, c, t, g, unknown or other
  misc_feature (177)..(177): n is a, c, g, or t
  modified_base (180)..(180): a, c, t, g, unknown or other
  misc_feature (180)..(180): n is a, c, g, or t
  modified_base (182)..(183): a, c, t, g, unknown or other
  misc_feature (182)..(183): n is a, c, g, or t
tcagcgcgtatacacacgaccggtgctcgatttagctctacgctcagggcacgaccggtgctcgatttagctctacgctcagggcacgaccggtgctcgatttagctctacgctcagggcacgaccggtgctcgatttagatcgtctgtgttgggttnagnggcggntgacgaggcntangnn

SEQ ID NO: 10016 - DNA, 145 bp, Homo sapiens
  misc_feature: GYAE6OF02FI0IK.53.73.G07.1.454.CMB.1.raw
  modified_base (143)..(145): a, c, t, g, unknown or other
  misc_feature (143)..(145): n is a, c, g, or t
tcagcgcgtatacacacgaccggtgctcgatttagctctacgctcagggaccggtgctcgatttagctctacgctcagggcacgaccggtgctcgatttagtgacatctcgcagttcttgagcgggctggcaaggcgcatagnnn

SEQ ID NO: 10017 - DNA, 175 bp, Homo sapiens
  misc_feature: GYAE6OF02HPOJ9.53.73.G07.1.454.CMB.1.raw
  modified_base (173)..(175): a, c, t, g, unknown or other
  misc_feature (173)..(175): n is a, c, g, or t
tcagcgcgtatacacacgaccggtgctcgatttagctctacgctcagggcacgaccggtgctcgatttagctctacgctcagggcacgaccggtgctcgatttagctctacgctcagggcacgaccggtgctcgatttagcagacgtctgagcgggctggcaaggcgcatagnnn

SEQ ID NO: 10018 - DNA, 496 bp, Homo sapiens
  misc_feature: GYAE6OF02I4U9X.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtccatcaaggttcagcggcagtggatcgtggacagagttcactctcaccattagcagcctgcagcctgatgtatttgactaacttattactgaccaatagtacaattacttgtggtacgttcggcaagggaccaaggtgaaatcaacgatgtggctgcacatctgtcttacatcttccgctac

SEQ ID NO: 10019 - DNA, 147 bp, Homo sapiens; identical to SEQ ID NO: 9561
  misc_feature: GYAE6OF02HLOC5.53.73.G07.1.454.CMB.1.raw
  modified_base (147)..(147): a, c, t, g, unknown or other
  misc_feature (147)..(147): n is a, c, g, or t

SEQ ID NO: 10020 - DNA, 504 bp, Homo sapiens
  misc_feature: GYAE6OF02GLCTA.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcacattagcagcctgcagcctgatgatttgctaacttattactgacctaacagtacaattactttgtggtacgttcggccaagggaccaaggtagaaatcgaaacgactgtggctgcacctatctgtcttcactcttcccgctac

SEQ ID NO: 10021 - DNA, 574 bp, Homo sapiens
  misc_feature: GYAE6OF02GBEOE.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttaccgggccagccaaagtattaagacctggttgcctggtatcagcagaaaccagggaaagcccctagactcctgatctatagacgtctactttagacagtggggtcccatcaaggttcagcggcagtggatcgtgggacagagttcactctcaccattagcagcctgcagcctgatgtattttcgactaacttattaactgacctaaacagttaacaactttactttggtaggtacgtttcggaccgtaaaggggtaacctaaagggtcggaaaactcgaaaacgtactaggtacggaccgtaggccctaaccgtagttccgttagttcctttaccgtaacttcccgttaccccgtcctatttcccg

SEQ ID NO: 10022 - DNA, 149 bp, Homo sapiens
  misc_feature: GYAE6OF02FHLIL.53.73.G07.1.454.CMB.1.raw
  modified_base (145)..(149): a, c, t, g, unknown or other
  misc_feature (145)..(149): n is a, c, g, or t
tcagcgcgtatacacacgaccggtgctcgatttagctctacgctcagggcacgaccggtgctcgatttagctctacgctcagggcacgaccggtgctcgatttagtgacatctcgcagttcttgagcggcgtgcaagcgcatagnnnnn

SEQ ID NO: 10023 - DNA, 512 bp, Homo sapiens
  misc_feature: GYAE6OF02GHOJ4.53.73.G07.1.454.CMB.1.raw
  modified_base (506)..(506): a, c, t, g, unknown or other
  misc_feature (506)..(506): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccataaaggttcagcggcagtggatcgtgggacagagttcactctcaccattagcagcctgcagcctgatgattttgctaacttattactgaccaacagtaacaatactttgtcggtacgttcggccgaaagggaccaaggtaggaaatacaaacgactgtaggctgcaccatctgtcttcacttcctccncctatc

SEQ ID NO: 10024 - DNA, 527 bp, Homo sapiens
  misc_feature: GYAE6OF02I1YLB.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccaggaaacgcccctagactcctgatctataagacgtctacttagacagtgggtccatcaaggttcagcgcagtgatctgggacagagttcactctcaccattagcagcctgcagcctgatgtatttgactaacttattactgaccaacgtataactaattactttgtacggtacgttacggcctaacgggacctaaagggtacgaaaatacgaaacgacgtgtcggctacgacaaccatcgtagttccttcacttccgttcccgctaac

SEQ ID NO: 10025 - DNA, 555 bp, Homo sapiens
  misc_feature: GYAE6OF02INLF7.53.73.G07.1.454.CMB.1.raw
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (243)..(243): a, c, t, g, unknown or other
  misc_feature (243)..(243): n is a, c, g, or t
  modified_base (397)..(397): a, c, t, g, unknown or other
  misc_feature (397)..(397): n is a, c, g, or t
tcagcgcgtatacacacgaccggtgctcgatttagctctacgctcaggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtnacttgccggcagcaagtntaagactggttgctgtatcagnagaaaccagggaacgcccctagactcctgactctaataagacgtctaacttagacagtcgggtcccatcgaagttcagcgcagtgatcgtgggacagagttcacgtctacactattagcagctagacagccgtagatgtatttagactaacttnttactcgacctaacagttaacaattactttaggtacggtacgttccggtaaccgaacgggtaaccgtaaacggtaggaaactacgtaaacgtacgtaggtcggtacgtagcctaacgtacctagttacgttcgtacctacttactttaccccgctacg

SEQ ID NO: 10026 - DNA, 531 bp, Homo sapiens
  misc_feature: GYAE6OF02G8APQ.53.73.G07.1.454.CMB.1.raw
  modified_base (333)..(333): a, c, t, g, unknown or other
  misc_feature (333)..(333): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacgcccctagactcctgatctataagacgtctactttagacagtggggtccatcaaggttcagcggnagtggatcgtgggacagagttcactctcaccattacgcagcctgcagcctgatgtatttgactaacttattactcgaccaacagtaactaattactttggtaggtaccgttcggaccgtaagggaccaagggtaggaaactacaaacgggtactggtaggctgactaccatcgtgttcttcacttccttcccgctacg

SEQ ID NO: 10027 - DNA, 524 bp, Homo sapiens
  misc_feature: GYAE6OF02JCEPZ.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttggagtggatgggtctaatcaacctaggtggtggatctacaagttactcacagagaatgcagggccaattaccatcgaccagagacacgtccacgagtacagtctacagtggaggtgagcagcctgagatcgtagaggacgacggcctagtagtattacgtgtagacgtattacgttaggtggtaactttaccgacttaactaatttattttacgtacagtacccg

SEQ ID NO: 10028 - DNA, 499 bp, Homo sapiens
  misc_feature: GYAE6OF02GLGDV.53.73.G07.1.454.CMB.1.raw
  modified_base (486)..(486): a, c, t, g, unknown or other
  misc_feature (486)..(486): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgctaacttattactgccaacagtacaatactttgtggacgttcggccaagggaccaaggtggaaatcaaacgactgtaggctgcaccatctgtcttnatcttcccgctac

SEQ ID NO: 10029 - DNA, 498 bp, Homo sapiens
  misc_feature: GYAE6OF02HCQXM.53.73.G07.1.454.CMB.1.raw
  modified_base (449)..(449): a, c, t, g, unknown or other
  misc_feature (449)..(449): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttggagtggatggggtctaatcaaccctagtggtggatctacaagttactcacagagaatgcagggcgaattaccatcgacagagacacgtccacgagtacagtctacatggagtgagcagcctgagatctgaggacacgcatgtattacngtgcgatcttagtggtattagacttactaattattttgtacagtacccg

SEQ ID NO: 10030 - DNA, 601 bp, Homo sapiens
  misc_feature: GYAE6OF02H193R.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaaagtattaagacctggttggcctggtatcagcagaaaccagggaaacgcccctagactcctgatctataagacgtctactttagacaggtcgggtcccatcaaggttcaggcggcagtggatcgtgggacagtacgttcactctcaacctattagcagcctgcagcctgattgtatttcgactaactttacttaactcgacctaaactacgtaactaactttaacgtttggtacgggtaaccgttttccgggaaccgtaaacggggaaccctaaaggggtacggtaaaacgtacgaaaaccggtacttaggttacgggacttcggtacctaaccgagttcctacgttccgttacacgttttaccctccccgtactaccg

SEQ ID NO: 10031 - DNA, 524 bp, Homo sapiens
  misc_feature: GYAE6OF02H99D2.53.73.G07.1.454.CMB.1.raw
  modified_base (423)..(423): a, c, t, g, unknown or other
  misc_feature (423)..(423): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattggtacgacaggcccctggacaggggcttgagtggatgggtctaatcaacctagtggtgatctacaagttactcacagtagaatgactaagggccgaattaccatacgaaccagagacacgtacccagacgtacagtctaacatgggaggtanagacagcctgagatctggacggacacggccatgttattactggtcgcgtaatctttaggtggtaacttacgactaataatttagtttcgtacacgtaccgg

SEQ ID NO: 10032 - DNA, 537 bp, Homo sapiens
  misc_feature: GYAE6OF02G6ZKB.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttcggcctggtatcagcagaaaccagggaaacgcccctagactcctgatctataagacgtctactttagacagtggggtcccatcaaggttcagcggcagtgatcgtggacagagttcactctcacctagttagcagcctgcagccctagactgtattttcgactaactttattaactcgtaccaaactagtacaattactttggtacgtacggttacggacgaaggaaccgaaggtaggaaatcgaaacgactagtcggtctgacaccgatcgtacgttctctacgtccgttccgctac

SEQ ID NO: 10033 - DNA, 521 bp, Homo sapiens
  misc_feature: GYAE6OF02GDTWA.53.73.G07.1.454.CMB.1.raw
  modified_base (430)..(430): a, c, t, g, unknown or other
  misc_feature (430)..(430): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttgagtggatgggtctaatcaaccctagtggtggatctacaagttactcacagagaatgcaggggccaattaccatgaccagagacacgtccaacgagtacagtctacagttggaggtgagcagctgagatcngaggacacgccaagtgtattactgtgcgtagtctttaaggtggtaacgttaacgtacttaactaatttaagttttcgtacgtagtaccccg

SEQ ID NO: 10034 - DNA, 503 bp, Homo sapiens
  misc_feature: GYAE6OF02FIO3C.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgatttgctaacttattactgccaacagtacaattactttgtggtacgttcggccaagggaccaaggtaggaaatcaaacgtactgtggctgcaccatctgtcttcactcttcccgctac

SEQ ID NO: 10035 - DNA, 534 bp, Homo sapiens
  misc_feature: GYAE6OF02ICPC6.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagcctggggcctcagtgatgatttcctgcagacatctggatacaccttcaccgactcccttatacagttgggtacgacacggcccctggacaggggcttggagtggagtgggtactaatccgaacccgtaggtgggtgagtctaactaagttactcacagagaatgacagggaccgaattaccatacgacagaagacgacgtaccaacgtagtaacacgtctacagtaggaggtgagcgagcctagagatcgtagaggaccacggccattagtattacgtgtgcgtatcgttaggtaggtattacgactactaattattttgctagtaaccg

SEQ ID NO: 10036 - DNA, 538 bp, Homo sapiens
  misc_feature: GYAE6OF02IN8YC.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctacttagacagtgggtccatcaaggttcagcgcagtggatcgtgggacagagttcactctcaccattagcagcctgcagcctgatgtatttgctaacttattactagacctaaacagtaactaattactttaggtggtacgttcggaccgaagggaccgaaagggtggaaaatacgaaacgtactcggtaggcttacgactaacctatacgtcgttactttcacttccttccccgacctacg

SEQ ID NO: 10037 - DNA, 502 bp, Homo sapiens
  misc_feature: GYAE6OF02HA88G.53.73.G07.1.454.CMB.1.raw
  modified_base (475)..(475): a, c, t, g, unknown or other
  misc_feature (475)..(475): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgtatttgactaacttattactgaccaactagtacaattactttgtggtacgttcgaccaagggaccaaggtgaaatcaaacgactgacggntgcaccatctgtcttcatctccgctac

SEQ ID NO: 10038 - DNA, 140 bp, Homo sapiens
  misc_feature: GYAE6OF02GJRWU.53.73.G07.1.454.CMB.1.raw
  modified_base (140)..(140): a, c, t, g, unknown or other
  misc_feature (140)..(140): n is a, c, g, or t
tcagcgcgtatacacacgaccggtgctcgatttagctctacgctcaggcacgaccggtgctcgatttagtagtgtagattcgcgggggatggcctccctcgagtctacagtgctctgagcgggctggcaaggcgcatagn

SEQ ID NO: 10039 - DNA, 513 bp, Homo sapiens
  misc_feature: GYAE6OF02GE32O.53.73.G07.1.454.CMB.1.raw
  modified_base (358)..(358): a, c, t, g, unknown or other
  misc_feature (358)..(358): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactntcaccattagcagcctgcagcctgatgatttgctaacttattactgccaacagtaacaatactttgtaggtacgttcggccaagggacctaagggtggaaaactcaaacgactggtaggctagcaacctatcgtgtcttcatccttcccgctacg

SEQ ID NO: 10040 - DNA, 210 bp, Homo sapiens
  misc_feature: GYAE6OF02GXETO.53.73.G07.1.454.CMB.1.raw
  modified_base (206)..(210): a, c, t, g, unknown or other
  misc_feature (206)..(210): n is a, c, g, or t
tcagcgcgtatacacacgaccggtgctcgatttagctctacgctcagggcacgaccggtgctcgatttagctctacgctcagggcacgaccggtgctcgatttagctccacgctcagggcacgaccggtgctcgatttagtacacgtgattagggattgggtgatagggtacgcactcgtctgagcgggctggcaaggcgcatagnnnnn

SEQ ID NO: 10041 - DNA, 529 bp, Homo sapiens
  misc_feature: GYAE6OF02HEXB5.53.73.G07.1.454.CMB.1.raw
  modified_base (190)..(190): a, c, t, g, unknown or other
  misc_feature (190)..(190): n is a, c, g, or t
  modified_base (226)..(226): a, c, t, g, unknown or other
  misc_feature (226)..(226): n is a, c, g, or t
  modified_base (269)..(269): a, c, t, g, unknown or other
  misc_feature (269)..(269): n is a, c, g, or t
  modified_base (282)..(282): a, c, t, g, unknown or other
  misc_feature (282)..(282): n is a, c, g, or t
  modified_base (411)..(411): a, c, t, g, unknown or other
  misc_feature (411)..(411): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttgccgggccagccaaagtnttaagacctggttggcctggtatcagcagaaaccagggaaacncccctagactccngatctataagacgtctacttagacagtggggtccatcaaggttcagcggcagtggatcgtggacagagttcactctcaccattagctagcctgcagcctgatgatttgctaaattattaactgaccaanagtacaattacttgtagtacgtttcgccgaagggaccaaaggtagaaactacgaaacgactgtacggctaggctaaccgattccgtgttaccttcgaacgttccttaccccgactacg

SEQ ID NO: 10042 - DNA, 497 bp, Homo sapiens
  misc_feature: GYAE6OF02F24TC.53.73.G07.1.454.CMB.1.raw
  modified_base (424)..(424): a, c, t, g, unknown or other
  misc_feature (424)..(424): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccgaattaccatgaccagagacacgtccacgagtacagtctacatggagtgagcagcctganatctgagacacgcatgtattatgtgcgtatcttagtggtattacgacttaacaattattttgtacagtacccg

SEQ ID NO: 10043 - DNA, 554 bp, Homo sapiens
  misc_feature: GYAE6OF02IPPU0.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggcagccaaagtattaagacctggttgcctggtatcagcagaaaccagggaaagcccctagactcctgatctataagacgtctactttagacagtgggtccatcgaagttcagcggcagtggatcgtagggacagtagttcactctacacctattagcagcctgcagcctgatgtatttgactaacgtttattactcgaccaactaacgtaacaattacgtttgtacggtaccgttacggaccgtaaagggaccctaaaggggtagaaacgttacaaaacgtagtacggtggctacggactaacctacgttcgtcgttcttacacttccttcccgtcctacg

SEQ ID NO: 10044 - DNA, 489 bp, Homo sapiens
  misc_feature: GYAE6OF02FL7FX.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcagggccaataccatgacagagacacgtcacgagtacagtcacatggagtgagcagcctgagatcagaggacgacgccatgtattactgtgcgatctagtggtattacgactacaattatttgtcagtaccg

SEQ ID NO: 10045 - DNA, 588 bp, Homo sapiens
  misc_feature: GYAE6OF02HNAQV.53.73.G07.1.454.CMB.1.raw
  modified_base (190)..(190): a, c, t, g, unknown or other
  misc_feature (190)..(190): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttcggccgggccagccaaagtattaagacctggttcgcctggtatcagcagaaaccgagggaaacgcccctagacctcctgatactataagaccgtacttactttagactaggtcggggtcccatcgaaggttcagcggcagtggactcgtaggacagacgttcactctacacctattacgcacgcctgcacgtcctgattgtatttgactaactttattactcgacctaacgactaactaatttactttggtacggtacggttaccgggacccgtaaggggtaaccaaggggttacggaaactacgaaacggtacgtggtacgggtctacggacctacctattccgttacgttcttactaccttcccgttcccgacctacg

SEQ ID NO: 10046 - DNA, 598 bp, Homo sapiens
  misc_feature: GYAE6OF02I3U7U.53.73.G07.1.454.CMB.1.raw
  modified_base (357)..(357): a, c, t, g, unknown or other
  misc_feature (357)..(357): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaacgcccctagactcctgatctataagacgtctactttagacagtcgggtccatcaaggttcagcggcagtgatcgtggacagagttcactcncacattagcagctgcagcctagatgtatttgactaacgttattactgaccaactacgtaactaattacgtttaggtacggtaccgtttacgggaccgtaaacggggtacccgtaaagggtaacggaaaacgtaaccgtaaaaccggtaacgttaggttacgggaccgttacggacctaaccctaacgttaccgttacgttacctttaccgtactttccccgtttaccccgacccttaaccg

SEQ ID NO: 10047 - DNA, 501 bp, Homo sapiens
  misc_feature: GYAE6OF02FGUKE.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagtcaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgtatttgcaacttattactgccaacagtactaatactttgtggtacgttcggaccaagggaccaaggtaggaatacaacgactgtggctgcactatctgtcttcatccttccgctac

SEQ ID NO: 10048 - DNA, 525 bp, Homo sapiens
  misc_feature: GYAE6OF02G7W7Y.53.73.G07.1.454.CMB.1.raw
  modified_base (229)..(229): a, c, t, g, unknown or other
  misc_feature (229)..(229): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttccngcacgacatctggatacaccttcaccgactcccttatacattgggtacgacaggcccctggacaggggcttggagtggagtgggtctaatcaacctagtggtggatctacaagttactcacagagaatgcgaggccaataccatcgacagacgacacgtccacgagtacagtactacagtggaggtgagcagcctgagatctggacggacacggaccagtgttattacgtgtcgtacgtattacgttaggtggtaagttacgacttaactaatttagttttagtactacgtacccg

SEQ ID NO: 10049 - DNA, 1127 bp, Homo sapiens
  misc_feature: GYAE6OF02JLCRE.53.73.G07.1.454.CMB.1.raw
  modified_base (139)..(139): a, c, t, g, unknown or other
  misc_feature (139)..(139): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgctagntgtcagtagtctccacggtaggtctcgccgtccctaccggtggtcgacgcgtcggttacgaaactacgggggtccgggtcgtaggagttagaaggaaaggaccgtcgggggtccgggtcctaggtaggtagtaggtacgttttccttcggcgaaccggaaccgaacttccgttcgggtaagttaacctaacccctttacccgtaacccggaaccccgttacccccttttaacttaaacctaacgttttacgggggttaacccgggaacctaccgggtaccccccggttaccgggtaaccggaacggggggtccggtttaggtaacgggtaggggttacggtggggtttacggttaaaccttacgtaaaccccccggttaaacgggtttggggtggggttaacgttaccttaacccgttaaaacggttttaaaccgtttcccgtaaaccgaaacgggtaaacgggttaaaagttaacggcccgggtaaaccgggggtaacccggggttaaaaccttttaaaaccctaacggttacggtaaaccccggaaacggaaaccgggaaaccgttaaaccccgggtaccccgtaaaacccgggtaaacgggtttaaaacccggttaaacgggtttaacccgtttaaacccgtaaacggttaacgggggtttaaaccgggggtaagggttaaacggggtaaccgtttaaacccgggtccggttaaaacgggaaacggttttaccgttaaccggggttaaacggggaaaacccgggttaacccccgggtaaacccgggtttaaacgtttaacgggtttttaaacgtttaacccggttttaaccggttttcggggaacccggttacgtttttaaccccggttttaaagggtttagggttaaccggtttaaaccggtttaaacccttaaacccgttttaagttttaaaccgttttttttaaggtttcccggaacccggtaaccccgggttaaacccggg

SEQ ID NO: 10050 - DNA, 529 bp, Homo sapiens
  misc_feature: GYAE6OF02GA790.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcggggctgagatgaagaagcctggggcctcagtgatgatttcctgcacgacatctggatacaccttcaccgacttcccttatacattgggtacacacggcccctggacgaggggcttgagtggagtgggtctaatccaaccgtagtggtggatctaactaagttactcaacagagaatgcgagggccaaattaccatagaccagagacacgtcacgacgtacagtctacagtggagtgagcagccgtagagatcgagacggacgacggcatagtattacgtgtacgcgtattcgttaggtcggttatacgtaacttactaatttagtttcgtacgacgtacccgg

SEQ ID NO: 10051 - DNA, 630 bp, Homo sapiens
  misc_feature: GYAE6OF02IYDAW.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggatggtcttctgcttgctgtcagtagctccaggtgctcgctcccaggtgcagctggtacaatcggggctgagatgaagaagcgtgggcctcgagtgatgtatttccgtgccacgacatctaggactacaccttcaccgactacccttatactattgggtacgacgacggcccctggacgaggggtctggagtggagtgggtactaatctaacccgtagtggtggattactaacgtaagttactcacgagaagaagtgacgacgggaccgtaacttaaccgatcgaaccaaggacgaaccgaccgtacccgacgaagtaaccgagtactaacgaagttagggaggttagaagtccgaggtccctaggacgtatacgtaggaacggaccgaacgggcctaagttcgttaacgtttacgtcggtaggaccgttattacggtttaacggtacggttaacgttaaccggtaccttaaacgttaagtttaacgtttttcgtacccgtaacccgg

SEQ ID NO: 10052 - DNA, 586 bp, Homo sapiens
  misc_feature: GYAE6OF02F7T2Z.53.73.G07.1.454.CMB.1.raw
tcagcgcgtatacacacgaccggtgctcgatttagctctacgctcagggggagtcagacccagtcaggtacacagcatagggacatggagggtccccgctcgagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacaggtggggtcccatcaaggttcagcggcagtggatgtgggacagagttcactctcacattagcagcctgcagcctgatgtatttgactaacttattactcgaccaaactacgtaactaattactttggtaggtaccgtttcggaccgtaaaggggacccgtaaagggtacggaaaactaccgaaaacgtacgttaggtacggtactacggtaccgtaacctacgttccgttagttccgtttaccgtacctttccctttaccccggaccttaaccg

SEQ ID NO: 10053 - DNA, 536 bp, Homo sapiens
  misc_feature: GYAE6OF02G289J.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaagcccctagactcctgatctaataagacgtctactttagacagtggggtccatcaaggttcagcgcagtgatctggacagagttcactctcaccattagcagcctgcagcctgatgtatttcgactaactttattactgaccaacacgtactaattactttagtacggtacgtttacggaccgtaaagggacctaaagggtacggaaatacgaaacgtacgtggtaggctacgcaaccattcgtcgttcttacacttccgttcccgctacg

SEQ ID NO: 10054 - DNA, 532 bp, Homo sapiens
  misc_feature: GYAE6OF02G3XU7.53.73.G07.1.454.CMB.1.raw
  modified_base (420)..(420): a, c, t, g, unknown or other
  misc_feature (420)..(420): n is a, c, g, or t
  modified_base (479)..(479): a, c, t, g, unknown or other
  misc_feature (479)..(479): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattgggtacacacggcccctggacaggggcttggagtggagtcgggtactaatcaacccgtagtggtggatctaactaagttactcaacagagaagtgacgagggaccaattaccatcgaccagacgacacgtacagacgtacagtctacngtggaggtgagcgagcctgagtatcgtagacggacacggccatgtattacgtgtgcgtntcgttaggtgtaacttacgaacgttaataatttattttcggtaccagtacccg

SEQ ID NO: 10055 - DNA, 623 bp, Homo sapiens
  misc_feature: GYAE6OF02GBZTO.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggcagccaaagtataagacctggttggcctggtatcagcagaaaccgagggaaacgcccctagactcctgatctataagacgtctacttagacagtcggggtccatcaaggttcagcggcagtggatctgggacagagttcactctcaccattagcagcctgcagcctgtatgtatttgactaactttacttactcgtacctaaactaacgtacctaaatttacgttttacggttagggtaaccggtttaccgggtaacccgtaaacgggggtaacccgtaaaaggggttaacggtaaaacgttaaccgaaaaccgtaacgttaggtacgggtacctacggaccgtaaccctaacgtttccgttacggttccgtttacctaaccgtttccctttaccccggtccttaaccg

SEQ ID NO: 10056 - DNA, 780 bp, Homo sapiens
  misc_feature: GYAE6OF02J2HCA.53.73.G07.1.454.CMB.1.raw
tcagcgcgtatacacacgaccggtgctcgatttagctctacgctcagggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtgggcctcagtgatgatttcctgcacgacatctggataccaccttcaccgtactcccttaatacagttcgggtacgactacggcccctggacgaggggtcttggagttgggaagttggggtaccttaaacgtccaaacccgttaggttggtcggtaacgtacctaaccgtaaaacggtttacctaccgaaccgaaggtaacgtaaacgttcggaccggtaacggggtacccgtaaactttaacccgtaagtacgaacccgtaaacggacgaaaccgtaaccggttacccgaaccgggtaacgttaaacccgtaagggttaaccttaaccgaaggtttaacggggaacggggttacggaaggacccgtaaggccccggtttaaggaacggttaacgttcggtaaccggtaacgggaaccgtaaccggggtaccttaagttaacggttaatttaacccggttggtacggttacggttaacgtttaccggttaacggttgggttaaaaccgtttacggtaaacgtttaaccgttaaagttttaccgtttttaacggttaccgtacgttaaccccggg

SEQ ID NO: 10057 - DNA, 658 bp, Homo sapiens
  misc_feature: GYAE6OF02GPP0M.53.73.G07.1.454.CMB.1.raw
  modified_base (232)..(232): a, c, t, g, unknown or other
  misc_feature (232)..(232): n is a, c, g, or t
  modified_base (500)..(500): a, c, t, g, unknown or other
  misc_feature (500)..(500): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtatttccngcacgacatctggatacacccttcaccgacctcccttatactagttgggtaccgacgacggcccccgtaggacgaggggtcttggaggtgggagttgggtactaataccgaacccgttaggtcgggtggattacgtaacgtaaacgtttactacactaagagtaatcggacgaacggggacccgtaaattacccgaagttcgaaccgaagaacgaaccgaaccgtaccaacggataacgtacgtactacaggtagggtaggtggacgnacgtcgtagagtatcgtagggaggacccgacggacctaagttacgtaacgttcgttagtacgtacggtaacgttacgttttaagggacggtttaacgtttaaccggaacctttaacgttaaagttttaacgtttttcgtaccggtacgtaaccccggg

SEQ ID NO: 10058 - DNA, 535 bp, Homo sapiens
  misc_feature: GYAE6OF02FNTRM.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtccatcaaggttcagcggcagtggatctgggacagagttcactctcaccattagcagcctgcagcctgatgatttgctaacttattactgtaccaacagtaactaattacgtttgtaggtacgttacggaccgtaagggaaccgtaaggtaggaaactacgaaacgtacgtagtacggtcgtacgacaccgtatcgtacgtcttacactccttacccgctac

SEQ ID NO: 10059 - DNA, 517 bp, Homo sapiens
  misc_feature: GYAE6OF02GBPLM.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattgggtacgacacggcccctggacaggggcttggagtggatgggtctaatcaacctagtggtgatctacaagttactcacagagaatgcgacggggaccgtaattacccatacgaccgagacgacacgtaccacgagtacagtctacagtggaggtgagcagctgagatcgtgaggacacggcagtgtattactgtgcgtattcttagtggtattacgacttaactaattattttcgtacacgaccg

SEQ ID NO: 10060 - DNA, 509 bp, Homo sapiens
  misc_feature: GYAE6OF02GHXUC.53.73.G07.1.454.CMB.1.raw
  modified_base (339)..(339): a, c, t, g, unknown or other
  misc_feature (339)..(339): n is a, c, g, or t
  modified_base (347)..(347): a, c, t, g, unknown or other
  misc_feature (347)..(347): n is a, c, g, or t
  modified_base (350)..(350): a, c, t, g, unknown or other
  misc_feature (350)..(350): n is a, c, g, or t
  modified_base (354)..(354): a, c, t, g, unknown or other
  misc_feature (354)..(354): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattgggtacgacacggcccctggacgaggggcttgagtggatgggtctaatcaacctgtggtggatctanaagttacncanaganaatgcagggccaattaccatcgacagagacacgtccaacgagtacagtctacgagtggagtgagcagcctagagatcgtgaggacacggccatgtattactgtgcgtatcttaggtggtaacttacgactactaattagtttcgtacacgtaccg

SEQ ID NO: 10061 - DNA, 510 bp, Homo sapiens
  misc_feature: GYAE6OF02GC1JD.53.73.G07.1.454.CMB.1.raw
  modified_base (448)..(448): a, c, t, g, unknown or other
  misc_feature (448)..(448): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaacctagtggtggatctacaagttactcacagagaatgcagggccaattaccatgaccagacgacacgtccacgagtacagtctacatggaggtgagcagcctgagatctgaggcacgccatgtattacngtgcgtattccttaggtggtaacttacggtacttaacgtaattagttttcgtacagtacccg

SEQ ID NO: 10062 - DNA, 527 bp, Homo sapiens
  misc_feature: GYAE6OF02G3RQW.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaaccctagtggtggatctacaagttactcacagagaatgcgagggccgaattaccatagaccagacgacacgtccacgagtacagtctacagtggagtgagcagcctgagatcgtagaggacgacggccagttgtattacgtgtcgcgtattcgttaggtggtaatttaccgacttaactaagtttattttacgtacctacgtacccgg

SEQ ID NO: 10063 - DNA, 514 bp, Homo sapiens
  misc_feature: GYAE6OF02GV9OR.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttgagtggatgggtctaatcaacctagtggtggatctacaagttactcaacagagaatgacagggccaattacatgacagagacacgtccacgagtacagtactacatggaggtagagcacgcctgagtatcgtagaggacacggaccatagtattacgtgtgacgtaatcgttaggtgtaattacgtaactactaattattttcgtacagtacccg

SEQ ID NO: 10064 - DNA, 582 bp, Homo sapiens
  misc_feature: GYAE6OF02HT7YF.53.73.G07.1.454.CMB.1.raw
  modified_base (354)..(354): a, c, t, g, unknown or other
  misc_feature (354)..(354): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgtatttcctgccacgacatctggatacaccttcaccgaccttccttatacagttgggtacacgacggcccctagggacgaggggcttggagtggatgggtctaatcaaccgtagtggtgatctacaagttacncacagagaatgacgagggaccaattaccatacgaccgagacgacacgtaccgacgtagtacagtactaacagtgggtaggtaggacgacgacgccgtaggacgagttcgtaggaacggaccgaccggacctagtagttattacgtgtacgtacgtattacgtttaaggtaggtaacgtttaacgtaacttaacgtaaagtttacttttacggtacctacggtacccgg

SEQ ID NO: 10065 - DNA, 538 bp, Homo sapiens
  misc_feature: GYAE6OF02I0GCD.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgcctggccagccaaagtataagcctggttgcctggtatcagcagaaaccagggaaacgccctagactcctgatctataagacgtctactttagacagtgggtcccatcaaggttcagcggcagtggatcgtgggacagagttcactctcacattagcagcctgcagcctgatgtattttgacctaacttattacgtacgacctaaactacgtaactaacttactttaggtacggtacgttcggaccgaaacgggacctaaaggtaggaaatacgaaacgtaactaggtggactcgctaccattcgtattcctctacttccgtcccgtacc

SEQ ID NO: 10066 - DNA, 538 bp, Homo sapiens
  misc_feature: GYAE6OF02HJQ75.53.73.G07.1.454.CMB.1.raw
  modified_base (344)..(344): a, c, t, g, unknown or other
  misc_feature (344)..(344): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttgagtggagtggtctaatcaacctagtggtggatctacaagttacncacagagaatgcgaggccgaataccatgaccgagacgaacacgtaccgaacgagtaacagtactacagtggaggtgagcaggcctagacgatcgtaggaaggacgaccggacctagtcgttacttacgtgtgtcgtattacgttagtaggtactttacggacttacgtaattagtttacgtacgtagtacccgg

SEQ ID NO: 10067 - DNA, 594 bp, Homo sapiens
  misc_feature: GYAE6OF02H11WX.53.73.G07.1.454.CMB.1.raw
  modified_base (94)..(94): a, c, t, g, unknown or other
  misc_feature (94)..(94): n is a, c, g, or t
  modified_base (188)..(188): a, c, t, g, unknown or other
  misc_feature (188)..(188): n is a, c, g, or t
  modified_base (232)..(232): a, c, t, g, unknown or other
  misc_feature (232)..(232): n is a, c, g, or t
  modified_base (278)..(278): a, c, t, g, unknown or other
  misc_feature (278)..(278): n is a, c, g, or t
  modified_base (558)..(558): a, c, t, g, unknown or other
  misc_feature (558)..(558): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
  modified_base (591)..(591): a, c, t, g, unknown or other
  misc_feature (591)..(591): n is a, c, g, or t
tcagcgcgtatacacacgaccggtgctcgatttagctctacgctcagggggagtcagacccagtcaggacacagcatggacatgagggtcccgntcagctcctggggctcctgctgctctggctcccaggtgccaaatgtgacatccagatgacccagtctccttcacctgtctgcatcgtgtcgganacgagacgtcacgtctacgtcggacccggcacgtaccaaagttnttaacggccttgggttgctaggtactcagtcagaaaccgaggaacncccgtagacctctagatcgtaagtacgcgtactactttagacgtaggtcgggtccagttcgaaaggttcaggcgctaggtcggtactcggtagactaggtacgtctaccgtctacgtacctaggttacgccgtagtccgtacgtactacgtaccgtcgtacgttcgtacttacggtacctaacgtttacgttaacgttacgtaccgtaacgtacgtaactaacgttacgttacggtacgttaccggttacggtaccggttaaaacgctaaggacgaatanaacactgagctgcaactntgtctntcatcctcntac

SEQ ID NO: 10068 - DNA, 544 bp, Homo sapiens
  misc_feature: GYAE6OF02GDMWD.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacacggcccctggacgagggcttggagtggatgggtactaatccaacccgtaggtggtggtatctaacaagtttacctcaacagaagaatgacgagggaccaattaccatcgaccagagacacgtccaacgagtacagtctacagttggagtgagcagcctagagagtcgtgacggacgacgccagtacgttacgttacgtgtcgcgtattcgttaggtggtaacttaccgtacttacgtaagtttattttcgtactacgtacccgg

SEQ ID NO: 10069 - DNA, 782 bp, Homo sapiens
  misc_feature: GYAE6OF02IP2DS.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccagatcgacccagtcctccttccaccctgtctgcatctgtcggagacagacgtccaccgtcacgttcggcccgggaccagacctaaaagttacttaacggaccgttgggttcggcccgttaggtactacgaacggaacgaaacggaaaacccggaaggggtaaacccgtaccccgtaacgtaccttccgtagtactacgttaataacggtaccgttacttaacgttaagaccgtaggttcgggtacctagtacgtaacggttcgacggcggacgtaggtaggtacgtcggtagggactaggtacgttactaccgttactacctaaccgtagttaacgcgtacgtccgtacggacctacggtcctagtacgttagtttactttacgaactttaaactttacgttaccgtaccgtaaacccttaaacgtacgttaaacgttaacgtttacggttttagggtaccgggttaccggttaccggaaaccgggttaaacgggtaaccgttaaaggggtaaacgtaaaaccgtaaccgtaaacggtcggttacgggtcggtaccgttacgtaacccgtaacgttacgttaccgttacgtttaccctttaccgtaccgtttccccgttacccaccgttaacg

SEQ ID NO: 10070 - DNA, 506 bp, Homo sapiens
  misc_feature: GYAE6OF02FPNYU.53.73.G07.1.454.CMB.1.raw
  modified_base (340)..(340): a, c, t, g, unknown or other
  misc_feature (340)..(340): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactccttatacattgggtacacacggcccctggacgaggggcttgagtggagtgggtctaatcaacctaggtggtggatctanaagttactcacagagaatgcagggcctaattaccatcgaccagagacacgtccaacgagtaacagtactacagtggaggtgagcaagcctgagatgtgaggacacggccagtgttattatgtgcgtattcgttagtgtattacgacttataattatttgacagccg

SEQ ID NO: 10071 - DNA, 526 bp, Homo sapiens
  misc_feature: GYAE6OF02I4JXJ.53.73.G07.1.454.CMB.1.raw
  modified_base (344)..(344): a, c, t, g, unknown or other
  misc_feature (344)..(344): n is a, c, g, or t
  modified_base (405)..(405): a, c, t, g, unknown or other
  misc_feature (405)..(405): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactccttatacattgggtacgacaggcccctggacaggggcttgagtggatgggtctaatcaacctagtggtggatctacaagttacncacagagaatgcgagggccgaattaccatcgacagagacacgtccacgagtacagtcctanagtggaggtagagcagccgtagacgtatcgtgaacggacaccggccaagtgtattacgtgtcgacgtattcgttaggtacggtattacgacttaactaattacgttttgactagtacccgg

SEQ ID NO: 10072 - DNA, 587 bp, Homo sapiens
  misc_feature: GYAE6OF02IMY1N.53.73.G07.1.454.CMB.1.raw
  modified_base (290)..(290): a, c, t, g, unknown or other
  misc_feature (290)..(290): n is a, c, g, or t
tcagcgcgtatacacacgaccggtgctcgatttagctctacgctcagggggagtcagacccagtcaggacacagcatggacatgagggtcccgctcagctccgtggggctcctgctgctctggctcccaggtgccaaatgtgacatccagatgacccagtctccttccaccctgtctgcatctgacggagacagagtcacgtcacgttcgccggcagacaaagtattaacgcgtggtgcctggtatcagacagaaaccgaggaaacgccctagacctctagactactaanaagacgtactacttagactaggtcgggtaccatacgaaggttcagcgcgtaagtgatcggtaggaacagtacgttacacgtctacaacctagttaacgctacgactgcacgtcctagacgttagtactttgaaccttaatttaacttacgtcgaccttaaacgagtaactaagtttacgttggtacgtaccgttcggaccgtaagggacctaaagggtcgtaaaacacgtaaaccgattcggtacggtctacgaccaacgtactcgttacgtctactacttcccttaccgacttacg

SEQ ID NO: 10073 - DNA, 528 bp, Homo sapiens
  misc_feature: GYAE6OF02IFV8G.53.73.G07.1.454.CMB.1.raw
  modified_base (259)..(259): a, c, t, g, unknown or other
  misc_feature (259)..(259): n is a, c, g, or t
  modified_base (512)..(512): a, c, t, g, unknown or other
  misc_feature (512)..(512): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccggccagccaaagtattaagacctggttgcctggtatcagcagaaaccngggaaacgcccctagactcctgatctataagacgttctactttagacagtggggtcccatcaaggttcagcggcagtgatcgtgggacagacgttcactctcaccattagctagcctgcacgcctgatgtatttgctaatttattactgacctaacagtacaattactttaggtggtacgttcggaccgtaagggaccaagggtacgaaatacgaaacgacgtaggtggctagaccacctatcgttgtccttnactccttcccgctacg

SEQ ID NO: 10074 - DNA, 512 bp, Homo sapiens
  misc_feature: GYAE6OF02IL4HE.53.73.G07.1.454.CMB.1.raw
  modified_base (434)..(434): a, c, t, g, unknown or other
  misc_feature (434)..(434): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacaggcccctggacaggggcttggagtggatgggtctaatcaaccctagtggtggatctacaagttactacacagagaatgcagggccaattaccatgaccagagacacgtaccacgagtacagtctacagtaggaggtgagcagcctagagatcgngaggacacggcatagtattactgtgcgtattacttaggtagtattaacgtactaactaattatttgtactagtacccg

SEQ ID NO: 10075 - DNA, 523 bp, Homo sapiens
  misc_feature: GYAE6OF02GOI1S.53.73.G07.1.454.CMB.1.raw
  modified_base (344)..(344): a, c, t, g, unknown or other
  misc_feature (344)..(344): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactcccttatacattgggtacgacacggcccctggacgaggggcttggaggtggatggggtctaatcaacctagtggtggatctanaagttactcacagagatgcagggcctaataccatcgacagacgacacgtaccacgagtacagtacacagtggaggtgagcagcctgagatcgtagacggaccgacgccagtacgtattacgtgtgcgtattcgttaggtgtattacgacttactaatttatttcgtacgtacgacccgg

SEQ ID NO: 10076 - DNA, 560 bp, Homo sapiens
  misc_feature: GYAE6OF02IAC8J.53.73.G07.1.454.CMB.1.raw
  modified_base (204)..(204): a, c, t, g, unknown or other
  misc_feature (204)..(204): n is a, c, g, or t
  modified_base (354)..(354): a, c, t, g, unknown or other
  misc_feature (354)..(354): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtnacttgccgggcagccaaagtattaagacctggttggcctggtatcagcaagaaaccagggaaacgcccctagacctctgatctaataagacgtactactttagactaggtcgggtacccatacgtaaggttcagcggcgagtggtatcgnggacagtacgtacactctcacctattagcagcctgcagcctgatgtatttcgattaacttattactagaccaaactagtaactaactttacgtttagtacgggtcgttacgggaccgaacgggtaaccgaagggtacggaaaataccgaaacgtactaggtcggactgaccaacctatctgtccttcgtactccttacccgctacg

SEQ ID NO: 10077 - DNA, 545 bp, Homo sapiens
  misc_feature: GYAE6OF02FX6FP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtgatcgtgggacaggagttcactctccaccattagcagcctgcagcctgatgtatttgctaactttattactgacctaatagtaactaattactttggtaggaccgtttcggaccaaggggtacccgaaggtaggtaaatacgaaacgtacgtagtcggcttcgacctaccagttcttacggttccttacgacttccttcccgcttaccg

SEQ ID NO: 10078 - DNA, 541 bp, Homo sapiens
  misc_feature: GYAE6OF02FQAYR.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttgcctggatcagcagaaaccagggaaagcccctagactcctgatctataagacgtctactttagacagtggggtcccatcaaggttcagcggcagtggatctgggacagagtcactctcacattagcagcctgcagcctgatgatttgctaactttattactgccaacagtactaattactttggtaggtacgttcggaccaagggaccgaaaggtggaaatacgaaacgtacgtagtacggtcgtcgacgaacccgtattccgttgttcctttaccgtactttccttccccggtacctaacg

SEQ ID NO: 10079 - DNA, 649 bp, Homo sapiens
  misc_feature: GYAE6OF02GRYO1.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagccgtggggcctcagtgatgtatttcctgcacgacatcgtggatacaccttcaccgacctcccttatacagttgggtacacgacggcccccgtggacgaggggtcttggagtggattggggtctaatcctaaacccgttaggtggtaggattactaacgtaagtttacctacaacgagaagtaagtgacgacggggtaccgtaaacttaccgaagttcgaaccgaaggacgaaccgtaaccgtaccaaccggagtaaccagtacctaacgtagtagggtaggtgacgacgacgtaccgtagacgtagtcgtaggaacggtaccgacggacctaagttacgttaatttaccgtgtacggtacggttagtttacgtttaacgggtcgttaagtttaacccgtaacttaacgttaagttttaaccgttttgttaccgacgtaaccccggg

SEQ ID NO: 10080 - DNA, 531 bp, Homo sapiens
  misc_feature: GYAE6OF02GSQ9N.53.73.G07.1.454.CMB.1.raw
  modified_base (268)..(268): a, c, t, g, unknown or other
  misc_feature (268)..(268): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaacncccctagactctgatctataagacgtctactttagacagtgggtccatcaaggttcagcgcagtggatctgggacagagttcactctacaccattagcagcctgcagcctgatgtatttgactaacttattactcgaccaactagtaactaacgttactttcgaggtacgttcggaccgaagggtaccgaaagggtagaaactcgaaacgtacgtggtacggctagaccactacgtctacgtcttacactccgttcccgctac

SEQ ID NO: 10081 - DNA, 464 bp, Homo sapiens
  misc_feature: GYAE6OF02FUO0J.53.73.G07.1.454.CMB.1.raw
  modified_base (146)..(146): a, c, t, g, unknown or other
  misc_feature (146)..(146): n is a, c, g, or t
  modified_base (199)..(199): a, c, t, g, unknown or other
  misc_feature (199)..(199): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
  modified_base (251)..(251): a, c, t, g, unknown or other
  misc_feature (251)..(251): n is a, c, g, or t
  modified_base (253)..(253): a, c, t, g, unknown or other
  misc_feature (253)..(253): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (308)..(308): a, c, t, g, unknown or other
  misc_feature (308)..(308): n is a, c, g, or t
  modified_base (325)..(325): a, c, t, g, unknown or other
  misc_feature (325)..(325): n is a, c, g, or t
  modified_base (373)..(373): a, c, t, g, unknown or other
  misc_feature (373)..(373): n is a, c, g, or t
  modified_base (382)..(382): a, c, t, g, unknown or other
  misc_feature (382)..(382): n is a, c, g, or t
tcagcgcgtatacacacgaccggtgctcgatttagctctacgctcagggcacgaccggtgctcgatttagctctacgctcagggcgacgaccggtgcgtcgatttagctctacgctcgagggcacgaccggtgctcgatttagctnacgctcagggcacgccggtgctcgatttgcttcacgctcagggcacgtcggtnactccgattcgctctacgcncgagggcacgcggttncgtcgtatcgcactcncngacgcgcgcgtcgtcgtcgtatcgctcgtcgcgcgcgcgcgcgcgcgcgtncncncgctcgtcgtcgcgcgngtcgcgcgtactcgtcgtcgcgtgcgcgcgtgacgtcgtcgtctagtntcgtactcncgtcgcgcgtcgacgtacgtctcgtacgtcgcgacgcgtacgtacgcgtcgtcgtcgacgtacgcgcgtacgtcgtcgtacg

SEQ ID NO: 10082 - DNA, 625 bp, Homo sapiens
  misc_feature: GYAE6OF02GQ8AI.53.73.G07.1.454.CMB.1.raw
tcagcgcgtatacacacgaccggtgctcgatttagctctacgctcagggggagtacagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttgccgggccagccaaagtattaagacctggttggcctggtatcagcagaaaccagggaaagcccctagactcctgatctataagacgtctactttagacagtcggggtccatcaaggttcagcggcagtgatcgtggacagagttcactctcacctattacgcacgcctagcagcctgatgtatttgactaacgttattacgtgaccaaacagttaaccaagtttacgtttagtacgggttaccggtttaccggaaccgtaaaggggtaacccgtaaacggggtaacggtaaaaacgttaccgtaaaaaccggtacgttacggttacgggtaaccgttcggaacccgtaacccgttaacgttaccgttccgttacgtttaccgtaacgtttccccgtttaccccgacccttaaccg

SEQ ID NO: 10083 - DNA, 519 bp, Homo sapiens
  misc_feature: GYAE6OF02HN8CL.53.73.G07.1.454.CMB.1.raw
  modified_base (407)..(407): a, c, t, g, unknown or other
  misc_feature (407)..(407): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagcctggggcctcagtgatgatttcctgcacgacatctggatacaccttcaccgactcccttatacattgggtacacaggcccctggacaggggcttgagtggatgggtctaatcaaccctagtggtggatactacaagttactcacagagaatgacagggccgaattaccatgaccagagacacgtccacgagtacagtactanagtggaggtgagacgagcctagagatcgtggaggacacggccatgttattacgtgtgacgtatcgtttaggtgtattacgacttacgtaattagttttagtactagtacccg

SEQ ID NO: 10084 - DNA, 568 bp, Homo sapiens
  misc_feature: GYAE6OF02F6RUC.53.73.G07.1.454.CMB.1.raw
  modified_base (347)..(347): a, c, t, g, unknown or other
  misc_feature (347)..(347): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgatttcctgcacgacatctggatacaccttcaccgactcccttatacattcgggtacgacacggccccctggacgaggggcttggaggtggatgggtactaatcaacctgtggtggactcgtanaagttactcaacgagagaatgacgaggggaccgtaattaccgatacgacgagagacacgtacccaagagtacagtcctagagtgggaggtagagcagccgtagagtatcgtaggaacggacgacggcctattcgtaattacgtgtcgacgtattcgtttaggtaggtaacgtttaaccgtaacgttaactaaacgtttagttttacgtactacgtacccgg

SEQ ID NO: 10085 - DNA, 524 bp, Homo sapiens
  misc_feature: GYAE6OF02GQ41A.53.73.G07.1.454.CMB.1.raw
  modified_base (340)..(340): a, c, t, g, unknown or other
  misc_feature (340)..(340): n is a, c, g, or t
  modified_base (351)..(351): a, c, t, g, unknown or other
  misc_feature (351)..(351): n is a, c, g, or t
  modified_base (471)..(471): a, c, t, g, unknown or other
  misc_feature (471)..(471): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatacattggtacgacacggcccctggacaggggcttggagtggatgggtctaatcaaccctagtggtggatctanaagttactcanagagaatgacgacgggccgtaaattacccaatcgaaccagaagacacgtaccacgagtacagtctacagtgggagtgagcagcctgagatcgtgacgacgacgcatgtatactgtgcgtnttacttaggtggtattacgaacttaacttaattagttttagtccacgtaccgg

SEQ ID NO: 10086 - DNA, 142 bp, Homo sapiens
  misc_feature: GYAE6OF02IXZGH.53.73.G07.1.454.CMB.1.raw
  modified_base (138)..(142): a, c, t, g, unknown or other
  misc_feature (138)..(142): n is a, c, g, or t
tcagcgcgtatacacacgaccggtgctcgatttagctctacgctcagggcacgaccggtgctcgatttagctctacgctcagggcacgaccggtgctcgatttagcagacgtctgagcgggctggcaaggcgcatagnnnnn

SEQ ID NO: 10087 - DNA, 646 bp, Homo sapiens
  misc_feature: GYAE6OF02F0ZZG.53.73.G07.1.454.CMB.1.raw
tcagcgcgtatacacacgaccggtgctcgatttagctctacgctcaggggggggggtcagacccacgtcaggacgaccagcatggacgatgagggtccccggcctcagctcctggggcgtcctcgctgctctggctccccaggtgccaaatgtgacatccagatgacccagtctccttcccaccctgtctgcatctgtcggagacagagtcaccgtcacttcggcccgggccagaccaaagtattaagccgtgggttggcctggtatcagcagaaaccgaggaacgacccctagactcctgatctatagacgtctacttagacgaggtcggggtcccatacgaaggttcgagcggcaggtggagtcgtgggacagtacgttcactctccacctagttagacacgcctgcgacgtccgtgtatcgttattttcgactaactttaacttacgttacgaccctaacgtaagttaacctaaatttaccgttttagggtcgggtaaccggtttcccgggaccggaaacggggtaccgtaaagggttaggtaaaactaaccgaaaccgtaggttcggtacgggcgtacgtaccgtaacctacgttcgttcggttaccttactaccttacccttaccccgtacctaagttccg

SEQ ID NO: 10088 - DNA, 530 bp, Homo sapiens
  misc_feature: GYAE6OF02HTX81.53.73.G07.1.454.CMB.1.raw
  modified_base (350)..(350): a, c, t, g, unknown or other
  misc_feature (350)..(350): n is a, c, g, or t
  modified_base (357)..(357): a, c, t, g, unknown or other
  misc_feature (357)..(357): n is a, c, g, or t
  modified_base (406)..(406): a, c, t, g, unknown or other
  misc_feature (406)..(406): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcgagtgatgtactttcctgcacgacatctggatacaccttcaccgactcccttatacattgggtacacacggcccctggacgaggggcttggagtggatgggtctaatcaacctagtggtgatctactaagttcncacaganaatgcgaggcaataccatgacagacacgacgtcacgagtacagtctaangtggaggtgagtcagctgagatcgtagacgacgacgaccagtagttattacgtgtgtacgtattacgttaggtagtacgttaacgacttaactaagtttacgttttcgtacgtcggtaacccgg

SEQ ID NO: 10089 - DNA, 621 bp, Homo sapiens
  misc_feature: GYAE6OF02IGOT9.53.73.G07.1.454.CMB.1.raw
  modified_base (195)..(195): a, c, t, g, unknown or other
  misc_feature (195)..(195): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagngtcacgtcacttgccggcagccaaagtataagctggtgcctggtatcagacaagaaaccagggaaacgcccctaagactcctagactctataagacgtactaacttagactaggtcgggtccatcgaagttcagcggcaggtgatcgtagggacagtagtcactctctactattacgcacgtcctcgcacgctgattgtatttcgactaatttacttactcgacctaacgtacgtaactaacgtttacgtttagggtacggttacggtttacccgggaaccgtaaacggggtaacccgtaaaagggtggaaaacttaaccgaaaaccggtacgttacggtcggtacgttaccggacctaacccggtacttaccggttacgttacccttttaccgaccgtttccccgttacccccgtacttaacccg

SEQ ID NO: 10090 - DNA, 542 bp, Homo sapiens
  misc_feature: GYAE6OF02HLQA9.53.73.G07.1.454.CMB.1.raw
  modified_base (344)..(344): a, c, t, g, unknown or other
  misc_feature (344)..(344): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtataagacctggttggcctggtatcagcagaaaccagggaaacgcccctagactcctgatctaataagacgtctactttagacaggtgggtccagtcaaggttcagcggcagtggatcgngggacagagttcactctcaccattagcagcctgcagctgatgtatttgctaacttattactcgaccaaacagtacaacttatttgtcggtacgttcggaccgaagggaaccaaagggtacggaaataccgaaacgtacgttaggtcggactcgacaccgtacttcttgtccttacgacttcccgtttcccgacttacg

SEQ ID NO: 10091 - DNA, 559 bp, Homo sapiens
  misc_feature: GYAE6OF02F3SBW.53.73.G07.1.454.CMB.1.raw
  modified_base (413)..(413): a, c, t, g, unknown or other
  misc_feature (413)..(413): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtcggggtcccatcaaggttcagcggcagtgatctgggacagagttcactctcaccattacgcagcctgcagcctgatgatttcgctaacttacttactgaccaanacgtaactaattaacttggtaggtacgttcggaccgtaaagggaccgaaagggtaggaaaacgttacaaaacggtactaggtcggctacggacctaaccgtacgtcttacggtctttaccgactttccgttaccccgaccttaccg

SEQ ID NO: 10092 - DNA, 575 bp, Homo sapiens
  misc_feature: GYAE6OF02I7UT2.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggataccaccttccaccgactcccttataccattcgggtacacacggcccctggacaggggcttggagtggatgggtactaatccaaccgtagtggtagatactacaagttactcacagagaatgcgacgggaccgaattaccatcgaaccagaacgacacgtccgacgacgtacacgttctacgtagtgggaggttagagacgacggaccgtgagtactcgtaggaggaaccgaccggaccgtattaggtaattaccgtggtagtacggatttccgttaggtacggtactttaaccggtacttacgtaatttagttttcgtaccgagtacccgg

SEQ ID NO: 10093 - DNA, 599 bp, Homo sapiens
  misc_feature: GYAE6OF02IBSUE.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtgggctcagtgatgtatttcctgcacgacatctggataccaccttcacctactcccttatacagttgggtacgacaggcccctggacgaggggtctgaggtggagtgggtactaagtccaacctgtggtgatactaacagttactcaacagagaatcgacgacgggacctaacgttacagtacgaccgaagacgaaccaccgtaccaacgatacacgtactaacgagttagggagggtgaagcgaagccgttagaagtacttcgtaggaacggtaccgaccggtccaagttacgttaacgttacgtgtacggtccgtagtttaccgtaggttaggtaacttaacggtaacttaacgtaaattttacgttttacggtaccgtacgtacccggg

SEQ ID NO: 10094 - DNA, 523 bp, Homo sapiens
  misc_feature: GYAE6OF02FZ79A.53.73.G07.1.454.CMB.1.raw
tcagcgcgtatacacacgaccggtgctcgatttagctctacgctcagggggagtcagacccagtcaggacacagcatggacatgagggtccccgctcagctccgtggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatcgtgggacagagttcactctcaccattagcagcctgcagcctgtatgtattttgactaactttattactgaccaacagtaactaattacgtttgtaggtacgtttcggaccaagggacctaaaggtaggaaactacaaacgtactagtggctgcacctatctgtcttcatcttcccgctacg

SEQ ID NO: 10095 - DNA, 682 bp, Homo sapiens
  misc_feature: GYAE6OF02JLIJL.53.73.G07.1.454.CMB.1.raw
tcagcgcgtatacacacgaccggtgctcgatttagctctacgctcaggggatcatccaacaaccacatccttctctacagaagcctctgagaggaaagttcttcaccatggactggacctggagggtcttctgcttgctgtcagtagctccaggtgctcgctccaggtgcagctggtacaagtcgggggctgagatgaagaagcgtggggcctcagtgatgatttcctgcacgacatctggactacaccttcaccgtacttccttatacagtttcgggtacgacgacggtccccgtggaccgagggggtcttggagtgggagttcggggtacttaacgtacctaacccgtaggtcgggtaggtaacttacgtaacgtaaaggtttacactaacgtaaggaacgtaagtacggaccgacggggtaaccgtaaagttacccgaagtacgaaccgacggaacgaaccgaaccggtacccgaacggtaacggtaaccgtaacgttacctaacgtaacggttagggtaacgggtaggagacgtaacggtccgtagaacggtatcggtaggaacggaccgtaccgggacctaagtagttacgttacgttgttacgacgttaagttacgttaggttaggtaacgttaagtaacgttacgtaatttacgttttacgtcgtaacgtaccgg

SEQ ID NO: 10096 - DNA, 606 bp, Homo sapiens
  misc_feature: GYAE6OF02HZJJL.53.73.G07.1.454.CMB.1.raw
  modified_base (372)..(372): a, c, t, g, unknown or other
  misc_feature (372)..(372): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagcctggggcctcgagtgatgtatttcctgcacgacatcgtggactacaccttcaccgtacctcccttatactagttcgggtacgaccacggccccctaggacgtaggggtcttggagtcggtagtgggtactaatctaaccgtaggtggtgatactaacgtaagttacncgtaacagacgtaatcggactacgggacctaacttacagtacgacgagacgacacgtccaagtacgactaagtctacagtgggagtagacgcagccgtagagtatacgtagacggacacggacctagtacgttaagttacgtgtcggtacgtaagttaccggtttaggtaacgttaacgttaaccgtaacgttaaccttaaagttttacgtttttgaccgtaccggtaacccgg

SEQ ID NO: 10097 - DNA, 688 bp, Homo sapiens
  misc_feature: GYAE6OF02JEJQM.53.73.G07.1.454.CMB.1.raw
  modified_base (247)..(247): a, c, t, g, unknown or other
  misc_feature (247)..(247): n is a, c, g, or t
  modified_base (390)..(390): a, c, t, g, unknown or other
  misc_feature (390)..(390): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgctccaggtgcagctggtacagtcggggctgagatgaagagccgtgggcctcgagtgatgtattctgcacgacatcgtggactacnccttccaccgtaccttcccttatactagttgggtacgacgacggtccccgtaggacgtaggggtcttggacgttgggattcggggttactaactaccgaacccgttaggtgggttaggtacttccgtaacgttaacgtttacnctaacgaagaacgtagtcggacgaacgggtacctaaacgttaccgagtacgaacgaagaacgaacgtaccgtaccgaacgtacgtaactaggttacctaacgaggttaggtacgggtcgaacgactaacggccgttaagaacgtacgttcgaacgggtaacggaaccggtacgggtaacctagtttaacgggtatttacggttaggtacggtacgttaacgttacgttacgggttacgtaaccgtttacgttaacgttaacttaagttttacgtttacggtaccgtacggtaacccgg

SEQ ID NO: 10098 - DNA, 576 bp, Homo sapiens
  misc_feature: GYAE6OF02IIT2I.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaagaagccgtggggccctcagtgatgtactttcctgcacgacatctggatacaccttcacccgtacctaccttatactagttgggtacgacacggtcccctagggacgagggggtccttggaggtggagtgggtacctaacgtacaacccgtaggtggtaggactactaacgaagttaccactaacgaagaacgtaagtagacgaaggggacctaaacttaaccagtacgaaccagacgacacgaccacgagtacagtactaacgagtaggaggtgagacgagccgagagatcgtagacggacgacgacattagtattacgtgtacgcggtattcgtagtagataacgactaactattagtttacgtacagtaccg

SEQ ID NO: 10099 - DNA, 614 bp, Homo sapiens
  misc_feature: GYAE6OF02HMHEC.53.73.G07.1.454.CMB.1.raw
  modified_base (280)..(280): a, c, t, g, unknown or other
  misc_feature (280)..(280): n is a, c, g, or t
  modified_base (294)..(294): a, c, t, g, unknown or other
  misc_feature (294)..(294): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctcccttccaccctgtctgcatctgtcggagacagagtccaccgtcacgttgcccgggccagaccaaaagtattaacgaccgttggtcgcctggtatcagcaagaaaccgagggaaacncccctagactccgngatctataagacgtctactttagactaggtcgggtaccatacgaaggttcaggcggcaggtgagtcgtggacagtagtcactctcacattagcagcctgcagtcctgattgtatttagactaacttattacctagacctaatagtaactaacgtttacttggtacggtaccggttacggacccggtaaagggtaacccgtaaagggtaacggtaaaacgtaaccgaaaacggtacgttaggtacggtacgtaccggacctaaccgtacgttaccgttcgttaccttaccgtacctttcccgttacccggtaccttaccgg

SEQ ID NO: 10100 - DNA, 507 bp, Homo sapiens
  misc_feature: GYAE6OF02I0GU9.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttataccattgggtacacaggcccctggacagggggcttggagtggatgggtctaatcaaccctagtggtggatctacaagttactcacagagaatgcagggccaaattaccatgaccagagacacgtccacgagtacagtctacatggaggtgagcagctgagatctgaggacacgcatgtattactgtgcgtatcgttaagtggtacttacgacttacgtaattagttttagtcacgtacccg

SEQ ID NO: 10101 - DNA, 508 bp, Homo sapiens
  misc_feature: GYAE6OF02FHUJK.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagacagtggggtcccatcaaggttcagcggcagtggatctgggacagagttcactctcaccattagcagcctgcagcctgatgattttgactaactttattactgaccaacagtactaattactttgtggtacgttcggccgaagggaccaaggtaggaaatacaaacgatgtggctgcaccatctgtcttctatcttcccgctac

SEQ ID NO: 10102 - DNA, 567 bp, Homo sapiens
  misc_feature: GYAE6OF02HMHWH.53.73.G07.1.454.CMB.1.raw
  modified_base (416)..(416): a, c, t, g, unknown or other
  misc_feature (416)..(416): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggaggcagagtcaccgtcacttgccgggccagccaaagtataagacctggttggcctggtatcagcagaaaccagggaaacgcccctagacctcctgatctataagacgtctaactttagacaggtggggtcccatcaaggttcagcggcagtggatctgggacaggagttcactctcaccattagcagcctgcagcctgatgatttgactaacttattactgacccaanacgtacaattactttggtaggtaccggttacggccgtaacgggaccgtaagggtacgtaaaagtacaaacggtactagggtacggtactacggacctaacctagtaccgttcgttaccgttcctaacgtttccccttcccgtacccttacg

SEQ ID NO: 10103 - DNA, 549 bp, Homo sapiens
  misc_feature: GYAE6OF02H5HMM.53.73.G07.1.454.CMB.1.raw
  modified_base (231)..(231): a, c, t, g, unknown or other
  misc_feature (231)..(231): n is a, c, g, or t
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttccngcacgacatctggatacaccttcaccgtactcccttatacattgggtacgacaggcccctggacgagggggcttggagtggatgggtctaatcaacctagtggtgatctacaagttactcacagagaatgcgagggccgaataccatcgacagagacacgtccacgatacagtctacgatggaggtgagcacgtcctgagtagtcgtaggaaggcacggacctagtacgttattacgtggtgtacggtaattcgtttaaggtaggtaacttaaccgtacgttaactaacgtttattttacgtaccgtacgtaccccgg

SEQ ID NO: 10104 - DNA, 634 bp, Homo sapiens
  misc_feature: GYAE6OF02IQECI.53.73.G07.1.454.CMB.1.raw
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
  modified_base (483)..(483): a, c, t, g, unknown or other
  misc_feature (483)..(483): n is a, c, g, or t
  modified_base (510)..(510): a, c, t, g, unknown or other
  misc_feature (510)..(510): n is a, c, g, or t
  modified_base (518)..(518): a, c, t, g, unknown or other
  misc_feature (518)..(518): n is a, c, g, or t
tcagcgcgtatacacacgaccggtgctcgatttagctctacgctcaggggatcatccaacaaccacatccctttctacagaagcctctgagaggaaagttcttcaccatggactggacctggaggtcttctgcttgctgtcagtagctccaggtgctcgctcccaggtgcagctggtacaagtcggggctgagatgaagagccgtgggcctnagtgatgattccngacacgacatctaggactacaccttcaccgacttccctatactagttacgggtacacgacggccccgtggacgaggggtcttagacggtgagtcgggtactaactccgaaaccgttggtaggtaggtactacgtaacgtaacgttacctacgtaagacgtaagtaacgtgaccggaagggtaccctaaacgttacccgaagtcgaaccaagggtacaaaccgtacggtaccaaccgtagtaaccgagttacctaacgngtaggacgtagacgcgtagcctggaancgttacgnggaacgacgcgacgttacgtagtagttaacctggtacgtacgtattacgttaggtacgaactttaaccggaacttaacgttaaacgttgtttaccggacgaaccgtccgtaaaggg

SEQ ID NO: 10105 - DNA, 509 bp, Homo sapiens
  misc_feature: GYAE6OF02GIXUY.53.73.G07.1.454.CMB.1.raw
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (455)..(455): a, c, t, g, unknown or other
  misc_feature (455)..(455): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaacctagtgtggatctacagttactcacagagaatgcagggaccaattaccatgaccagagacacgtccacgagtacagtctacatggaggtgagcagcctgagatcgngaggacacggccagtntagttctgtcgngtatcgttaggtggtacttaacgacttaactaattattttgtacgtacgacccg

SEQ ID NO: 10106 - DNA, 656 bp, Homo sapiens
  misc_feature: GYAE6OF02GFK3I.53.73.G07.1.454.CMB.1.raw
tcagcgcgtatacacacgaccggtgctcgatttagctctacgctcagggatcatccaacaaccaactatcccgttctcgtacagaagcctctggagaggaaagttcttcaaccatggactggaccgtggaggtcttctgcttgctgtcagtagctccgaggtgctcgctcccgaggtgcagtctggtacaagtcggggctgagtagtgaagaacgccgtggggccctcacgtgatcgtactttcctggccacgactactccgtggactaccaccttcaccgtactcccttatacctagttcgggtaacgacacggcccccgtgggaccgaggggtcttggaggttggacgttcgggtacctaaacttcccgtaacccgttaggtcggttggacttaccgtaaacgtaaacggtttacctaccgaacgtaggaacgtaaacgtggaccgagggacccgtaaattacccgagtacgaaccaagacgacacgtccaacgagtacagtctaacagtacggaggtgacgacgacgtacctgaagagtcgtaggaacggtaccgaccggacctagttagttaacttacgtgtcgagtaatttcgttaggtaggttaacttacgtaacttacgttaaatttgttttacgtactacgtacccgg

SEQ ID NO: 10107 - DNA, 651 bp, Homo sapiens
  misc_feature: GYAE6OF02IOT5E.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttggccgggccagaccaaagtattaacgccgtggttcggcctggtatcagacaagaaaccgaagggaaacgcccctagactcctgatctaataagtacgttacttacttagactaggtcggggtacccatcgtaaggttcaggcggcaggtcgatcgtgggacaggtacgtcacctctacacctattacgcgacgccctgaccgacgtcctaggtattggtacttttacgaaccttaacttttaacttaacgttcgaaccctaaactacgtaactaagtttacgtttacggtacgggtaaccgttaccgggaccgtaaacgggtaaccgtaaagggtaacggtaaaactaacgtaaaacgggacttaggtacgggtacgtacgaccgtaacctacgttccgttacgtttccttaccgtactttccccgtttaccccgaccttacg

SEQ ID NO: 10108 - DNA, 635 bp, Homo sapiens
  misc_feature: GYAE6OF02GUA04.53.73.G07.1.454.CMB.1.raw
  modified_base (434)..(434): a, c, t, g, unknown or other
  misc_feature (434)..(434): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagaccaaagtattaagacctggttggcctggtatcagcaagaaaccagggaaacgcccctagacctcgtagtactactaagtaacgtaccgttacttaacgttaacgacgtacgggtccgggtaccatacggtaagttcgacggcggacgtaggtaggtactacggtacggaacgtaggtacttactaccttaccactaactagttacgacaccgtcncgacacgtcgtagtagttagtttattacgacttaactttacttacgccgaactaacgtaataactaactttcgttacgggtacggttaccggttaccggaacggtaaccgggtaacgtaaagggtaacaaacgtaaccgaaacgtagttacgggtcgacgtacgaccacttatcgtacttctagtccttcccgtctactcg

SEQ ID NO: 10109 - DNA, 547 bp, Homo sapiens
  misc_feature: GYAE6OF02IRX8N.53.73.G07.1.454.CMB.1.raw
  modified_base (353)..(353): a, c, t, g, unknown or other
  misc_feature (353)..(353): n is a, c, g, or t
  modified_base (356)..(356): a, c, t, g, unknown or other
  misc_feature (356)..(356): n is a, c, g, or t
  modified_base (428)..(428): a, c, t, g, unknown or other
  misc_feature (428)..(428): n is a, c, g, or t
  modified_base (470)..(470): a, c, t, g, unknown or other
  misc_feature (470)..(470): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgacctccttatacattgggtacgacgacggcccctggacgaggggcttaggagtggatgggtactaatcaaccgtagtggtgatctaacaagttacncanagagaatgacgagggaccgtaaattaccgaatacgaccagaacgacgaccgtcacgagtacacgtactacgngtaggaggtgagcagcctgagatcgtgagacgacgccaagtntattactgtagcgtacttacgttaggtagtacgttaacggaacttaacgtaattagttttcgttacacggtacccgg

SEQ ID NO: 10110 - DNA, 560 bp, Homo sapiens
  misc_feature: GYAE6OF02GO9V0.53.73.G07.1.454.CMB.1.raw
tcagcgcgtatacacacgaccggtgctcgatttagctctacgctcagggggagtcagacccagtcaggacacagcatggacatgagggtccccgctcagctcctgggctcctgctgctctggctcccaggtgccaaatgtgacatccagatgacccagtctccttccacctgtctgcatctgtcggagacagagtcaccgtcacttgccggccagccaaagtattaagacctgggttgcctggtatcagcagaaaccgaggaacgcccctagactctgatactataacgacgtctacttagacagtcggggtccagtcaaggttcgagcggcagtgatcgtgggacagagttcactctacacctagttacgcagtcctgcacgcctgatgtatttcgactaacttacttactcacctaactagtacaattactttggtacgtacggttcggaccgtaacgggtaccgtaaggtaggaaacttaccgaaaacgtacgttggacggtcgacgtacgaccgtaattctcggttcttaccgtacttcccgttcccgccttaacg

SEQ ID NO: 10111 - DNA, 526 bp, Homo sapiens
  misc_feature: GYAE6OF02IU7HW.53.73.G07.1.454.CMB.1.raw
  modified_base (347)..(347): a, c, t, g, unknown or other
  misc_feature (347)..(347): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacacacggcccctggacaggggcttggagtggatgggtctaatcaaccctagtggtgatctacaagtttacncacagagaatgcaggggccaaattacccatcgaccagacgacacgtccacgagtacagtcctacagtggaggtgagcagcctgagatcgtgacggacgaaccggcctagtagtattacgtgtgacgtattacgttaggtggtattacgacttaactaatttattttcgtcacgtacccg

SEQ ID NO: 10112 - DNA, 517 bp, Homo sapiens
  misc_feature: GYAE6OF02FSU1N.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacacggcccctggacagggggcttgagtggatgggtctaatcaaccctagtgtggatctacaagttactcacagagaatgcagggccgtaataccatgaccagagacacgtccacgagtacagtctacatggaggtgagcagcctgagatcgtgaggacacgggccagtgttattacgtgttgcgtatacttaggtggtatttaacgaacttacgtaatttattttcgtacagtacccg

SEQ ID NO: 10113 - DNA, 626 bp, Homo sapiens
  misc_feature: GYAE6OF02JT6L3.53.73.G07.1.454.CMB.1.raw
  modified_base (388)..(388): a, c, t, g, unknown or other
  misc_feature (388)..(388): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatcgtgtcggagacagacgtcaccgtcacgttgccgggccagccaaagtacttaagaccgtggttggcctggtatcagcaagaaaccgagggaaacgcccctagacctcctagactctaataagtacgtacttacgttagactaggtcgggtcccatacgtaaggttcaggcggacaggtggactcgtgggacgagtacgttcacgtcncaccattagctagccgtagccaagcccgtagacttagttacgtttacgacttaaactttacgttactttacggaccctaaactagtaactaattaacgttttcgtacggtaaccggtttccggaaccgtaacgggtaaaccgtaagggtaacggaaattaccgaaaccgttagtacggttacggacgttacgcgtaacctcttacgtacgttctacctactcccgttaccgccctacg

SEQ ID NO: 10114 - DNA, 662 bp, Homo sapiens
  misc_feature: GYAE6OF02H6LE0.53.73.G07.1.454.CMB.1.raw
  modified_base (190)..(190): a, c, t, g, unknown or other
  misc_feature (190)..(190): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttgccgggccagccaaagtattaagacctggttggcctggtatcagcagaaaccagggaaagcccctagactctgatctataagactctactttagacagtcggggtccagtcaaggttcagcggcaggtggatcgtgggacagtacgttcactctcacctattacgacagcctgcagcctgatgtatttcgacttaacgttacttacgtcgacctaaactagttaactaaagtttacgttttaggtacggttacccggtttaccgggaacccgtaaacgggggtaaccctaaagggggttaaacggtaaaaacgttaacccgtaaaaaccgtaaccggtttcggttaacggggtaccgttaccggtaacccgtaaccccgttaacgttcccgtttacggttacccgttttaccgtaacccgtttaccccgttttacccccggacccttaacccgg

SEQ ID NO: 10115 - DNA, 573 bp, Homo sapiens
  misc_feature: GYAE6OF02G3EXW.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaagaagccgtggggcctcagtgatgtatttcctgcacgacatctggatacaccttcaccgtactcccttatacagttgggtacacacggcccctggacgagggcttgagtggatgggtactaatccaacctagtggtgatctaacaagttactcaacagaagaatcgacgaacggggcctaaacttaccaatacgaaccaagacgaaccacgtaccaacggaagtacgacgtctaacagtggaggtgagcaggccgtaggaagatcgtaggacgacgaccggactagtagttattacgtggtacgacggtaattcgttaggaggttaactttacggaacttacgtaatttagtttacgtacgacgtaacccgg

SEQ ID NO: 10116 - DNA, 537 bp, Homo sapiens
  misc_feature: GYAE6OF02HD3RG.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacacggcccctggacgaggggtcttggagtggagtgggtctaatcaaccgtagtggtgatctacaagttactcacagagatgcagggccgaataccagtcgacagacgacacgtccacgagtacagtactacgagtgggaggtgacgcaggcctagagtactcgtaggacgacgaccggcctagtgttattcgtgtcgcgtattacgttaggtggtactttaacgacttaactaagtttattttcgactacgtacccgg

SEQ ID NO: 10117 - DNA, 649 bp, Homo sapiens
  misc_feature: GYAE6OF02I755D.53.73.G07.1.454.CMB.1.raw
  modified_base (284)..(284): a, c, t, g, unknown or other
  misc_feature (284)..(284): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtccaccgtcacgttcggccgggccaggacctaaaaggttattaacgaccgtggttcgccttggtatcagcaaggaaaccagggaaacncccctagacctcctgatctaatagacgttctaacgttagacgtaggtcgggtaccatcgaaggttcgagcggacagtggatcgaggacagtacgttcactacgccactagttacgctacgccgtgaccacggtccctaggtacgtgttacgttttacgaaccttaacttttaacttactaccggaaccctaacgtaacgttaactaactttaccgttttacgggtacggttaccggtttaccggaaccgtaaacgggtaccgaaagggttacgaaactacgaaaagtacgtcggtaggtccgtacgtacgaccgtacgttaccgttcggttacttaccgtactttccccgttacccgacttaccg

SEQ ID NO: 10118 - DNA, 559 bp, Homo sapiens
  misc_feature: GYAE6OF02HWUZR.53.73.G07.1.454.CMB.1.raw
  modified_base (394)..(394): a, c, t, g, unknown or other
  misc_feature (394)..(394): n is a, c, g, or t
  modified_base (554)..(554): a, c, t, g, unknown or other
  misc_feature (554)..(554): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcaagaaaccagggaaacgcccctagacctcctagatctaataacgacgtcttactttagacaggtcggggtcccatcaaggttcagcggcaggtggactcgtgggacaggtacgttcactctcactattagcacgcctgacncgcctgatgtattgactacttattactgaccaactataactaattacgtttggtacgggtaccgtttcgggaccaaggggtaaccgtaagggtaggaaactaccgaaacgtacgtaggtcggctacgaccgacctagtctcgttcttcgcttccctcccnctacg

SEQ ID NO: 10119 - DNA, 821 bp, Homo sapiens
  misc_feature: GYAE6OF02GVZ3J.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcggggctgagatgaagaacgccgtgggcctcagtgatgtatttcctgcacgacatcgtggactacctaccttcaaccgaccttcccttatactagttgggtaccgactacggcccctggacgaggggtcttaggaggttggagttcggggtacttaaacgtccaaacccgttggtgggtacggtacttaccgtaacgtaaacggttttacctaccgaaaccgtaaggaacgtaaacgttggaacccggtaacgggggaaccccgttaaaacgttttaaccccgaagttaccggaaacccgaacgggtaaacggaaacccgtaaccccggttaccccgaaacccggttaacggttaaacccgtaacggtttaccccgttaaaccgaaggtttacgggggaacgggtttacgggaacggtccgtaaacggtccccgtagggaagtacgttccgtagggaaaccgggtaaccgaaccgggtaccttaaacggttagtttaaaccgttttaccgttagggtacggtaccggttaacgttttccggtttttaaagggtacggtttaaacgttttaacccggtaacgtttaaaccgttaagttttttaacgtttttcggtaacctacgggtaaacccccgg

SEQ ID NO: 10120 - DNA, 648 bp, Homo sapiens
  misc_feature: GYAE6OF02JTDXT.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtgggcctcagtgatgtatttcctgcacgacatctggatacaccttcaccgactcccttatacattgggtacacacggcccctggacaggggcttggaggtggagtgggtctaataccgtaaaccgtggtcggtgactacgtaacgaagtttactacgacagagaatcgacgacggaccgaaattaccgatacgaaccaagtaacgacctaacggtacccaacggtaacgttaacgaagttacctaacgaggttagggaagggttagacggtcgaacggtacccgttaggacgtaacgttacggtaaggaacggaacgtaccgggtacctaagttagttaacgtttacgtaggtacggtacgtacgtttacgttaaggttacggtaacgtttaacggaacttaacgtaattttacgttttacggtacctaaccggtacccgg

SEQ ID NO: 10121 - DNA, 590 bp, Homo sapiens
  misc_feature: GYAE6OF02G2G1C.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcggggctgagatgaagagccgtggggcctcagtgatgtactttcctgcacgactatctggatacaccttcaccgtacctacccttatacagttgggtacgacacggcccctggacaggggcttggaggtggagtgggtactaatcaacccgttggtggtggattcaacgtaagtactcacagagaagtgacgagggacctaattaccatacgaacacgacgacgaccgccgaacgtacgtacgagtactacagttagggaggtagagcacgctagagtctacgtgaacggacgacggacctagtacgttaacttacgtcgtacgtacgtacttacggtttagtaacggttaacgttaaccgtacttaacgttaatttacggttttacggtactaccggtaacccgg

SEQ ID NO: 10122 - DNA, 557 bp, Homo sapiens
  misc_feature: GYAE6OF02H3I3W.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttggccgggccagccaaaagtattaagacctggttggcctggtatcagcagaaaccagggaaacgcccctagctcctgatctataagacgtctactttagacaggtggggtcccatcaaggttcaggcggcagtggatcgtgggacagacgttcactctcaccattcgcagcctgcagcctgattgtatttgactaactttattactagaccaaactagtaactaagttactttggtaggtaccgtttcggaccgaagggtaaccaagggtacggaaaatacgaaacgtagtggtacggcgtacgactaccagttcgttcgttctttacgactttaccttcccgaccttac

SEQ ID NO: 10123 - DNA, 559 bp, Homo sapiens
  misc_feature: GYAE6OF02G2NHW.53.73.G07.1.454.CMB.1.raw
  modified_base (338)..(338): a, c, t, g, unknown or other
  misc_feature (338)..(338): n is a, c, g, or t
  modified_base (470)..(470): a, c, t, g, unknown or other
  misc_feature (470)..(470): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagccgtggggcctcagtgatgatttcctgcacgacatctggatacaccttcaccgactccttatacagttggtacacacggcccctggacagggcttgagtggatggtctaagtcaaccgtaggtggtgatctaanaagttactcaacgagacgaaatgacgagggaccgtaaattaccgatacgaacccgaaggaacgaacgaccgtacccgaacgtaacgtaccaagtacctactagtaggaggtagacgcagccgtgagtatcgngaacggacacgctatgtacttcgtgtgaccgtattacgttaaggtggtaacttacgacttactaagtttattttcgtactagtacccgg

SEQ ID NO: 10124 - DNA, 536 bp, Homo sapiens
  misc_feature: GYAE6OF02GGSIZ.53.73.G07.1.454.CMB.1.raw
  modified_base (355)..(355): a, c, t, g, unknown or other
  misc_feature (355)..(355): n is a, c, g, or t
  modified_base (406)..(406): a, c, t, g, unknown or other
  misc_feature (406)..(406): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactcccttatacattgggtacgacacggcccctggacgagggcttgagtggatgggtctaatcaaccgtagtggtgatctacaagttactcacaganaagtgcgaggccgaataccatcgacagacacacgtccacgagtacagtcanatgaggtgagcagcctgagatcgtgaggacgacggaccagtgtaattacgtgtcgtacgtaacttcttaaggtcgtaagttaaccgtaacttaacgttaaagtttattttacgttacgtaacgtacccgg

SEQ ID NO: 10125 - DNA, 552 bp, Homo sapiens
  misc_feature: GYAE6OF02JHX4N.53.73.G07.1.454.CMB.1.raw
  modified_base (302)..(302): a, c, t, g, unknown or other
  misc_feature (302)..(302): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcaggtgatgatttcctgcacgacatctggatacaccttcaccgctcccttatacagttgggtacgactaacggcccccttggacgnggggcttaggacgtggattgggtctaagtccaacctgtggtggactctacaagttactcacagagatgcgagggcaattacagtcgaaccagagacacgtaccacgagtacgatcgactagtggtaggtgacgacacgccgtaggagactcgtaggacgtacgaccggtcagttgtaactacgtgtacgacgtacgttgttaagcggtacttacgtaactacgtaagtttgtttacgtacgtacgtaccg

SEQ ID NO: 10126 - DNA, 594 bp, Homo sapiens
  misc_feature: GYAE6OF02G7WBN.53.73.G07.1.454.CMB.1.raw
  modified_base (234)..(234): a, c, t, g, unknown or other
  misc_feature (234)..(234): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatagaagaagccgtggggcctcgagtgatgacttttccngcacgacatctggataccaccttcaccgaccttcccttaatactagttgggtacgacgacggccccgtgggacgaggggtcttggagtggatgggtctaactcaaccgtggtggtggattactaacgtaagtttactacgacagagtaagtgacgacgggacctaacttaccagtacgacagacgacacgtccacgacgtacacgtactacgtagtgggagtagagacacggtccagtagactcgtagaacgaccgacgacctagttacgtattacgtgtacgtacgtacgttacgttaggtaggttaacgttaacgtaaccttaacttaagtttacttttacgtacgaccggtacccgg

SEQ ID NO: 10127 - DNA, 943 bp, Homo sapiens
  misc_feature: GYAE6OF02GYPWO.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaagaagccgtggggcctcgagtcgatgtatttcctgacacgacgattcgtaggactacctacctttcaacccgtaccttaccccttaataccgtagtttcggggtaaccgaccgaacgggccccccttgggaaccgtagggggtcctttggaaggttgggaacgttcggggtaccttaaacgtacccgtaaaccccgttaaggttcgggtacggtaactttaccgttaaaccgtaaaggttttaacctaccgaacgaaaggtaacggtaaacgttcgggaaccggtaaccgggggtaccccgttaaaaacgttttaaaccccgaaggttacccgggaaaccccgtaaacgggaaccggtaaaccccgtaaaccccgggttaaccccgtaaacccggggtaaaccggtttaaacccgtaaccgggtttaacccgttaaacccgggtaaggtttaacgggggtaacggggtttacgggaaacgggtacccgtaaaccgggtccccggttaagggtaaacggtaaccgtttaccgggttaaggggaaaccggggtaaccccggtaaccggggtacccggttaaagtttaccgggtttaaacgtttaccggttcgggttacggtaccggttaacggtttaccggttttaaacgggttaacgggttaaccgttttaaccccggtaaacgtttaaaccgttaacgttttaacggtttttaccggttacccgaaccggttaaccccgggg

SEQ ID NO: 10128 - DNA, 571 bp, Homo sapiens
  misc_feature: GYAE6OF02H08FO.53.73.G07.1.454.CMB.1.raw
  modified_base (230)..(230): a, c, t, g, unknown or other
  misc_feature (230)..(230): n is a, c, g, or t
  modified_base (352)..(352): a, c, t, g, unknown or other
  misc_feature (352)..(352): n is a, c, g, or t
  modified_base (416)..(416): a, c, t, g, unknown or other
  misc_feature (416)..(416): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcagtgatgatttccngcacgacatctggactacaccttcaccgtactcccttatactagttgggtacgacgacggcccctggacgaggggcttggagtggagtggtctaatcaaccgtgtggtgatctacagttacncacgagagaatgacgacggacctaattaccatcgacagacacgacgtaccagagtacagtctanagtaggaggtagacgacgacgccgtagacgtagtcgtaggaacggacgacgacctaagttcgttaacgttacgtggtcgtacgttattaccgttaaggtacgtaacgttaacgtaacttaactaaagtttagttttacgaccgtacggtacccgg

SEQ ID NO: 10129 - DNA, 719 bp, Homo sapiens
  misc_feature: GYAE6OF02GIMZW.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaagagccgtggggcctcagtgatgtactttccgtgacacgacatcgtggactaccacctttccacccgtaccttaccccttaatactagttggggtaccgacgaccgggtccccgtgggaacggacgggggtccgttaggacgggtgggagtttcggggttacctaaactaccgtaaaccccgttaggttacgggtagggtaacttaccgttaacgaaacgttttaacctaccgaagtaacggaagtaaagttcggaccggtaacgggggtaccccgtaaaatttacccaacggttacgaaacccgaaggaacgaacccgtaccggtaacccgaaccgtaacgtaaccagttaccctacgtaacgtgggacggtagacggcgaacgtccgtagagtaacgtcgtaggacggaaccgacccgggtactagttacgttattaccgttgtacggcgtaattacggttaaggtggtaagtttaccgtaactaattaagtttagttttcgtacgtacgtaccgg

SEQ ID NO: 10130 - DNA, 637 bp, Homo sapiens
  misc_feature: GYAE6OF02HR5HW.53.73.G07.1.454.CMB.1.raw
  modified_base (310)..(310): a, c, t, g, unknown or other
  misc_feature (310)..(310): n is a, c, g, or t
  modified_base (436)..(436): a, c, t, g, unknown or other
  misc_feature (436)..(436): n is a, c, g, or t
tcagcgcgtatacacacgaccggtgctcgatttagctctacgctcagggggagtcagacccagtcaggacacagcatggacatgagggtccccgctcagctccgtggggctcctgctgctctggctcccaggtgccaaatgtgacatccagatgacccagtctcccttccaccctgtctgcatctgtcggagacagacgtcaccgtcacttcggccgggccagaccaaaggtattaacgaccttggttcggctggtatcgagacaaggaaaccgaaggtaaacgccccaagacctcctagacttactaanaacggtactacttaacgtttagacgacgggttcggggtacccagttacgaaggttcgaacggtcggcaaggtggatcgtagggacaagtacgttcactactacactatagcagtcctgacagtctntagtgtatttgacttaacttattactacgacctaaactaacgttaacctaaagtttacgtttggtacggttaccggttccgggtaaccggtaaacgggtaaccgtaaaggggtaacgaaacttaacgaaaccgtagttcggtacggacctcgacctaactacttcttcgttaccttcaaccgtttccgtcccgtactaacg

SEQ ID NO: 10131 - DNA, 559 bp, Homo sapiens
  misc_feature: GYAE6OF02JHW8M.53.73.G07.1.454.CMB.1.raw
  modified_base (349)..(349): a, c, t, g, unknown or other
  misc_feature (349)..(349): n is a, c, g, or t
  modified_base (411)..(411): a, c, t, g, unknown or other
  misc_feature (411)..(411): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtaacacacggcccctggaccgaggggcttggagtggatgggtactaatcaacctaggtggtgatctacagttacncacagagaatgacgagggaccaattaccatcgacctagagacacgtccacgatacagtctanagtggagtagagcacgcctagacgtatcgtgaacggacaccgggacctattacgttagttaccgttggacgtcggtaatttacgttaagggtggttaacgttaaccgttaactaacttaaattcttttaggtaccgtaggtaccccgg

SEQ ID NO: 10132 - DNA, 576 bp, Homo sapiens
  misc_feature: GYAE6OF02HHT9M.53.73.G07.1.454.CMB.1.raw
  modified_base (266)..(266): a, c, t, g, unknown or other
  misc_feature (266)..(266): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtgggcctcagtgatgatttcctgcacgacatctggatacaccttcaccgactcccttanacattgggacacaggcccctggacaggggccttggagtggagtgggtctaatccaacccgtagtggtggatcctaacaagtttactcaacagaagtaatgacgaacggggccgaaattacccagttacgaccaggacgacaaccgtccacgagtaacagtctacgagtggaggtgagcagcctaggacgtatcgtaggtaggaccgtacgggacctagtgttaacttagtggtagtcgtatccggtttaaggtcggtaagtttaccgaacttaacctaaagtttcgttttacgttacgacgtaaccccgg

SEQ ID NO: 10133 - DNA, 513 bp, Homo sapiens
  misc_feature: GYAE6OF02FSWF3.53.73.G07.1.454.CMB.1.raw
  modified_base (348)..(348): a, c, t, g, unknown or other
  misc_feature (348)..(348): n is a, c, g, or t
  modified_base (431)..(431): a, c, t, g, unknown or other
  misc_feature (431)..(431): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgactcccttatactattgggtacgacaggcccctggacaggggcttgagtggatgggtctaatcaaccctagtggtgatctacaagttactnacagagaatgcgagggccaattaccatcgacagagacacgtccacgagtacagtctacatggaggtgagcagcctgagagtcnggagacacggccagtgtattcgtgtgtcgtatcgttaggtcggtattacgtacttactaaattgttttcgtacacgtacccg

SEQ ID NO: 10134 - DNA, 829 bp, Homo sapiens
  misc_feature: GYAE6OF02G1W8G.53.73.G07.1.454.CMB.1.raw
  modified_base (95)..(95): a, c, t, g, unknown or other
  misc_feature (95)..(95): n is a, c, g, or t
  modified_base (199)..(199): a, c, t, g, unknown or other
  misc_feature (199)..(199): n is a, c, g, or t
tcagcgcgtatacacacgaccggtgctcgatttagctctacgctcagggggagtcagacccagtcaggacacagcatggacatgagggtccccgntcagctccgtggggctcctgctgctctggctccgaggtgaccaaagtgtgacatccgagatcgacccagtcctccttccaccctgtctgctatcgtgtacgganacgagtacgtcaccggttacacgttcggacccggtaccaacggtacctaaaagttcgttaacggaccgttgggttcgtaccgttaggtactaccgacggaccgtaaacggaaacccggtagggtaaaccgtcccccgttaaggtacccttccgttaaggtaacgttaccgttaaacggtaacggtaccgtttaccgttaaccgttttaaggaccggttacgggttacccggggtaccctaaggttaccggtaacggtttccgacgggtccggtacgtaggttacggtaacgttacggtacggtaactacggttacgttacctacgttaccgtaacctaacgtacgttaccgacgtaccgtccgttagaccgtaggtacctaggtacgttacgttaccgtttacgaaacctttacgtttacgtaccgttaccgaaccgtaacgttacgttaaccgtaacggtttaccgttaggtacccggttaccggtaccggaaccggtaacgggtaccgttaacgggtaacttaaaccgtaccggtaaacgttcggttacggtaccgtacgttaccgacctaaccgtttagtacccgtttaggttcctacgtacccgttaccgtacccgtattacccgg

SEQ ID NO: 10135 - DNA, 144 bp, Homo sapiens
  misc_feature: GYAE6OF02HN1GY.53.73.G07.1.454.CMB.1.raw
  modified_base (137)..(144): a, c, t, g, unknown or other
  misc_feature (137)..(144): n is a, c, g, or t
tcagcgcgtatacacacgaccggtgctcgatttagctctacgctcagggcagaccggtgctcgatttagcgagacgcgcagggcacgaccggtgctcgatttagcagacgtctgagcgggctggcaaggcgcatagnnnnnnnn

SEQ ID NO: 10136 - DNA, 549 bp, Homo sapiens
  misc_feature: GYAE6OF02F8F7J.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacgaggggcttgagtggatgggtactatcaacctagtggtgatctactaagttactcacgagaagaatgacacggggaccaaagttaccatcgaccagagacacgtccacgagtacagtactacgagtaggaggtgagcgagccgtgagtatcgtagacggacgaccggccagttacgttattactgtacgcgtagttacgttaggtggtacttaaccggtacttaacgtaatttagttttacgtacgtacgtacccgg

SEQ ID NO: 10137 - DNA, 720 bp, Homo sapiens
  misc_feature: GYAE6OF02I4PVS.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcggggctgagatgaagaagcctggggcctcgagtgatgatttcctgcacgacatctggatacaccttcaccgactccttatacattgggtacacacggcccgtaggacaggggcttggacggtggacgtgggtacctaatacgaaccccgttagtcggtggtactcctaagtaacggtttactcaacgtaagacggtaaatcggacgaacgggacccgtaaagtttaccgaagttacgaaacccgaaggaacgaacccgtaaccggttaacccgaacggtaacgtaaaccgaacgttacccgtaacgtaaggttacggggtaagggttacgggaacggtacccgaacggtacccgttaggaaggttaaccgttacggttaacgggaacgggtaaacccgaccgggtaccccggtaaagttaccggttaagtttacccgtagggttacggtaacgttaacgtttaccgtttagggtaacggttaaccgttaacgtaacgttacttaaagttacgttttcggtactacggtaacccgg

SEQ ID NO: 10138 - DNA, 586 bp, Homo sapiens
  misc_feature: GYAE6OF02IBY8N.53.73.G07.1.454.CMB.1.raw
  modified_base (230)..(230): a, c, t, g, unknown or other
  misc_feature (230)..(230): n is a, c, g, or t
  modified_base (356)..(356): a, c, t, g, unknown or other
  misc_feature (356)..(356): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttccngcacgacatctggactacaccttcaccgactccctaatacattgggtacgacacggcccctggacgaggggtcttggaggtggagtgggtcttaatcctaaccgtggtggtgatctactagttacnacagagtaatgacagggaccgtaacttaccagtacgacgagtacgacacgtaccgaacgagtactacgtctaacgagtacgggaggtagacgtcagacctggagtatccgtaggacggacgaaccgggtcctagttagtattagtcgttaggccggtaactttaccgttaggtaggttaaccgttaacgtaccttaacgtaaattttagttttgtacctacggtacccgg

SEQ ID NO: 10139 - DNA, 609 bp, Homo sapiens
  misc_feature: GYAE6OF02JX1PY.53.73.G07.1.454.CMB.1.raw
  modified_base (230)..(230): a, c, t, g, unknown or other
  misc_feature (230)..(230): n is a, c, g, or t
  modified_base (370)..(370): a, c, t, g, unknown or other
  misc_feature (370)..(370): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacaagtcggggctgagatagaagacgccgtgggcctgagtgatgtatttccngcacgacatcgtagactacctacctcaccgtacttccttatactagttcgggacacgacggccccgtggacgagggtcttggagtggagtggtactaataccgaaccgttaggtggtacgatactaacgtaacgtttacncaacgtaagagtaagtcgacggaacgggtacctaaagttaccgagtacgaacaagacgaccgtaccgtaccaggtaacgtactagtacgtacaggtaggtaggagacgcgacgtcgaggactagtcgtaggacggacaccgtctagttagttacgttacgtgtacgtacgtattacgttagggaacgttacgtaccgtaacttaacgttaagttttacgttacgttaccgaccgtacgg

SEQ ID NO: 10140 - DNA, 522 bp, Homo sapiens
  misc_feature: GYAE6OF02GU6XP.53.73.G07.1.454.CMB.1.raw
  modified_base (230)..(230): a, c, t, g, unknown or other
  misc_feature (230)..(230): n is a, c, g, or t
  modified_base (349)..(349): a, c, t, g, unknown or other
  misc_feature (349)..(349): n is a, c, g, or t
  modified_base (430)..(430): a, c, t, g, unknown or other
  misc_feature (430)..(430): n is a, c, g, or t
  modified_base (467)..(467): a, c, t, g, unknown or other
  misc_feature (467)..(467): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttccngcacgacatctggatacaccttcaccgactcccttatacagttgggacgacacggccccctggacaggggcttggagtggatgggtctaatcaacctaggtggtgatctacaagttacncacagagaatgacgagggacctaattaccatcgacagagacacgtcacgagtacagtcacagtggaggtgagcagccaganagtcgagacggacacgcagtgtattacgtgcgacgtnttcgttaggtggtaacttacgtacttacgtaagtttactttcgtacgacgtaccg

SEQ ID NO: 10141 - DNA, 594 bp, Homo sapiens
  misc_feature: GYAE6OF02ITEYQ.53.73.G07.1.454.CMB.1.raw
  modified_base (587)..(587): a, c, t, g, unknown or other
  misc_feature (587)..(587): n is a, c, g, or t
tcagcgcgtatacacacgaccggtgctcgatttagctctacgctcagggggagtcagacccagtcaggacacagcatggacatgaggtccccgctcagctcctggggctcctgctgctctggctcccaggtgccaaatgtgacatccagatgacccagtcctccttccaccctgtctgcatctgtcggagacagagtcaccgtcacttcggccggccaggaccaaaagtattaacgaccgtgggttcggcctaggtactacgagacaaggaaaacccgaaggggaaaacgccccctaagacctccctagtactactaataaggaccgttacttaacgtttagactaggtcggggtacccagtacgtaaggttcagcgggctaggtggatcgtgggacagtacgttcactctacacctagttacgcagcctgccacgctgattgtatttcgactaattattactcaccaatatataattacgtttagagggtacgttacggaccgaagggacctaagggtacgaaactacgaacgtacgtgtcggactacgaccacctagttccttctacttcctacctcccttaccncttaccg

SEQ ID NO: 10142 - DNA, 661 bp, Homo sapiens
  misc_feature: GYAE6OF02I1CCK.53.73.G07.1.454.CMB.1.raw
  modified_base (364)..(364): a, c, t, g, unknown or other
  misc_feature (364)..(364): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggccctcgagtgatgtactttcctgcacgacatctgatacaccttcaccgtacctccttatacagttgggtacacacggcccctggacgaggggcttggagtggagtgggtactaactccaacctaggtggtgattactaacgaagtttaccncgtaacaggagaaagttcggacgtacggggtacctaaaacgttaccaagtacgaaccctaaggaacgaaccgaaccgttcccgaaccggtaagtaacctaggttacctaacgaggttgggaaggttcggacgaccgaacgccgttaggaagtacgttacgtaggacgggtaccgaaccgggtaccagtttacgttaacgtttaccgtcggttaggacgtaacgtttacgttaaggtagttaaccgtttaaccggaactttaacgtaacttttagttttacgtacctaaggtaccccg

SEQ ID NO: 10143 - DNA, 644 bp, Homo sapiens
  misc_feature: GYAE6OF02F2EBR.53.73.G07.1.454.CMB.1.raw
  modified_base (263)..(263): a, c, t, g, unknown or other
  misc_feature (263)..(263): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccggcagccaaagtataagcctggttgcctggtatcagcagaaaccagggaacncccctagactcctgatctataagacgtctactttagactagtcggggtccatcaaggttcagcggcaggtggatctgggacagagttcgactctcaccattacgcagccttgacacgccctgacttggtaacttttgaccttaacgtttacttaccgtcgtaccctaaacgtaacgttaactaagtttaaccttttagggtacgggttaaccggttttccgggaacccgtaaacggggtaccgtaaaacggggttacggtaaaacttaccggaaaacgtaccgtttaggtacgggtaccttcggaaccctaacccgtaacgtttccgttacggtttccctttaccgtaaccgtttccccgtttaccccgacccttaaccgg

SEQ ID NO: 10144 - DNA, 642 bp, Homo sapiens
  misc_feature: GYAE6OF02F1YEI.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgtactcccttatacctagttgggtacgacacggcccctgggacgaggggtcttaggaggtggagtggggtactaatcctaaccgtggtgggtggactactaactaagttactacaacaggaagaatcggacgacgggaccgtaagttaccagtacgaaccgaggaacgaccgtaccggtaccgaacggaagttaacacggttacctaacgtaggttacgggaggtaggaacggcacgtcccgtaggaacgacgttcggtaggacggaccgaccggtacctagttacgttacttacgtggtcgtacgtaacgttacgttaggtacggtaacgtttaccgaacttaacgttaattttaacggtttacggtaccgtacggtaacccgg

SEQ ID NO: 10145 - DNA, 794 bp, Homo sapiens
  misc_feature: GYAE6OF02HXK5V.53.73.G07.1.454.CMB.1.raw
  modified_base (237)..(237): a, c, t, g, unknown or other
  misc_feature (237)..(237): n is a, c, g, or t
tcagcgcgtatacacacgaccggtgctcgatttagctctacgctcagggatcatccaacaaccacatcccttctctacagaagcctctgagaggaaagttcttcaccatggactggacctggagggtcttctgcttgctgtcagtagctccaggtgctcgcctcccgaggtgcagctggtacaagtcgggggctgagatgaagaacgccgtggggcctcgaggtgatgtatttccgngctacgactatcgtggaactaccaccttaccgaccgtaccttccgttaatactagttcgggtacgaccacggtccccgtagggacggtaggggtcttaggacggttcggtaggttcggggttacctaaacgtacccgtaaacccgttagggtgggttaggtaactttaccgtaaaccgttaagttttaaccaccgtaacgtaaaggtaaggtaaacgttcgggaacgtaaccgggggtaacccgtaaacgtttaaccccgaaggttaccggaaacccgtaacggaaaccggtaaccgtaaccccgggttaacccgaaaccgggttaacggtaaacccgtacggttaacccgttaacgaggttaacggggtaggttacgggagttacgacgtaccgttaggaagtaccgttcggtacggtaacggaaccgacccgggtactagttacgttaacgttaccgttaggccggtacgttaagtttaccgttaggttacggttaaacgtttaccgtaacgttaacgtttaagtttagttttaccggtacgtaccgtaacccgg

SEQ ID NO: 10146 - DNA, 677 bp, Homo sapiens
  misc_feature: GYAE6OF02G4HKJ.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagccgtggggcctcagtgatgtactttcctgcacgacatctggatacaccttcaccgtactcccttatacagttgggacgacgacggccccgtggacgaggggtcttggaggtggagtgggtactaactaccaaccgttaggtggtaggacttaccgtaacgtaaagtttactacaacaaggaagtaagtcgaccgaacggggacctaaacttaccgaagtacggaaccgaaggaacgaaccgtaccgtaccgaacgtaacgtacacgtacctacgaggttagggaggtacggacgtacgacggtaccgtaggaacgtagtaccgtagggaacggaaccgaccggtacctaagttacgtttaattaccggttggtacggtacgttaagtttacggtttaagggtacggttaacgttaaccggtaactttaacgttaaacgttttacgttttacggtaccgtaccggtaaccccggg

SEQ ID NO: 10147 - DNA, 708 bp, Homo sapiens
  misc_feature: GYAE6OF02GHAX8.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatggaagaagccgtggggcctcagtgatgatttcctgcacgacatcgtggataccaccttaccaccgtaccttcccttaatacctagttcgggtaccgacgacgggtccccctagggacgagggggtccttaggaggtgggtagttcggggtacttaaacgtcccaacccgttaggtcgggtaggacttaccgtaacgtaacgtttacctacgaacgaaggaaggtaacgtggaccgaacggggacccgtaaagtttaacccgaagtacggaaccctaacggaacgaaccgtaacccggtacccgaacggtaacgtaaccgacggtacctaacgaggttacggggtaagggtcgacggacgacggtccgtaaggacgtacgttacgaggaacgggaccgaccgggtaccagttagttaattacgttggtcggtacgttaagttacgtttaggtacggttaacttaaccggtaacttaacgttaatttagttttacggacctacggtacccgg

SEQ ID NO: 10148 - DNA, 559 bp, Homo sapiens
  misc_feature: GYAE6OF02IEMKF.53.73.G07.1.454.CMB.1.raw
  modified_base (230)..(230): a, c, t, g, unknown or other
  misc_feature (230)..(230): n is a, c, g, or t
  modified_base (353)..(353): a, c, t, g, unknown or other
  misc_feature (353)..(353): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttccngcacgacatctggatacaccttcaccgtactcccttatactattgggtacgacacggcccctggacaggggtcttggagtggatgggtactaatcaaccgtagtggtgatctacaagttaccncaacagagaatgacgacgggaccaattaccagtacgaccagacgacacgtccacgagtacagtcagagtggaggtgagcacgcctaggagtacgtcgtagggaacgacgaccgggactattaggtatttacgtgtacgacgtattagttaggtaggtaacttaacggacttaacgtaacgtttagtttacgtaccgacgtacccgg

SEQ ID NO: 10149 - DNA, 527 bp, Homo sapiens
  misc_feature: GYAE6OF02GNQYY.53.73.G07.1.454.CMB.1.raw
  modified_base (426)..(426): a, c, t, g, unknown or other
  misc_feature (426)..(426): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactcccttatacattgggtacgacaggcccctggacaggggcttggagtggatggggtctaatcaaccctagtggtggatctacaagttactcacagagaatgcagggcgaattaccatcgacagagacacgtccacgagtacagtctaacatggaggtgagcagccngagatcgtagaggacgacggccagtagtacttatggtagtcggattacgttaggtggtacttaccgaactacgttaattagttttagtccgtagtacccgg

SEQ ID NO: 10150 - DNA, 606 bp, Homo sapiens
  misc_feature: GYAE6OF02GRTJB.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagcctgggcctcagtgatgatttcctgcacgacagtctaggatacaccttcaccgacttcccttatacagttcggtacgacacggcccctggacgaggggtcttggagtggagtgggtactaatcaaccgtaggtggtggatctaacgtaagttactacacagagaatgacgagggacctaaattaccgaagtacgaccgaagacgaacaccgtaccgaacggacgtaacgacgtaccgtacgagtacgggaggtagacggactagaccgtagaacgtacgtcgtaggaaggaccgacggacctaagttcgttaagttacgttggtagacggtaacttcgttaaggtacggttaacttaacggtacgttaacgtaatttacgttttacgtacgtacgtaacccgg

SEQ ID NO: 10151 - DNA, 635 bp, Homo sapiens
  misc_feature: GYAE6OF02F23GT.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacgcccctagactcctgatctataagacgtctactttagacagtggggtcccatcaaggttcagcggcagtggatcgtgggacagagttcactctcacattagcagcctgcagcctagatgtatttgacctaacttattactcgacctaactacgtaactaattacgttttggtacggtaccggtttaccgggaccgtaaacggggtaacccgtaaaggggtacggaaaaacgttaccgaaaaaccggtaacgttacgggttacgggtaccgttacggtaacccgtaaccccgtaacgtttacccgtttacggtttacccttttaccgttaaccgtttccccgttttaccccccggtacccttaacccg

SEQ ID NO: 10152 - DNA, 176 bp, Homo sapiens
  misc_feature: GYAE6OF02HEOGC.53.73.G07.1.454.CMB.1.raw
  modified_base (151)..(151): a, c, t, g, unknown or other
  misc_feature (151)..(151): n is a, c, g, or t
  modified_base (173)..(176): a, c, t, g, unknown or other
  misc_feature (173)..(176): n is a, c, g, or t
tcagcgcgtatacacacgaccggtgctcgatttagctctacgctcagggcacgaccggtgctcgatttagctctacgctcagggcacgaccggtgctcgatttagctttacgctcagggcacgaccggtgctcgatttagcagacgtctgngcgggctggcaaggcgcatagnnnn

SEQ ID NO: 10153 - DNA, 682 bp, Homo sapiens
  misc_feature: GYAE6OF02HLLGG.53.73.G07.1.454.CMB.1.raw
  modified_base (364)..(364): a, c, t, g, unknown or other
  misc_feature (364)..(364): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagccgtgggcctcgagtgatgatttcctgcacgacatctggatacaccttcaccgacttccttatactagttggtacgacgacggcccctggacgaggggtcttggagtggagtggtactaatccaaccgttaggtggtaggatactaactaagttactacanaaggataagtggacgtaacgggggacctaaattaccgaatacggtaaccgaaggaacgaaccgtacccggtacccgaacggtaacgtaacgacggttaccttaacgaggtacgggtagggttacgaaggaccgtaacggtcccgtaaggtaacggtaacttacggtacgggaacgggtaacccgtaaccggggtaacccaaggttaacgttaacgtttaaccgtgggttacgtcggttaacgttcgtttaagggtcggtaaacgtttacgtaaccttacgttaaattttacggtttttagacccgtaaggtaacccgg

SEQ ID NO: 10154 - DNA, 609 bp, Homo sapiens
  misc_feature: GYAE6OF02JCXUS.53.73.G07.1.454.CMB.1.raw
  modified_base (372)..(372): a, c, t, g, unknown or other
  misc_feature (372)..(372): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgactttcctgcacgacatctggataccaccttccaccgacctcccttatacctattcgggtacgacacggcccctggacaggggcttggagtggtagtgggtactaagtccaacccgttggtggtggactcgtaaactaagtttaccnctaacgaagaagaagtaggtaagggtacctaaactttaccagtacgaccaagaacgacctaacgtcccgaacggaacgttacgagttacctaacgtagtcgggaaggtgaagcgagacccgtagagtatcgtaggacggaccgacggtaccagttagttacttacgtgtacgcgtagttcgttaaggtaggtacgttacgaacttataactttattttggactacgtaccgtaacgg

SEQ ID NO: 10155 - DNA, 653 bp, Homo sapiens
  misc_feature: GYAE6OF02J2P2D.53.73.G07.1.454.CMB.1.raw
  modified_base (193)..(193): a, c, t, g, unknown or other
  misc_feature (193)..(193): n is a, c, g, or t
  modified_base (412)..(412): a, c, t, g, unknown or other
  misc_feature (412)..(412): n is a, c, g, or t
tcagcgcgtatacacacgaccggtgctcgatttagctctacgctcaggggagtcagacccagtcaggacacagcatggacatgagggtcccgctcagctcctggggctcctgctgctctggctcccaggtgccaaatgtgacatccagatgacccagtctccttccaccctgtctgcatctgtcggagacagngtcaccgtcacttcgccgggtcacgccaaagtattaacgaccctggtttcggcctggtaactcagacagaaaccgagggaaacgcccctagactcctgtatctataagacgttacttactttagactaggttacgggtcccatacgaaggttcaggcggtacagtggtaactcgtagggacagtacgttcacgtctaccgactattagctacgaccgtnactacgtcctgtagttgtagttttcgacgttaaacttagttaccttacgacctaaacgtagtacctaaagtttcgtttggtacggtaccgttttaccgggaacccgttaacggggaaccctaaggggttaacgaaaacgtaccgtaaaccggacgttgtaccggcttaaccgaccggtaaccttagtacgtttcggtttaacccttccgtaacgtttaccccgtttaccccgacttaccgg

SEQ ID NO: 10156 - DNA, 578 bp, Homo sapiens
  misc_feature: GYAE6OF02IJH5M.53.73.G07.1.454.CMB.1.raw
  modified_base (362)..(362): a, c, t, g, unknown or other
  misc_feature (362)..(362): n is a, c, g, or t
  modified_base (461)..(461): a, c, t, g, unknown or other
  misc_feature (461)..(461): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatactaccttcaccgacttcccttatactagttgggtacacgacggcccctggacgagggggtcttggaggtggagtgggtactaatcctaaccgtggtggtgactctagaacttacncacagaagaatgcgacgggaccgtaacttaccagtcgaaccaggaacgacgaccgtcgaacggtagactaagtctaacagtgggaggtgaagcagtccngagtactcgtagggacgacgaccgactagttacgtacttgttcgtgacgtacgttacgttaggttaaggtactttaacggacttagttaacgtttagttttcgacgtaccgtaccgg

SEQ ID NO: 10157 - DNA, 547 bp, Homo sapiens
  misc_feature: GYAE6OF02GF7WI.53.73.G07.1.454.CMB.1.raw
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (352)..(352): a, c, t, g, unknown or other
  misc_feature (352)..(352): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctgggggcctcagtgatgatttcctgcacgacatctggatacaccttcaccgactccccttatacattgggtacgacaggcccctggacaggggcttgagtggatgggtctaatcaaccgtagtggtggatctaanaagttacncanagagaatgcgaggggccgaaattaccatcgaccagacgacacgtccacgagtacagtctacagtaggagtgagcagccagagatcgtgaggaccgacggaccaagttgtactttacctaggtgacggtattcgttaacggttaggtaacttaaccgtacttaacgtaatttaagttttacgtacaacgtacccgg

SEQ ID NO: 10158 - DNA, 590 bp, Homo sapiens
  misc_feature: GYAE6OF02HVE03.53.73.G07.1.454.CMB.1.raw
  modified_base (481)..(481): a, c, t, g, unknown or other
  misc_feature (481)..(481): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatggaagagccgtggggcctcaggtgatgtatttcctgcagacatctggatacaccttcaccgtactcccttatacagttcgggtacacgacggcccctggacgacggggtctggagtggagtgggtactaactactaacccgtaggtggtaggtactactaacgtaagtttacctacgaacgaggaagtaatggacgacggggaaccgtaacttaccgaagtcgaacgaaggacgaaccgaccgtaccgacgtaacgtacagtactacgagttggagtgagcganccgtagacgtatcgtagaacgacgacgacctagtagtacttagtgtgtacggtattgttagtggttaactaccgactaacgtaatttagtttacgtacgtagtacccgg

SEQ ID NO: 10159 - DNA, 770 bp, Homo sapiens
  misc_feature: GYAE6OF02GXM2D.53.73.G07.1.454.CMB.1.raw
  modified_base (235)..(235): a, c, t, g, unknown or other
  misc_feature (235)..(235): n is a, c, g, or t
tcagcgcgtatacacacgaccggtgctcgatttagctctacgctcaggggatcatccaacaaccacatcccttctctacagaagcctctgagaggaaagttcttcaccatggactggacctggatggtcttctgcttgctgtcagtagctccaggtgctcgctcccaggtgcagctggtacaagtcgggggctgagatgaagacgccgtggggcctcgagtgatgtactttccgngaccacgactagtccgtaggactaccaccttccgacccgtaccttccccttatacctagttacgggtaaccgaccgaccggcccccgtagggaccggtacgggggtccttagggaggttgggtagttcgggtacttaaacgtacccgtaaacccgttagggttcgggtacggtaacttaccgttaaacgtaaacgtttacctacgaacgaaggaacgtaagttcggacggtaacggggtacccgtaaacgtttacccgaagtacgaaacccgtaaggaaccggaaccgtaacccggtacccgaacggtaacgttacgacgttacctaacgtaggtacggggtaggtaggacgaccgacggtccgtaggagtacgttacgtaggaaccgggaaccgtaccgggacctaagttacggttaacgtttacggtggttaccggtacggttaacgtttaccggtttaacgggtacggttaacgtttaacccggtaaccttaaacgtttaatttttacggttttaccgtaccgtaacccggg

SEQ ID NO: 10160 - DNA, 619 bp, Homo sapiens
  misc_feature: GYAE6OF02ISS55.53.73.G07.1.454.CMB.1.raw
  modified_base (313)..(313): a, c, t, g, unknown or other
  misc_feature (313)..(313): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagccgtggggcctcgagtgatgtatttcctgcacgacatcgtggatacaccttcaccgtactcccttatactagttggtacgacgacggcccctggacgaggggtcttggngtggtagtgggtactaaattccaaacccgttaggtggtaggacttacgtactaagtttactcaacgaagagaatgcgacgggaccaattaccgatcgaaccagacacgacgtacacgtagtaacagtacctaacgagtagggaggtagagacgagaccgtagagtacgtcgaggaacggaccgaaccggtaccctagtaacgttaacgtttacgttgtacggtacgtacgttacgttacggtaggttaacgtttaacgtaacttaacgttaacgtttagttttaacgtccgtaccggtaacccggg

SEQ ID NO: 10161 - DNA, 144 bp, Homo sapiens
  misc_feature: GYAE6OF02FIHN9.53.73.G07.1.454.CMB.1.raw
  modified_base (138)..(144): a, c, t, g, unknown or other
  misc_feature (138)..(144): n is a, c, g, or t
tcagcgcgtatacacacgaccggtgctcgatttagctctacgctcaggggtgctcgatttagctctacgctcagggcacgaccggtgctcgatttagtgacatctcgcatttcttgagcgggctgcaaggcgcatagnnnnnnn

SEQ ID NO: 10162 - DNA, 542 bp, Homo sapiens
  misc_feature: GYAE6OF02FOO11.53.73.G07.1.454.CMB.1.raw
  modified_base (205)..(205): a, c, t, g, unknown or other
  misc_feature (205)..(205): n is a, c, g, or t
tcagcgcgtatacacacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtnacttgccgggccagcaaagtataagacctggttgctggtatcagcagaaaccaggaaacgcccctagactcctgatctaataagacgtctactttacgacaggtcgggtccatcaaggttcagcggcaggtggatcgtgggacagtagttcactcctcaccagttacgcacgcctgctacgcctagatgtatttgactaactttagttactacaccaactatacaattactttgaggtaccgttgaccgtaagggaccgaaggtagaaagtacaaacgtactaggtcggtctacgacaaccgtatcttcgtcttcctagttcccttacccgctaccg

SEQ ID NO: 10163 - DNA, 609 bp, Homo sapiens
  misc_feature: GYAE6OF02F7QPD.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgactttcctgcacgacatctggataccaccttcaccgactcccttatacagttgggtacacacggcccctggacgagggtcttgagtggatgggtctaatctaaccgtagtggtaggacttctaactaagtttacacacagaagaatgcgacgggtaccgaaattaccgagtacgaccagacgacaccgtaccgacgtagtaacagtacctacgagtagggtagtagacgacgagtacccgtaggagtagtcgtaggacggacgtaccgggacctaagttacgttattaccgtgtacggtcgttaacgttaccgtttaggttacggttaacgttaaccgtaacgtttaacttaacgttttattttacggtacgtaaccgtacccgg

SEQ ID NO: 10164 - DNA, 561 bp, Homo sapiens
  misc_feature: GYAE6OF02I7GL3.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggcagccaaagtattaagacctggtgcctggtatcagcagaaaccagggaacgcccctagactcctgatctagtaagacgtctacttagacaggtgggtcccatcaaggttcagcggcagtgatcgtagggacagtagttcacgtctacacctattacgcagcctgcagtctagatcgtatttcgactaactttattactagaccaacagtaactaagttacgtttaggtacggtacgttacggaccgtaacgggtacctaagggtacggaaattacgaaacgtagtaggtacggctacggacctaccgtattccgttagttccttaccacttcccgttcccgactacg

SEQ ID NO: 10165 - DNA, 172 bp, Homo sapiens
  misc_feature: GYAE6OF02JFS6F.53.73.G07.1.454.CMB.1.raw
  modified_base (171)..(172): a, c, t, g, unknown or other
  misc_feature (171)..(172): n is a, c, g, or t
tcagcgcgtatacacacgaccggtgctcgatttagctctacgctcagggcacgaccggtgctcgatttagcgagacgcgcagggcacgaccggtgctcgatttagtacacgtgattagggattgggtgatagggtacgcactcgtctgagcgggctggcaaggcgcatagnn

SEQ ID NO: 10166 - DNA, 769 bp, Homo sapiens
  misc_feature: GYAE6OF02JAYFH.53.73.G07.1.454.CMB.1.raw
  modified_base (165)..(165): a, c, t, g, unknown or other
  misc_feature (165)..(165): n is a, c, g, or t
  modified_base (190)..(190): a, c, t, g, unknown or other
  misc_feature (190)..(190): n is a, c, g, or t
tcagcgcgtatacacacgaccggtgctcgatttagctctacgctcagggatcatccaacaaccacatccttctctacagaagcctctgagaggaaagttcttcaccatggactggacctggagggtcttctgcttgctgtcagtagctccaggtgctcgctcccnggtgcagctggtacaagtcgggggntgagatggaagagccgtggggcctcaggtgatgatttcctgccagacatcgtggtatacaccttcaccgtactcccttattaccagtttgggaccgtacgacggccccgtggaccgaagggggccttggaaggtggtagttggggtactaaacgttaccgaaccccgttaggttacgggtggtacttaccgttaaactaaacgggtttactactaacgaggtaaaggtaacgtggaccgaaggggtacccgtaaaacgtttacccgaacgttacgtaaccgtaaacggaaccggtaaaccgtacccggtaaccaaccgggtaaaccgtaaaccgtacggttaaacccgtactaacgggttacggggtaacggggttaacgtacggtaccgacggtacggtacgtaacggtacgtttacggacgggtacggaaccgtacggtaaccggtaacgtttacgttaacgtttacgttacggtcgtaacggtaactttaaccgttagggtaaccggttaacgtttaaacgggttacttaaacgtttaacggtttaacttttacgttaccgtaaccggtaaccggg

SEQ ID NO: 10167 - DNA, 567 bp, Homo sapiens
  misc_feature: GYAE6OF02FPFC2.53.73.G07.1.454.CMB.1.raw
  modified_base (190)..(190): a, c, t, g, unknown or other
  misc_feature (190)..(190): n is a, c, g, or t
  modified_base (335)..(335): a, c, t, g, unknown or other
  misc_feature (335)..(335): n is a, c, g, or t
  modified_base (385)..(385): a, c, t, g, unknown or other
  misc_feature (385)..(385): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttgccgggccagccaaagtattaagacctggttggcctggtatcagcagaaaccagggaacgcccctagactcctgatctataagacgttctactttagactagtggggtcccatcaaggttcagcgcngtgatcgtggacagtagttcactctcactattacgcagcctgcagcctgntgtatttgactacttattactcacctaacagtaacaagttactttgtacggtacgttacggaccgtaaggggtaaccgtaagggtacggaaacgtacgaaaccgtacgtaggtacgggtacgtaggacctaaccgtacttcgttacgttactttaccgtacgttccttaccccggactaacg

SEQ ID NO: 10168 - DNA, 554 bp, Homo sapiens
  misc_feature: GYAE6OF02G2WCC.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatgacccagtctccttccacctgtctgcatctgtcggagacagatcaccgtcacttgccggcagccaaagtataagacctggttgcctggtatcagcagaaaccagggaaagcccctagactcctagatctataagacgtactactttagactagtgggtaccatcaaggttcagtcgcaagtgaatcgtgggacagagttcactctacacctattacgcacgcctagcaagcctagatgtatttgactaactttagttactgaccaaactagttaaccaattactttggtacggtaccgttacggacgtaacgggaacctaaagggtacggaaaataccgaaacgtacctggtacggtcgtagaccaccgtatctacgttccttctacgtcctcccgactaacg

SEQ ID NO: 10169 - DNA, 514 bp, Homo sapiens
  misc_feature: GYAE6OF02IPMY4.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttgcccgggccagccaaagtattaagacctggttggcctggtatcagcagaaaccagggaaacgcccctagactcctgatctaataagtacgtctacttagacagtggggtcccatcaaggttcagcggcagtggatcgtggacagagttcactctcactattagcagcctgcagcctgatgtatttgactaattattactgaccaatagtacaattacgttgtacggtacgttcggaccaagggaccgaaggtacgaatacaaacgactagtacgctgcacatctgtcttctactccttccgctac

SEQ ID NO: 10170 - DNA, 626 bp, Homo sapiens
  misc_feature: GYAE6OF02GVVXX.53.73.G07.1.454.CMB.1.raw
  modified_base (191)..(191): a, c, t, g, unknown or other
  misc_feature (191)..(191): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcgganacagagtccaccgtcacttcggccgggccagaccaaagtattaagacctggttcggcctggtatcagcaagaaaccgagggaaacgccccctaagacctcctagactactaagtaacgacgttacttactttaagacgtaggtcggggtacccatacgtaaggttcagcggcaggtggatcgagggacagtacgttcactcctacacctagttacgacacgcctgcacgtcctagtatgttatttagacctaatttacttactacgacctaaactagtaactaagttcgtttaggacggttaccggttaccggaccgaacgggtaaccgtaagggtaacggtaaacgtaacgaaacgtacgttacggtacggtctacgaccgtaaccgtacgttctacgttaccgttacctaccgttcccgttcccgacttaccg

SEQ ID NO: 10171 - DNA, 587 bp, Homo sapiens
  misc_feature: GYAE6OF02IUTD3.53.73.G07.1.454.CMB.1.raw
  modified_base (269)..(269): a, c, t, g, unknown or other
  misc_feature (269)..(269): n is a, c, g, or t
  modified_base (333)..(333): a, c, t, g, unknown or other
  misc_feature (333)..(333): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacncccctagactcctgatctataagacgtctactttagacagtcgggtccagtcaaggttcagcgnagtggatcgtggacagagttcactctacacctattacgcagcctgcacggcctagtactgtatttcgactaactttattaactgaacctaactacgtaacaattactttaggtcggtaaccggtttcgaccggtaaagggacccgtaaagggtacggaaactacgtaaaaccggagttcggtacggtctaccgtacaaccgtaagtccttaggttacctttaccgtaccttcccgtttaccccggacttaacgg

SEQ ID NO: 10172 - DNA, 515 bp, Homo sapiens
  misc_feature: GYAE6OF02GOGCB.53.73.G07.1.454.CMB.1.raw
  modified_base (337)..(337): a, c, t, g, unknown or other
  misc_feature (337)..(337): n is a, c, g, or t
  modified_base (347)..(347): a, c, t, g, unknown or other
  misc_feature (347)..(347): n is a, c, g, or t
  modified_base (351)..(351): a, c, t, g, unknown or other
  misc_feature (351)..(351): n is a, c, g, or t
  modified_base (403)..(403): a, c, t, g, unknown or other
  misc_feature (403)..(403): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgacttcccttatacattgggtacgacacggcccctggacaggggcttgagtggatgggtctaatcaacctgtggtgatctanagttactcanaganatgcaggcaataccatcgaccagacgacacgtaccagacgtacagtcctaanagttgggagttgagcagtccagagatcgtagaggaccgacggacagtagtattactgtgcgtattcgttaggtgtaacttacgactactaatttatttcgaccagtacccgg

SEQ ID NO: 10173 - DNA, 538 bp, Homo sapiens
  misc_feature: GYAE6OF02FQAYO.53.73.G07.1.454.CMB.1.raw
  modified_base (270)..(270): a, c, t, g, unknown or other
  misc_feature (270)..(270): n is a, c, g, or t
  modified_base (422)..(422): a, c, t, g, unknown or other
  misc_feature (422)..(422): n is a, c, g, or t
  modified_base (524)..(524): a, c, t, g, unknown or other
  misc_feature (524)..(524): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttggccgggccagaccaaagtattaagacctggttggcctggtatcagcagaaaccagggaacncccctagactcctgatctataagacgttactactttagactaggtggggtcccatctaaggttcagcggcaggtgatcgtggacagtgttcactctcaccattagcagtcctgacacgcctagacttgtatttacgctaaacgttatttacngaccaagtacgtacaattactttgtaggacgtttcggaccaagggaaccaagggtacgaatacgaaacgtactgtagtctagcacctattctacttcttctntaccttccgactac

SEQ ID NO: 10174 - DNA, 740 bp, Homo sapiens
  misc_feature: GYAE6OF02IJDMJ.53.73.G07.1.454.CMB.1.raw
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
  modified_base (497)..(497): a, c, t, g, unknown or other
  misc_feature (497)..(497): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggtacaagtcgggggctggagataggaagacgccgtggggcctcgagtgatgtactttcngacgacgacnttcgtaggactacctaccttccgaaccgtcctcccgttaatacgtacgtttacgggtaaccgacgtacgggtcccctagggaaccggtaggggtcgttaggacggttagggacgttacggggttacctaaacgtacccgtaaaccgttaggtacgggtacgtaactccgtaaacttaaacgttacccgtacaaccgtaaagaacggtaaacgttcggacgggtaaccggggtaacccgtaatttaaacccgngtaacccggaacaaggaacgtaaccgtacccgtaaccgaacggtaaacgtaccgtacgttactaacgtacggtagggtacgggtacgacggaacgcggtaccggtgaacgtaggtccgtaaggaccggaccgtaacgggtacccttaggttacttaagttacggtgtacgtccgttaagtacggttaggtacgtaaccgtaccgttaagtaacgtatttaccgtttctaccgtacgtaacccg

SEQ ID NO: 10175 - DNA, 518 bp, Homo sapiens
  misc_feature: GYAE6OF02FVGND.53.73.G07.1.454.CMB.1.raw
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgagtggatgggtctaatcaacctagtggtgatctanaagttacnacagagaatgcagggccgaattaccatcgacagacgacacgtccaacgagtacagtctacagtggaggtgagcgagccgtgacgatgtggaggacgacggccagtgtacttacgtgtgcgtatcttaggtgtacttacgtacttaactaagttattttacgtcctagtacccgg

SEQ ID NO: 10176 - DNA, 692 bp, Homo sapiens
  misc_feature: GYAE6OF02G5CTU.53.73.G07.1.454.CMB.1.raw
  modified_base (231)..(231): a, c, t, g, unknown or other
  misc_feature (231)..(231): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatagaagagccgtggggcctcagtgatgtatttccngcacgacatctggataccaccttccaccgtactcccttatactagttcgggtacacgacggccccgtggacgaggggtcttggaggtggagtggtactaagtccaaccgtggtggtagatactaactaacgttactacacgaagacgtaagtcgacgtaacggggtacctaaacttacccgaagttaccgaaccgtaacggaacgtaaccgtaaccgtacccgaaacggtacgttaacgtaaccggttacctaaccgtaaggttacggggtaaggttacgggaacgtccgtaacggccgttaggtaacgtacgttccggtaagggaaccggaaccggtaaccgtaaccgtaagttacgttaactttacggtggttacgacgtaagtttaccgttagggttacggtaactttaaccgtaacgttaacttaacgtttagttttaccggtacgacggtacccgg

SEQ ID NO: 10177 - DNA, 591 bp, Homo sapiens
  misc_feature: GYAE6OF02GHGLS.53.73.G07.1.454.CMB.1.raw
  modified_base (407)..(407): a, c, t, g, unknown or other
  misc_feature (407)..(407): n is a, c, g, or t
  modified_base (443)..(443): a, c, t, g, unknown or other
  misc_feature (443)..(443): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagatcaccgtcacttggccggcagaccaaagtattaagaccgttggttcgccgtggtatcagacaacgaaaccgaaggggaaacgccctaaggacctcctagactctaagtaagtacgtacttacttagacgtaggttcggggtacccattacgaaggtttcaaggtcggacaggtgagtcgagggacagtagttcactctcaccagttacgacncgcctgacacgtcctggatgtatttgacttaaattnttactgacctaataacgtaactaagttacttaggtcgtacggttacgaaccggtaacggacgtaaaggtacggaaataccgaaacgtacgtggtacgtcgtacgcctaactagtcctacgttcctacgacttccctacccgacttacg

SEQ ID NO: 10178 - DNA, 592 bp, Homo sapiens
  misc_feature: GYAE6OF02F1ZAL.53.73.G07.1.454.CMB.1.raw
  modified_base (497)..(497): a, c, t, g, unknown or other
  misc_feature (497)..(497): n is a, c, g, or t
  modified_base (583)..(583): a, c, t, g, unknown or other
  misc_feature (583)..(583): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccgaggtgcagctggtacaagtcgggggctgagatgaagaagccgtggggcctcgagtgatgtatttcctgcacgacatcgtggataccacctttccaccgacttcccttatactattgggtacgacacgggcccctggacgacggggcttggaggtggtagtcgggtactaataccaacccgttaggtggtgactactaactaagttactacacagagaatcgacgacgggaccgtaattaccgatacgaaccaaggaacgacgaaccgtacccgacgaacgtactacgtacctacgtagtagggaggtgacgacgacggtcgtagaaggntcgtagacggaccgtaccgacctagttcgtacttacgtgtagcgtatcgttaggtagtacttacgacttataaattgtttacgtanacgtaccgg

SEQ ID NO: 10179 - DNA, 599 bp, Homo sapiens
  misc_feature: GYAE6OF02GHS8S.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacctaccttcaccgactcccttatacattgggtacacgacggcccctggacaggggcttggagtggatgggtactaatcaacccgtaggtggtaggatctaactaagttactacaacagagaatcggacgacgggaccgaattaccagtacgaacctagaacgacgaccgtaccaacgacgtaacgacgtactaacagtggaggtagacgcgagccaggtagacgtcgtaggacggaaccgacggacctaagttacgttattacgtgttacgtcgtaacgttacgttaagggtacgtaacgtttaaccgtaattaaccgtaaagtttacttttacggtacgaacggtacccgg

SEQ ID NO: 10180 - DNA, 682 bp, Homo sapiens
  misc_feature: GYAE6OF02HXDY2.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtgggcctcagtgatgtacttctgcacgacatctggactacaccttccaccgtacctcccttaatactagttagggtacgacgacggcccctggacgtaggggcttggagtggagtgggtactaatcgaacctaggtggtagattactaacgtaaagtttacctacaacgtaagaaggtaaacgtggacgaaacggggtaccgtaaacttaccaacgtacgaaccgaaggaacggaaacctacggtaccgaacggaacgtaacgaacgttacctaacgtaggttagggaaggttcggacgacgacggtaccgtaggaagtacgtacggtaggaacggaccgaccgggtaccgtaagttacgttacgttacgtcggtacgtaaccggtatttacgtttaagggtaacggttaaacgtttaaccgaaacctttaaccgttaaatttacggtttttacgtaccgtacggtaaccccgg

SEQ ID NO: 10181 - DNA, 882 bp, Homo sapiens
  misc_feature: GYAE6OF02HMA7E.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcgccgggccacgaccaaagtattaacgaccgttgggttcggccttggtactcgagacaacggaaaccgaaggggaaaccgccccgtaagacctcctagactactaagtaacgtacgtacttaacgtttacgacgtagggttcggggtaccctagtacgtaacgggttcaacggtccggtacgtaggttacgggtaacgttcggttacgggggaacctaagggtacgtttacctaaccgttccttaccctaaccgttaagtttaacggaccgtaacgtcccgtacggacctaacggtacccgttaggtacgttacgttaacgtttttacggaaccctttaaacttttacgtttaaccgttaccgggtaaacccctaaaacggttaaaccgtttaaaccgttaaaaccgttttacggttttacgggtaaccggggttacccgggttttaacccggggaacccgggtaaaaccgggggtaaacccgttaaaacgggggttaaacggtaaaaaaccgttaacccggtaaaacgggtaaccgtttacggggttaaccggggtacccttaaccgggtaaccctaaaccccggtttaacggtttacccgtttacgggttttaccctttacccggttaaccccgttttcccggttttacccccccggtaccgtttaacccgg

SEQ ID NO: 10182 - DNA, 530 bp, Homo sapiens
  misc_feature: GYAE6OF02GTYP7.53.73.G07.1.454.CMB.1.raw
  modified_base (355)..(355): a, c, t, g, unknown or other
  misc_feature (355)..(355): n is a, c, g, or t
  modified_base (441)..(441): a, c, t, g, unknown or other
  misc_feature (441)..(441): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagcctgggcctcagtgatgatttcctgcacgacatctggatacaccttcaccgactcccttatacattggtacgacacggcccctggacaggggcttggaggtggagtgggtactaacgtccaaccgttagtcggtgactctaacgtaattacncaacagagaatgcgaggacgattacatacgacagacgacacgtaccacgatacagtactacagttggagtgagcagctgagactgngaggacacggcagtgtacttacgtgtacgcgttactcgtttaaggtgtattacgtaacttactaatttgttttacgtaccagtacccgg

SEQ ID NO: 10183 - DNA, 686 bp, Homo sapiens
  misc_feature: GYAE6OF02HY3S6.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtgggcctcagtgatgtactttcctgcacgactatcgtggataccaccttcaccgtacttcccttatactagttcgggtaacgaccgtacggccccctaggaccgacgggggtcttggaggtcggaaggttcggggttactaaacgtacctaacccgtaggtgggtggtaactactaacgtaagttacctctaacgtagaagtaaagtcgacgtaacgggaccgtaattaccagtacgaaaccgaggacgtaccgtaaccgtaccgaacggtaacgtaacgtacgtctaactaggtagggtaacggtagacgacgacggccgttagaacgtagtcgtacggaacggaccgacggcctaagttacgttaacgttaccgtggttaccggtagtaaccgttacggttttaacggtacgggttaaacttaccggttaaacttaacgtaaacgttttacgttttacgtccgtaacgtaaccccgg

SEQ ID NO: 10184 - DNA, 651 bp, Homo sapiens
  misc_feature: GYAE6OF02HSCGS.53.73.G07.1.454.CMB.1.raw
  modified_base (370)..(370): a, c, t, g, unknown or other
  misc_feature (370)..(370): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgtactttcctgcacgacatcgtggatacaccttcaccgtaccttcccttaatactagttcgggtacgaccgacggcccctggacgaggggcttgaggtgagtgggtctaatcaacccgtagtggtggtatacgtactaacgtttacncaacgtagagtaatgacgacgggaccgtaaattaccagtacgaccgaaggtacgaaccgtaccgtacccaacggtacgtaacgtacgttaaccgtaacaggttacgggtagggttaggacggacgtacgaccgtaggaacgtacttacgtagggaacggaaccgaccggtaccgtagtaggtttacttacgtagtcggtacggtattacgttaacggtggttaaccgtttaaccgaacttaaccgttaatttagtttttacgtaccgtacgtaaccccggg

SEQ ID NO: 10185 - DNA, 654 bp, Homo sapiens
  misc_feature: GYAE6OF02GSVG8.53.73.G07.1.454.CMB.1.raw
tcagcgcgtatacacacgaccggtgctcgatttagctctacgctcagggggagtcagacccagtcaggacacagcatggacatgagggtccccgctcagctccgtggggctcctgctgctctggctcccaggtgaccaaatgtgacatccagatgacccagtctccttccaccctgtctgcatctgtcggagacagagtcaccgtcacttggccggccagaccaaagtattaagcctggtgcctgtatcagcaagaaacgaggaaacgccctagactctagatactaataagacgtacttaacttagacgtaggtcgggtacccagtacaaggttcagcggacaggtggatcgtagggaactaggtacgttacactctaccaaccgtattacgacagtcctagcgagtcctgattgtaagtttcgaaccttaactttaagttactcgaacctaaacaacgttaactaacgttacgttttggaacgggttaccggttaccgggaaccgtaaacggggaaccgtaaagggtacggtaaaaacgtacggtaaaaccggtaacgttagggttaccgggacttacggtaaccctaacccgttaagttaccgttacgttccgtttaaccgtaactttcccgtttacccccggattaaccg

SEQ ID NO: 10186 - DNA, 542 bp, Homo sapiens
  misc_feature: GYAE6OF02HB8Z4.53.73.G07.1.454.CMB.1.raw
  modified_base (282)..(282): a, c, t, g, unknown or other
  misc_feature (282)..(282): n is a, c, g, or t
  modified_base (334)..(334): a, c, t, g, unknown or other
  misc_feature (334)..(334): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaacgcccctagactccngatctataagacgtctactttagacagtggggtcccatcaaggttcagcggnagtggatctgggacagagttcactctcacctattagcagcctgcagcctgattgtatttgactaattattactgaccaatacgtactaattactttggtacggtaccgttcggaccgtaacggggaccctaaagggtacgaaataccgaaacgtacgtggtggcctggccaaccgtatcgtcgttcttcacttccttacccgctaacg

SEQ ID NO: 10187 - DNA, 649 bp, Homo sapiens
  misc_feature: GYAE6OF02FOFBF.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgctatctgtcggagacagagtcaccgtcacttggccggccagaccaaagtattaacgacctggttgcctggtatcagcagaaaccagggaaacgcccctagacctcctgatactataacgacgtctactttagacgtagtcgggtcccatcgaaggttcgaagcggcgagtggatcgtagggacaggtagtttcacctctacaaccctattacgcaggcctggcacgtcctagattgtatttcgacctaaactttattacgtacgaccctaagtaacgtaacctaagtttaacttttggtacgggttacccggtttccggtaacccggtaaacgggggtacccgtaaagggtaacgggtaaaacttaccggtaaaaccggtacgttagggtacgggtactacggtacccgtaaccgtacgttaccgttacgtttacctttacgttaccttcccgtttacccgcccttaaccg

SEQ ID NO: 10188 - DNA, 879 bp, Homo sapiens
  misc_feature: GYAE6OF02ITZND.53.73.G07.1.454.CMB.1.raw
  modified_base (189)..(189): a, c, t, g, unknown or other
  misc_feature (189)..(189): n is a, c, g, or t
  modified_base (551)..(551): a, c, t, g, unknown or other
  misc_feature (551)..(551): n is a, c, g, or t
  modified_base (671)..(671): a, c, t, g, unknown or other
  misc_feature (671)..(671): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatgacccagtctccttccaccctgtctgcatctgtcgganacagagtcaccgtcacgttcgcccgggaccagcccaaaagttattaaacggcccttagggttcggcccgttgggtaattccaggacctaacggaaaaccccgaacggggaaaacggtacccccccgtaaggtaacccttccccgtagtaacttaccgttaagtaaacgtaaccgttaccttaaccttttaaacggaaccttaacggggttacggggggttaccccctaacgttccgggtaaaacggtttccgaaacggtccggggtaccggtaacggttcggggtatttaccgggttcggggaaccctaaggtaacggttttcccaacgttaccgttaccctaacccggtaaggttttaccnccggtacggtacccccgtaggtacccgtaccgggtaccttacggtaacgttggtttaaacgttttagggaaccccttttaaacggtttactttaccggttacccgtaaaccccggtaaanacccggtttaaactaaacggttttaacgtttcgggtttaaccgggtaaccgggttttcccgggaaacggttaaacggggacccgttaaaaggggttaacggaaaccggttaaccgttaaaaccgggacgtttaacggcggtacgtacgttaccaaccgtgtttactaccgttagttacccttaccgtcccgtttccccgcccgttaag

SEQ ID NO: 10189 - DNA, 634 bp, Homo sapiens
  misc_feature: GYAE6OF02IBNBN.53.73.G07.1.454.CMB.1.raw
  modified_base (257)..(257): a, c, t, g, unknown or other
  misc_feature (257)..(257): n is a, c, g, or t
  modified_base (506)..(506): a, c, t, g, unknown or other
  misc_feature (506)..(506): n is a, c, g, or t
tcagcgcgtatacacacgaccggtgctcgatttagctctacgctcaggggatcatccaacaaccacatcccttctctacagaagcctctgagaggaaagttcttcaccatggactggaccgtggagggtcttctgcttgctgtcagtagctccaggtgctcgctcccaggtgcagctggtacagtaaaacggggctggagataggaagaagccgtggggcctcgaggtgatgtatttcctgcaacgacatctggtanacaccttcaccgtactacctatactagttaggtacgacacggcccgtcggacggacgggtcttaggaggtggtagtcgggtactaacgtacctaaaccgtacggttgggtaggtactactaacgtaaagttactacaacgagaagtaagtacgacgagggaccgtaaacttaacgaatacgaacgacggaacgaacgaccgtaccgaacgtacggtaacagtctaaacgaggtacgggtaggtgacgtnaacggccgttagacgtatcgtacggaagaacgtaccgaacgttatgttaacttacgtgttagacgtaattacgttaaggtagtaacgttagtaaccttaacgtaatttacgtttacgtacacgaccgg

SEQ ID NO: 10190 - DNA, 665 bp, Homo sapiens
  misc_feature: GYAE6OF02I95JV.53.73.G07.1.454.CMB.1.raw
  modified_base (224)..(224): a, c, t, g, unknown or other
  misc_feature (224)..(224): n is a, c, g, or t
tcagcgcgtatacacacgaccggtgctcgatttagctctacgctcagggggagtcagacccagtcaggacacagcatggacatgagggtcccgctcagctcctgggctcctgctgctctggctcccaggtgccaaatgtgacatccagatgacccagtctccttccaccctgtctgcatctgtcggagacagagtcaccgtcacgtgccggacagaccaaagtnttaagccgtggttgcctggtatcgagacgaacgaaacgaggaacgcccgtagactctgtactactataacgacgtacttacgtttacgactaggtcgggtaccctagttacgtaaacggttcgaacggtcgggactaacggtaggtacgtcggtagggtaactaggtacgttcctacgtctacacctagttacgacacgtctagactacgtccgtagtcgtagttacgtttacgacttaattacttacgttacggaccctaaagttacttaacgtaaactttacggtttgtacgggttacgttacccgggaacgtaaaccgggaacgtaacgggttaagtaaaacggtaacctaaaaccggtacgtaggtacggtacgttacgacctaaccgtacttacgtcgttaccgttcctaacgttcccgtacccgtacgttaaccg

SEQ ID NO: 10191 - DNA, 557 bp, Homo sapiens
  misc_feature: GYAE6OF02GL9NJ.53.73.G07.1.454.CMB.1.raw
  modified_base (269)..(269): a, c, t, g, unknown or other
  misc_feature (269)..(269): n is a, c, g, or t
tcagcgcgtatacacacgaccggtgctcgatttagctctacgctcagggggaggtcagacccagtcaggaccacagcatggacatgagggtccccgctcagctcctggggctcctgctgctctgctcccaggtgccaaatgtgacatccagatgacccagtctccttccaccctgtctgcatctgtcggagacagagtcaccgtcacttgccgggccagccaaagtattaagacctggttgcctggtatcagcagaaaccagggaaacncccctagactcctgatctataagacgtactactttagacagtcggggtcccatcaaaggttcaaggcggcagtgggatcgtagggacagagttcactcctacaccattagcagcctgcagcctgatgtatttcgactaacttattactcgaccaacagtacaatttacgttgtcggtacgttaccgggaccgtaagggtaccaagggtacgaaataccaaacggtactgtgggtctacgacctaacctagttcgttacgttcttactacttccttaccccgtactacg

SEQ ID NO: 10192 - DNA, 663 bp, Homo sapiens
  misc_feature: GYAE6OF02GXPY1.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccagatgacccagtcctccttccaccctgtctgcatctgtcggagacagagtcaccgtcacgttcggcccgggccacggaccaaaagttattaacgaccgttggttcggccttggtatcagacaacgaaaccgaagggaaacgccccgtaagacctcctagtactactaagtaagtacgttaccttacgtttacgacgtaggtcggggtaccagtacgaaggttcaggcggcagtggatcgtggaactgtacgttaccacgttctacaacctagttacgacgtacgcctgcacgtctgtattgttactttacacttaactttacttactacgtaccaacgtacgtaacctaatttaccgtttggtaccgttaacggttaccgggaaccggtaacgggtaaccgttaaagggtacgaaaaccttaaccgaaacgtacgttaggtacggtacgtacgtaacccgtactacgttcgttacgtttactacccgttactccccgtttacccgacgttaccg

SEQ ID NO: 10193 - DNA, 529 bp, Homo sapiens
  misc_feature: GYAE6OF02GNAH8.53.73.G07.1.454.CMB.1.raw
  modified_base (283)..(283): a, c, t, g, unknown or other
  misc_feature (283)..(283): n is a, c, g, or t
  modified_base (425)..(425): a, c, t, g, unknown or other
  misc_feature (425)..(425): n is a, c, g, or t
  modified_base (446)..(446): a, c, t, g, unknown or other
  misc_feature (446)..(446): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtggggcctcagtgatgatttcctgcacgacatctggataccaccttcaccgacttcccttatacagttgggacacncggcccctggacgaggggcttggagtggagtgggtctaatacctaaccctaggtggtgatctaacgaagtttactcacaagagaagtgacgagggccaattaccatcgaccagacgacacgtaccacgagtacagtacctanagtggagtgagcagcctaganatcgtgaggacgacgcagtgtatagtgtgtcgtattcgttaggtggtattacgacttactaatttatttgtacgacgtaccgg

SEQ ID NO: 10194 - DNA, 573 bp, Homo sapiens
  misc_feature: GYAE6OF02I3YAY.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggataccaccttcaccgactcccttaatactagttgggtacgacacggcccctggacaggggtcttggagtggagttggggtacttaatccaaccgttggtggtggatctaactaagttactcacaagagaagtcgacgaagggaccaattaccgatcgacagacgacacgtcacgtagtacagtctacagtggagtgacgcagccgtgagtactcgtagaggaaccgacggacctagttcgtaacttacgtaggttgacgtagttcgttaggtcggttaacgttaaccgtacttaacgttaatttacgttttcggacctacggtacccgg

SEQ ID NO: 10195 - DNA, 760 bp, Homo sapiens
  misc_feature: GYAE6OF02GCSY4.53.73.G07.1.454.CMB.1.raw
  modified_base (190)..(190): a, c, t, g, unknown or other
  misc_feature (190)..(190): n is a, c, g, or t
  modified_base (267)..(267): a, c, t, g, unknown or other
  misc_feature (267)..(267): n is a, c, g, or t
  modified_base (287)..(287): a, c, t, g, unknown or other
  misc_feature (287)..(287): n is a, c, g, or t
  modified_base (353)..(353): a, c, t, g, unknown or other
  misc_feature (353)..(353): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttgcccggcagccaaagtattaagacctggttcgcctggtatcagcaagaaacgaggaacnccctagactctgatactaanaagtacgtactaactttagactaggtcgggtaccatacgtaaggttcaggcggcaggtggactcgnggactagtacgttcactctacgaactattagctacgcctgaccacgtcccgtagtagttagttagttttaccgaacctaaacttttaagttaaccgtacggtaacccctaaaacgttaacggttaaaaccctttaaacgttttaaccgtttttacgggtaaccgggtttaacccgggtttaaccggggaaaccccggtaaaaacgggggtaacccggttaaaaacgggtttaaacgggtaaaaaccttaaaacccggtaaaaacccgggtacgtttaacggggttaccgggtaaccttaaccggggtaaccccttaaaacccgtaggttttacccgttaaccggttttccgtttaacccgttaaacccgttttccccccggtttaccccccggactttaaacccggg

SEQ ID NO: 10196 - DNA, 680 bp, Homo sapiens
  misc_feature: GYAE6OF02JVC8A.53.73.G07.1.454.CMB.1.raw
  modified_base (196)..(196): a, c, t, g, unknown or other
  misc_feature (196)..(196): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagntgaagagcgtgggcctcagtgatggtacttcctgctacgacatcgtggatacaccttcacccgactcccttatactagttcggtacgacacggccctggacgagggtcttggagtggacgtcgggtactaacgtaccgtaaccccgttaggtcggtaggtataccttaacgtaagtttaacctctaacgagaacgaagtagacgacgggacggtaaacttacccgaagtacgaaccgaacggaacgtaaccaccggtaccgaaccggtagtaacgacgtactacgtaggtagaggtagagacgtaggacccgtgaagtacgtacgtacggtaacgggaaccgaccgggtaccgtaaacgtcgtttaacgttaccgttacggtcgtaacgtaaggttttccggttaacggttagggttaaccgttaacggtaacctttaacggtaaacgttttacgtttacggttacctaccggttaaacccggg

SEQ ID NO: 10197 - DNA, 633 bp, Homo sapiens
  misc_feature: GYAE6OF02INHMU.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctccttccaccctgtctgcatctgtcggagacagagtcaccgtcacttcgccgggccagaccaaagtattaagacctggttcggcctggtatcagcagaaaccagggaaacgccccctagacctcctgactctaataaggtacgttaccttaacgtttagacgtacggtcggggtaccccatccgtaaggttcgacgtcggctaggtggatcgtcggacagtacgttcactctcactattacgcacgcctgaccagccgtagattaggttactttcgacctaactttacttactcgaacccaacgtacttaactaatttactttggtacggtaccggtttcgggaaccgaacgggaacctaaagggtcgaaaatccgaaaaccgtacgttcggtacgggtacttacggacctaaccgtacgttaccgttcgttaccttaccgtaacctttcccttaccccggacttaaccgg

SEQ ID NO: 10198 - DNA, 714 bp, Homo sapiens
  misc_feature: GYAE6OF02FYVTV.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccacctgtctgcatctgtcggagacagagtcaccgtcacttcgccgggccagccaaagtataagaccgtggttcggccttggtatcgagacaacgaaaaccgaaggggaaacgcccctagacctcctagactactaataacgacgtactactttagactaggtcgggtacctagtacgtaaggttcagcggtacgtagtggtatcgtaggacgtagtacgttaccactccgtacctacctagttacgactacggccttacgcgtacgccgtagtattagttacgtttcgtactaactttacttacgtcgtaaccctaaactaacgttaacttaaacgtttaaccggttttggtaccgggttaccgttacccgggtaaccggtaaacggggtaaacccgtaaagggttaaacggtaaaacgttaaccggtaaaacgtaccggttacggtacggtaccgttacggacccgttaaccgtaacccgtttaccgttacggtttacccttttaaccgttacccgtttacccccgttcccccggtaccttaaccg

SEQ ID NO: 10199 - DNA, 772 bp, Homo sapiens
  misc_feature: GYAE6OF02GZ8VA.53.73.G07.1.454.CMB.1.raw
  modified_base (205)..(205): a, c, t, g, unknown or other
  misc_feature (205)..(205): n is a, c, g, or t
  modified_base (469)..(469): a, c, t, g, unknown or other
  misc_feature (469)..(469): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtcctgcatctgtcggagacagagtcaccgtnacgttcgccggccagccaaagtattaagacctggttgcctggtatcagcaagaaaccgagggaaacgccccagactacctgactactaagtaacggacgttaccttaacgtttacgaactacgggtcggggtacccctaataccgtaacgggtttacaggaccggccgtaaggtggaacttacgggtacgggaacctaagggttacggtttaccaaccgttactaccgaaccttaagtttacgacgtaccgtacccgtacgacncggtaccccttggaagttagttactttaggaccttaaacgtttaacttactacgtacccgtaaaactacggttaaactaacgtttaacgtttttgaaccggggtaccgttttacggggaacccgtaaacggggtaaccggtaaacggggttacggtaaaaaccgttaccggtaaaaaccgtaacggttaccggggtaggttacggttaaccggaccctaaacccgggttaattaccccggttaggtttttacccgtttaacctacccgtttttaccccgttacccccgggactttaaccccgg

SEQ ID NO: 10200 - DNA, 715 bp, Homo sapiens
  misc_feature: GYAE6OF02JXVTQ.53.73.G07.1.454.CMB.1.raw
  modified_base (153)..(153): a, c, t, g, unknown or other
  misc_feature (153)..(153): n is a, c, g, or t
tcagcgcgtatacacacgaccggtgctcgatttagctctacgctcagggatcatccaacaaccacatcccttctctacagaagcctctgagaggaaagttcttcaccatggactggacctggaggtcttctgcttgctgtcagtagctaccgnggtgctcgcctcccaggtgcagctggtacaagtcggggctgagagtagaagacgccgtgggcctacgagtagagttagtactttccgtagcaacgactacgtcgtaggactacctaccgttaccacccgtaccttacccttaacttaacgtagtttaccgggtaacgaccggaaccggtccccgtacggaacggacgggttcgttagacggtgggtagttcgggttaactaacgtaccgtaacccgttaggtggtacggtaatccgtaacgtaacgtttacactaacgaagaagtaagttcgaccggtaaccgggtaaccgtaaccgtaaccgagttaaccgaaccgtaagaacgtaccaaccggtacccaaacggtaacgttacgaacggttaccgtaaactaggttaacgggtagtacgacgtacgacgtacgtagacgtatccggtagaacggaccacgtacagttacgttagtacgtcgtaggtacgtaccttaggttagtacgttacgttaaccgttacgtaacttaacgttttgttaacccgtagtccctaacggg

SEQ ID NO: 10201 - DNA, 605 bp, Homo sapiens
  misc_feature: GYAE6OF02IPHBN.53.73.G07.1.454.CMB.1.raw
  modified_base (368)..(368): a, c, t, g, unknown or other
  misc_feature (368)..(368): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgtatttcctgcacgacatctggatacaccttcaccgacctcccttaatacattgggtaaccgacgacggcccccgtggaccgagggggcttggacggtggatgggtactaacgtcgtaacctaggtggtggatctaacaagttacncacgagagaatgacacgggacgaattaccgagtcgacagaacgaccacgtaccacgacgtacagtacgtactagtgggaggtagagacgtacgccgtagagtacgtacgtaggaacggacgaccggtctacgttagtacgtttacgtggttacgtacgtaagtttaccgttagggttaggtaacgttaaccggtaaccttaacgttaatttagttttacgtaccgtaccgtaaccgg

SEQ ID NO: 10202 - DNA, 803 bp, Homo sapiens
  misc_feature: GYAE6OF02JPIL1.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcgccggcagaccaaagtattaacgaccgtggttcggccttaggtactcgagacgaagaaaccgagggaaaccgcccctaagacctcctagactactaagtaagtaccgttacttaacgtttaaggaaccgtagggttaccggggtacccctaagttaccgtaaacgggttcgaacggccgggtacctaaggttcgggaactttcggtagggaacctaaggtacgttccaacgttcctacgtaaccctaagttaacgacgtaccgacccgtttacgaccgtaacggtccgtttaggtaacgttacggtttacgttttaccgaaccgtttaaaactttaccgtttaaccgtaccgtaaccctaaacgttaacgttaaacctaaacggttttacgtttagggttaacgggttaacccggtttaccggaaacccgggttaaaccgggaaccggttaaagggtaaacggtaaaacgttaaccgtaaaaccggtacggttacggtaaccgggtccttaaacggaccctaacccgttagttaccgttacggttttacccttaaccgttacggtttcccccgtttaccccgtaccggttaacg

SEQ ID NO: 10203 - DNA, 591 bp, Homo sapiens
  misc_feature: GYAE6OF02GB0U8.53.73.G07.1.454.CMB.1.raw
  modified_base (289)..(289): a, c, t, g, unknown or other
  misc_feature (289)..(289): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatagaagaagccgtggggcctcagtgatgtactttccgtgcacgactatctggactacaccttcacccgacttcccttatacattgggtacacnggcccctggacgaggggcttgaggtggagtgggtcttaactcaacccgtaggtggtggtatctactaacgttactacaacgaggaagaatgacgacgggaccgtaaacttacaagtacgacaaggacgaacgaccgtacccaacgaacgtaacacgtactaactagagggtaggtgacggcgacgtccgtagagtactacgtaggagaaccggtaccgacctattgttaacgttactgtggtacgtattacgttaggtgtacgttaacgtactaactaatttatttctacgacgtaacccgg

SEQ ID NO: 10204 - DNA, 755 bp, Homo sapiens
  misc_feature: GYAE6OF02JI2WG.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccacctgtctgcatctgtcggagacagagtcaccgtctacgttcggccgggccacgacctaaaagtacttaagaccgtggttcggcctggtatcagtcaacgaaaccgagggaaacgccccgtaagtacctcctgtactcgtaataacggtacgttaccttacgtttaacgacgtacgggttcggggtacccctagtaccgtaagggtttaccaggtccggtacgacggtcgggtacgttacggtcggggaactacgggtacgtttccacgttcccgtaacctaaccgtaagtttacggcctacggtacccgtcggtaccgtacggacccttaggtaacgttagtttacgttttacggaacctttaaacttttaaccttaaccggtcgtaacccgtaaactaacgttaacctaaagtttaccgtttagggttacggtaccggtttaccgggaaccgtaacggggtaaccgtaaaggtaacggtaaaccttaacgaaaccgttacggttacggtcggtaacgtcgtaaccgaaccgttaacgttccgttacgttaccttacgacccgtttaccttccccgtaccgttacg

SEQ ID NO: 10205 - DNA, 542 bp, Homo sapiens
  misc_feature: GYAE6OF02JBEF9.53.73.G07.1.454.CMB.1.raw
  modified_base (355)..(355): a, c, t, g, unknown or other
  misc_feature (355)..(355): n is a, c, g, or t
  modified_base (469)..(469): a, c, t, g, unknown or other
  misc_feature (469)..(469): n is a, c, g, or t
  modified_base (480)..(480): a, c, t, g, unknown or other
  misc_feature (480)..(480): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactcccttatacagttcgggtacacgacggcccctggacgagggtcttggagtggatgggtactaatccaaccgtagtggtgatactaagagttacnacagagatgacgaggaccaataccatcgacgagacgacacgtccgaacgagtactagtactaacagttacggaggtgacgcacgcgtagagactcgtaggagacgacgctagtnttattccgtgngacgtagttacgtagtcggtaattaccggaacttacgaatttacgtttacgcctacgtaccg

SEQ ID NO: 10206 - DNA, 604 bp, Homo sapiens
  misc_feature: GYAE6OF02H5DUI.53.73.G07.1.454.CMB.1.raw
  modified_base (471)..(471): a, c, t, g, unknown or other
  misc_feature (471)..(471): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgacatctggatacaccttcaccgtactcccttaatactagttggggtacgaacgacggtcccccgtggacgtagggggtcttggaggtggagttggggttacttaaagtcctaaacccgttggtggttacggattactaacgtaacgtttacctacaacgagagaatgacgagggaccgtaaactacccagtacgaccagaagacacgtccaacgagtacagtactagagtggtagnggagcgagccgtgagagtcgtagaaggaccgaccggaccattagttacttaacgttgttgcgttagttacgttaggtaggttaattaccggaacttaccgtaagtttactttttacgtacctacgtaacccgg

SEQ ID NO: 10207 - DNA, 569 bp, Homo sapiens
  misc_feature: GYAE6OF02FXOYD.53.73.G07.1.454.CMB.1.raw
  modified_base (377)..(377): a, c, t, g, unknown or other
  misc_feature (377)..(377): n is a, c, g, or t
tcagcgcgtatacacacgaccggtgctcgatttagctctacgctcagggggagtcagacccagtcaggacacagcatggacatgagggtccccgctcagctcctggggctcctgctgctctggcctcccaggtgccaaatgtgacatccagatgacccagtctccttccaccctgtctgcatctgtcggagacagagtcaccgtcacttggccgggccagccaaagtattaagacctggttgcctggtatcagcagaaaccagggaaacgcccctagacctcctagatactataagacgttcttacttaagacgaggtcggggtcccaattcgaaggttcagcggacagtggatcgtgggacagtagttcactcctnaacctattacgacagcctgcagcctgatgttatttacgactaacttattactcgaccaactagtaactaagttactttaggacggtacggtttcggacccgtaaggggacctaagggtacgaaataccgaaacgtactggtggtcctagaccaacctatcgttacgttcttactactcccttacccactacg

SEQ ID NO: 10208 - DNA, 848 bp, Homo sapiens
  misc_feature: GYAE6OF02GHYJR.53.73.G07.1.454.CMB.1.raw
  modified_base (317)..(317): a, c, t, g, unknown or other
  misc_feature (317)..(317): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaagaagccgtgggggcctcgagtagatgtactttcctgacacgacatctggtataccaccttaccaccgtaccttcccttatactagtttgggtacgacgacggccccgtgggacgngggcttggaggtggtagtgggtacttaacgtcctaaacccgtaggtcgggtaggacttaccgtaactaaacgtttaccactaacgaagtagaagtcggaccgacggggaccctaaagtttaccaagttaccgaccgtaaggaaccggtaaccgtaaccggtacccaaacgggtaacgtaaccgtaacgttaaccgtaaccgtagggttacggggtaagggttacggaacgtaccggtaaccggtaacccgttagggttaaacgggtaaccgtttaccgggttaacggggaaaccggggtaacccccgggtaaaccgggtacccgttaaacggttttaacgttttaaaccggttttaaccggttagggtttaccgggaacccgggttttaaacggtttttaaaccccggggttttaggggttaacgggtttaaaaccggttttaaaccccggttaaacttttaaaacccgtttaaaacgttttttaacggtttttaacccgttaccgggttaaacccggttaaaccccgggg

SEQ ID NO: 10209 - DNA, 760 bp, Homo sapiens
  misc_feature: GYAE6OF02GNDOX.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcgagtgatgtacttttccgtgacacgacagtcgtggatacctaccttcacccgtacctacccttactaactagttcggggtaaccgacgacggcccccgtggaccggacggggtccgttagggaggtaggtagtggggttacttaacgtaccgtaaaccccgttaggtcggttaggtacgttacgtaaaccgttaaacggtttaaccctacgaaccgtaaaggaaacgtaaagtcgggaaccgaaacgggggtacccgttaaaacgtttaaacccgaagttaccggaacccgaaggaaacgaaccaacccggttacccaaacggtacgtaaccgtacgttacctaacgaagttagggagggtacggaacgtcgacgtaccgtaggacggtaacgttcgtaacgggacgggaaccgaacccgtaccgtaaggttacgtaactttacgttggttacggtcggtaactttacggtttaacggtaggtttaacttaacgtaaccgttaactttaaagtttacgttttaccgtacgtaccgtaacccggg

SEQ ID NO: 10210 - DNA, 599 bp, Homo sapiens
  misc_feature: GYAE6OF02IMGSJ.53.73.G07.1.454.CMB.1.raw
  modified_base (475)..(475): a, c, t, g, unknown or other
  misc_feature (475)..(475): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatggaagaagccgtggggcctcagtgatggtactttcctgcacgacatcgtggactacaccttcaccgactcccttatacattgggtacacgacggcccctggacgaggggcttggaggtggatcgggtctaatccaaccctaggtggtggatctaacaagtttacctcaacgagtaagaagtgacgacgggaccgtaaattaccatacgactaagacgacactaccgagtaagtacacgtacaatagtcgggagtaggagcagccgtagagacgtacgnggaacggaccgaccggactagttagtacgtttactggtacgttcgtaagtttacgttaacggttggttaaagttaaccgtacttaaacgttaattttaacgttttagtccgtacgtaacccggg

SEQ ID NO: 10211 - DNA, 924 bp, Homo sapiens
  misc_feature: GYAE6OF02IR7AI.53.73.G07.1.454.CMB.1.raw
  modified_base (158)..(158): a, c, t, g, unknown or other
  misc_feature (158)..(158): n is a, c, g, or t
  modified_base (190)..(190): a, c, t, g, unknown or other
  misc_feature (190)..(190): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccngtctccttccaccctgtctgcatctgtcgganacagacgtcaccgtcacgttcggccgggccagacctaaagtattaagaccgtggttcggcctggtactcagcgaacgaaaccgaggaacgccccgtagactcctgatctaagtaacgtacgtctaacttaggacgtacggtcgggtaccctaattacgtaacggttacaggtccggacgtaggtacggtacgttacggaggggactaaggtacggtttaactaccgttacttacccgaaaccgttaacgtttaacggtaccctaacggtaccccgtaggtacccgtaacggtacccgtaggttaacgttacgtttaacggttttttacgaaacccgttttaaaacgttttaacgtttaacccgttaacggtaaacccgttaaaaccgtaaaccgggtttaaaccctaaaacggtttttaccgttttaaacggggttacccggggttttaaacccgggtttaacccggggtaaaccccggtaaaaccgggggttaaaacccgggttaaaacgggggttaaacgggttaaaaaaaaccgttaccggttaaaaaaaccccgggttacgggtttaaccggggttaaccggggttaacccggttttaaacccgggaaccgtttaaaacccccggttaaccgttttacccggttaacccgggtttttaacccggtttttaacccgttaaccccggtttaacccccgtttttacccccgggttaaccccgtttaacccggg

SEQ ID NO: 10212 - DNA, 638 bp, Homo sapiens
  misc_feature: GYAE6OF02H7OO3.53.73.G07.1.454.CMB.1.raw
  modified_base (235)..(235): a, c, t, g, unknown or other
  misc_feature (235)..(235): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcggggctgagatagaagaacgccgtgggcctcgagtgatgtactttccngcacgactatcgtggactacctaccttccacccgtaccttacccttaatactagttcgggtaccacgtacggccccgtaggacgaggggtcttaggagtggagtcggtactaacgtaccgaaccgttaggtggtaggacttactaacgtaagtttaccacgaacgaagtagaatcggacgacgggtaccgtaacttaccgagtacgaaccgaggaacgtaccgacgtaccgaagtacgtaacgtacgtactaacgagttagggagtacgagacgagtaccgagacgtacgtacgagggaacgaccgacgtacctagttacgttattcgtgtacgtacgttaagttcgttaggtacggtacttaacgtacttaactagttttacgtttcgtaccgacggtaccg

SEQ ID NO: 10213 - DNA, 685 bp, Homo sapiens
  misc_feature: GYAE6OF02JX8A7.53.73.G07.1.454.CMB.1.raw
tcagcgcgtatacacacgaccggtgctcgatttagctctacgctcaggggatcatccaacaaccacatcccttctctacagaagcctctgagaggaagttcttcaccatggaatggacctggagggtcttctgcttgctgtcagtagctccaggtgctcgctcccaggtgcagctggtacaagtcgggggctgagatagaagaagccgtggggcctcgagtgatgtactttctgcacgacatctggataccacctcaccgtactccttaatacagttgggtacgacgacggccccgtggaccgaggggtctggtacggtaggacggtaggtactaacgtaccgtaaacccgttggtgggtacgggtaatacccgttaacggtaaacgtttactaccgaacgtaacggagtaaacgttacggacggaacggggaccgttaaacttaaccgtacgtacgaccgtaaggaccgtaacgacccggtaccaacggtaacgtaacggtacgttacgtaacgtagttaggggtaaaggtcggaacgcgtacggaccgttacggagtacgtcgtaacggtacggacgtaccgaccgtataggttaattcggtactggacgtcgttacgtttacgggttagtaacgttacgtaacgtttaacgtaacgtttacgttagttccgacggttaccgg

SEQ ID NO: 10214 - DNA, 715 bp, Homo sapiens
  misc_feature: GYAE6OF02IRTKK.53.73.G07.1.454.CMB.1.raw
  modified_base (356)..(356): a, c, t, g, unknown or other
  misc_feature (356)..(356): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctcgaggtgctcgcctaccgaggtgcgagtcgtaggtacgaaggtcggggctaggagtagtaggaagaacgccggtcggggcctacgaggtagtagtagtactttccgtgaccacgactacgttcgtaggactacctaccttccacccgttaccttaccctttaatactaggttacgggtaccgaccgaccggtccccgtaggacggnggggtcttaggaggtaggtagttcgggtaccttaacgtacccgtaaccgttagggtgggtacggtaacttaccgtaacgttaacgtttacctacgaacgtaaggaaacgtagtcgggacggtaacgggaaccttaaacgtaccgtagtaaccgaaccgaaggaaccgaaccacccggtaccgacgtaaacgtacgtagtactacgaggtcgggtaggtcgagacacggccgtagacgtagtacggtagacggaacgtaccggactagttcgttacttacgtgtacgtcgtattacggtttacgtaggttaacttacgtaacttaactttaagttttcgtttaacgcgtaacccgtacgg

SEQ ID NO: 10215 - DNA, 586 bp, Homo sapiens
  misc_feature: GYAE6OF02FQI0H.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggataccaccttccaccgtaccttccccttatactattggggtaccacgacggccccgtagggacgaggggtcttggagtggagtgggtctaatcgaacctaggtggtggatactactaagttactcacgagagaatgacgagggaccgtaaacttaccgatacgaccgtaagacgtaaccaccgtaccacgacgtaacgacgtcacgagtgggaggtgacgcacgtacctggagtagtcgtagacgacgacgctatgttattcgtagtcggtgtacgtacgtttaggtacgttaacgttacgttaacgtaacgttaattacgttttcgtacgtacgtacccgg

SEQ ID NO: 10216 - DNA, 618 bp, Homo sapiens
  misc_feature: GYAE6OF02G3GXO.53.73.G07.1.454.CMB.1.raw
  modified_base (347)..(347): a, c, t, g, unknown or other
  misc_feature (347)..(347): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtataagacctggtcggcctggtatcagcaagaaaccagggaaacgcccctagactcctagactactaataacgacgtactaactttagacaggtcggggtacccatacgtaaggttcagcggngagtggatcgtggacagagttcactcacacattacgcacgcctagcacgcctagtattgtactttgaccttaaactttagttacctcgaaccctaaacgtaacgttaaactaactttacgtttagggtacgggttacggttaccgggacccggtaaacgggaaccgtaaagggttacggaaaacgttaccgaaacggtacgtaggtacggtcgtacgtacctaacctagttcgtacgttccttactaccgtttcccttcccggtactaccg

SEQ ID NO: 10217 - DNA, 670 bp, Homo sapiens
  misc_feature: GYAE6OF02HM533.53.73.G07.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (231)..(231): a, c, t, g, unknown or other
  misc_feature (231)..(231): n is a, c, g, or t
  modified_base (500)..(500): a, c, t, g, unknown or other
  misc_feature (500)..(500): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgctccaggtgcagctggacaagtcggggntgagatagaagagccgtgggcctnagtgatgtactttccgngacgacgactatcgtaggaactactaccttccaccgtacttcccttaatacgtagttacggacacgacgccccgtggacgtagggtactgagtaggagtggtacctaataccgtaacccgtagtagggtcacgttactaacgtaacgttactcaacgtagaacgagtacgaggtaacggtaaccgtaatttaccgagtacgaaccgttaagaaccggtaacaccggtaacgaccgtagtaacgacgtacttaacgagtagggtaacggngaacggcgacggaccgttagaacgtacgttaccgacgggaaaccggtacgaccggtaaccttagtacgttaacgtttagacggttacgtacggtaactttagtaacgggttataaccgttaacgtaacgttaactaaccgttttaggtttacgtaccgacgttaaccggg

SEQ ID NO: 10218 - DNA, 715 bp, Homo sapiens
  misc_feature: GYAE6OF02JDVDV.53.73.G07.1.454.CMB.1.raw
  modified_base (157)..(157): a, c, t, g, unknown or other
  misc_feature (157)..(157): n is a, c, g, or t
  modified_base (572)..(572): a, c, t, g, unknown or other
  misc_feature (572)..(572): n is a, c, g, or t
tcagcgcgtatacacacgaccggtgctcgatttagctctacgctcaggggatcatccaacaaccacatcccttctctacacgaagcctctgagaggaaagttcttcaccatggactggacctggagggtcttctgcttgctgtcagtaactccacgngctcgctccacgtgcagctggtacaatcggggcgtgagagtagaagaagccgttggggccgtctagtgatgtatttccttgcacgacatctggatacaccttcaccgactcccttatacagttggtacgacacggaccccgtggacgagggtccgttgtaaggtggtagttacggggtaccttaaactacctaaaaccccgtggttgggtacggtacgttccttaacctaaagggtttaacccttccaaccgaaggtaaggtaaaacgtcggacgtaacgggggtaaccccgtaaacttttaaccgacgtacggaacccgaaggacgtaaccgtaaccgttacccgaacggtacgtaacgtaccgtacgttaccgaagtagggacggttaggaacgcgacggtaccgtgaacgtntccgttaggacgggacaccgggtcctagttacgttaacgttacgttggtacgaccgttaggttcgtttaggttagggtacgtttggtacccgtaccgttaacgtttaacgttacgttttttacgtaccggtaccgaacccggg

SEQ ID NO: 10219 - DNA, 763 bp, Homo sapiens
  misc_feature: GYAE6OF02JEC3Y.53.73.G07.1.454.CMB.1.raw
  modified_base (219)..(219): a, c, t, g, unknown or other
  misc_feature (219)..(219): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgactcccaggtgcagctggtacaagtcggggctgagatgaagaagccgtggggacctnactagtgtacttgtacttaccgtagacgtaacgtactatacgtacgtaactaccgtaccttaccgtaaccgtacctaccgttaactaacgtacgttacggtaacgtacgtacggtacccgtaggaaccgtacggggtacgttacggaacggttacggtaacgttacgggtaaccgtaaacggttaccgtaaaccgttaggtaacgggttaacggtaacgttaccgtaaacgtaacgttaaccgtaacgtaacgtaacggtaacgtaaacgtacggaacgtaacgggtaaccgtaaacgtaaccgaagtacgaaccgtaacggtaaccgtaacgtaaccgtaaccgtaacgtaacgtaacgaacgtaacgtaacggtaaggtacggtaacgtacgaacgtacgaacggtacgaggtaacgtacgtacggtaacggaccgtaacgaacggtacgtaacggttactaacgttacgtacggtacgtaacgtagttacgtaacgtacgtaacgttacgtaacgttaacgtacttacggtacgtagtacg

SEQ ID NO: 10220 - DNA, 633 bp, Homo sapiens
  misc_feature: GYAE6OF02JG8OU.53.73.G07.1.454.CMB.1.raw
  modified_base (550)..(550): a, c, t, g, unknown or other
  misc_feature (550)..(550): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtaacaagtcgggggctggagtagtgaagaacgccgtggggcctcgagtgatgtactttcctgcacgacatctaggactacctaccttaccaccgtaccttccccgttaatacctagtttagggtaaccacgaaccggcccccgtgggaacgtacgggggtccttggacggtggtacgttgggtactaacttacccgaacccgttaggtgggtaggacttacgtaactaacggtttactacgaacgaagaacgtaatcgacgacggggtaccaaacttaccagtacgaccagaacgaccacgtccaacgtacgtaacgacgtctaacgagttcggtaggtgagacacgtccgaggagtatacgtacgagaccncgtcatgtagtacgtgtcgaggtacttacgttaggtcgtaacgttaccgtattaactatttacgtttacgtacgacggtaccg

SEQ ID NO: 10221 - DNA, 682 bp, Homo sapiens
  misc_feature: GYAE6OF02I6KO2.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtccaccgtcacttgccggccagccaaagtattaagcctggttgcctggtatcgagcaagaaaccgaggaacgccctagactctgatactaataagacgtacttacttagacgtaggtcgggtcccaatcgtaaggttcagcggcgaggtggattcgtggacagtagttacactcgtcaacctattacgacacgcctgacgaacggtccctgacttagtactttacggaccttaaacgttactttaacgtacgtaaccctaaactaacggttaacctaaacgtttacgttttacgggtaaccgggttaaccgggtttaacccgggtaccgtaaaaccggggtaaaccgtaaacgggttaaaggtaaaaccgtaaccgtaaaacggttaccgttagggtaccggtaacgtaccgtacccgaaaccgtacgtttccgttaaccggtttaccttaccgtaacccgttcccgtttaccccgaccttaaccg

SEQ ID NO: 10222 - DNA, 864 bp, Homo sapiens
  misc_feature: GYAE6OF02G9N9J.53.73.G07.1.454.CMB.1.raw
  modified_base (191)..(191): a, c, t, g, unknown or other
  misc_feature (191)..(191): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcgganacagagtcaccgtcacgttcggcccgggcacgaccaaagtacttaacgaccctgggttcggccttggtatcgagacgaacggaaaaccgaagggaaacgcccccgtaagaccttacccgtagtaacttacgtaaagtaaacggtaccgttaccttaacgttttaaggaaccgtagggttccggggttaaccccagttaccgtaaacggggttcaacgggtaccgggtacaaggttcgggaacgtttaccggttagggggaacctaaggtaacggtttaccaaccgttaccgtacccgaaccgtaagtttaaccggcctaaccggtcccgttacggacgtaaccggtacccgtagttacggttacgttaacgttttacggaaccttaaaccgttttaaacgtttaacgtacccgtaaccctaaaacgttaacgtaaacctttaaacgtttaacgttttacgggttacgggttaacccgggtttacccgggaaaccggtaaacgggggtaaacccgtttaaacggggttaaaggtaaaaaccgttaaccggaaaaacgggtttaacccgtacgggttaacgggtaccgtaacggtaacccgtaacccgttaccgttaccggttacgtttaccgtttaccgtaaccgtttccccgttaccccgacccgtttaaccg

SEQ ID NO: 10223 - DNA, 660 bp, Homo sapiens
  misc_feature: GYAE6OF02ISKIH.53.73.G07.1.454.CMB.1.raw
tcagcgcgtatacacacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcgccgggcagaccaaagtattaagacctgggtggcctggtatcagcaagaaaaccgaaggggaaacgcccctagacctacctgactctaataagacgttctactttagacgaggtcgggtccatacgtaagttcaggcggcagtggatcgtagggacagacgttcactctacaccagttagcacgcctgacagcctagattgtatttcgactaactttattacacgtaccaaactacgttactaaacgtttcgttttggtacgggtaaccgtttaccgggaacccgtaacgggggtaacccgtaaaggggttaacggtaaaaacgttacccggaaaacgttaaccggttacggtacgggtacccgttacggacccgtaaaccccgtagtttaccggttaccggtttactttacccgtaacgtttccccgtttacccccgacccgtttaacg

SEQ ID NO: 10224 - DNA, 777 bp, Homo sapiens
  misc_feature: GYAE6OF02H2XNC.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggacaagtcggggctgagatagaagacgccgtgggcctcgagtgatgtactttccgngcacgactatcgtaggactaccaccttcgaccgtactccgttatacgtagttcgggtacacgtccggccccgtagggaacgacggggtcttaggaggtggtagttacggggtacttaacgtaccgtaaaccgttaggttgggtagtaacttaccgttaaacgtaagttttacctaacgaacgaaggtaaacggaacgttcggacggtaacggggtaaccttaaacgttaacccgtaacgtacgaaaccgacggtaacgtaacccgtaacccggtaccgtaaacggtaacgttaaccgtacggtaacgttaacggtaacggttaggggtaacgggttacggaaccgtaccgaccggtaccgtacgggtaacttacggtaccggtagggaaccggaacccgtaccgggtaacccttaaggttacgtttacgtacgttacggacgttaccggtacgtttcggttaacggtaaggttaaccgttaaccggttaacttaaccgtttaaacgttttacggttttaccgtaccggtaccgttaaccccggg

SEQ ID NO: 10225 - DNA, 908 bp, Homo sapiens
  misc_feature: GYAE6OF02I6CTP.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctgggaggtcttctgcttgctgtcaggtagctccgaggtgctcgctccaggtgcagctggtacaagtcggggtctagacgataggaaacggacgccggtcggggcctacgaggttcgaagtcggtacttttcccgagtaccgtaacgtactaattccgtaggtactacctaccttccgtaacccgtaccttacccgttaactacgtagttacggtaacgtaccgaccggtccccgtaggaccgtaggggtaccttaggaggttcggtacgttgggggtaaccttaacgttacccgaaaccgttaggttacgggttacggtatttacccgtaacgttaacgttaaccgttccaacggtaagaacggtaacgttaccgacgggtaaaccggggtaacccgtttaaacgttaaccgaacggttaacggtaacccgaaaggtaacccgaaccccgggtaaacccgttacccggtaaccggtaaacgggtacccaacgggtttaaccccgtaaccgtaaggggttaaacggtaaccggggtacggtaacgtccggtaaccggttaacccgtaacggggtaacgttaaccgtccgggtaaaccggtaccggggtaaacccgtaccccgggtaacgttaacccggtttaaagttaccgttttaacccgtacgggttaccggttaaccggtaatttaacgggtttaccgggtaaaggtttaaaccgtttacccggaaacgtttaaccgttaaacgttttaacggttttacccgtaaggttaacccggtaaccccggg

SEQ ID NO: 10226 - DNA, 596 bp, Homo sapiens
  misc_feature: GYAE6OF02GW9W4.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcgccgggccagccaaagtattaacgacctgggtcgcctggtatcagcagaaaccgagggaaacgcccctagactctgatctaataagacgtctacttagacgtaggtcggggtccagtctaaggttcagcggcaggtggatcgtgggacagtacgttcactctacactagtagcacgcctagcacgtcctagtagttgtatttcgacttaactttattacgtctaacctaactagtaactaattacgtttggtacggttacggttaccgggaccgtaaacgggaccgtaaagggtacggaaaccgttacgaaaaccggtacgttaggtacgggactcgaccaccgtacttcttacgttcttacctaccgtttccgttcccgtctaccg

SEQ ID NO: 10227 - DNA, 726 bp, Homo sapiens
  misc_feature: GYAE6OF02GMVRE.53.73.G07.1.454.CMB.1.raw
  modified_base (230)..(230): a, c, t, g, unknown or other
  misc_feature (230)..(230): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtggggcctcagtgatgatttccngcacgacatcgtggataccaccttccaccgtaccttcccttaatactagttcgggtacgacacggtcccctgggacgaggggtcttaggaggtggagttgggtacttaacgtaccgtaacccgttaggtcggtaggacttaccgtaaacgtaaacgtttacctaccgaacgaaggaacgtaagtcggaccgaaacgggggtacccgtaaatttaacccgaagttaccggaaacccgaaggaaccgtaaccgtaacccggtacccgaaacggtaacgtaaccgtaacgttcctaacgaggttacgggagggttggaacgtacgtacgtaccggtaggaacgtacgttacggtagggaaacggaccgaccggtacccgtagttacgttaactttacggttaggtcgtacgttacgtttacggtttaaggtacggttaaccttaaccggttaacttaacgttaagttttacgttttaccgtaccgtaccggtaacccgg

SEQ ID NO: 10228 - DNA, 740 bp, Homo sapiens
  misc_feature: GYAE6OF02GR79N.53.73.G07.1.454.CMB.1.raw
  modified_base (238)..(238): a, c, t, g, unknown or other
  misc_feature (238)..(238): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctccgctcccgaggtgcagctggtacagtcggggctgagagtagaagacgccgtgggcctcgagtgtagtgtactttccgngaccacgactagtcgtaggactaccaccttccgacccgtaccttaccttaagtactaggttacgggtaccacgaccggtccccgtaggaaccggtaggggtcgttaggaggttaggtaggttacgggtaccttaacgtacccgttaaacccggttggtacggttaggtaccttacgtaacgttaacgttaacaccgaagagtaagtagtacggacgtacggaacctaacttaccgagtaccgaacgaacgacgtaccgaccgtaccgaacgtaactaccgtagtactaacgtaggtcggaacggtagacgtacgtacgtaccggtagaacggtacgtacggtaacggaccggaacggtacccgtaacttacggttacgttaaccgttaggttacggtacggtaacgggtttacttaaggtttaaccgggttaccgttaacgttaaccgttaacgtttaccgttaacggtttaccgttacgttaccggtacggttaacccggg

SEQ ID NO: 10229 - DNA, 743 bp, Homo sapiens
  misc_feature: GYAE6OF02I8F07.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgtatttcctgcacgacatcgtggactaccaccttccaccgtaccttcccttatactagttcgggtaaccgaccacggcccccgtagggaccgagggggccttgggagtgggagtcggggttactaacgtacctaaaccccgtaggttgggtacggtattaccgtaaacttaaacggtttaactaccgaaccgtaaggaagtaacgtacggccgaacggggtacccgtaaaacttacccgaatacggaacccgtaaggaacgtaaccgaacccgtacccgaacggtaacgttaaccgaacgttaccctaagtacggttagggtacgggttagacgccgaccgtccgtaggacgttatcggtaggaaccggaacgtacccggtactaagtttaacgttaacgtttacgttggttacggtaaccgttacgtttaccggtttaaggtacggtttaacggtttaaccgtaaccgtttaaaccttaagttttacgtttttaacggtaccgtacccggtaacccggg

SEQ ID NO: 10230 - DNA, 556 bp, Homo sapiens
  misc_feature: GYAE6OF02GI0L3.53.73.G07.1.454.CMB.1.raw
  modified_base (450)..(450): a, c, t, g, unknown or other
  misc_feature (450)..(450): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcgagtgatgatttcctgcacgacatctggatacaccttcaccgactcccttatacattcgggtacgacacggcccctggacaggggcttggagtggatgggtctaatcaaccgtagtggtggatctacaagttactcacagagaatgacgagggaccgaattaccatcgaccaggacgacaccgtccaacgacgtaacagtctacagttggaggttgagcgagcctagagactcgngacggacaccggcctaagtgtattacgtgtgtacgtatttacgttaggttacggtaatttaaccgaacttaacgtaatttagtttttacgtaccgagtaaccccgg

SEQ ID NO: 10231 - DNA, 594 bp, Homo sapiens
  misc_feature: GYAE6OF02HVF8U.53.73.G07.1.454.CMB.1.raw
  modified_base (236)..(236): a, c, t, g, unknown or other
  misc_feature (236)..(236): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaaagaagccgtggggcctcgagtgatgtactttccngcacgacatcgtggactacaccttcaccgtacctcccttatacagttcgggtacgacacggcccctaggacgtaggggcttggaggtggagtgggtactaagtaccaaccgttaggtggtagatacgtaactaagttactacacgaagaagaagtgacgacgggaccgtaacttaaccagtacgaaccaagagaaccacgtccgaacgtacgtaacacgtctaacaggtaggaggtgacgcgagcgtagtagatcgtagaacggaccgtccggactagttagttacttacgtgtcgagtaattcgttaaggtgtaactttaccgattaacgtaatttcttttacgacgtacgtacccg

SEQ ID NO: 10232 - DNA, 700 bp, Homo sapiens
  misc_feature: GYAE6OF02F4KS7.53.73.G07.1.454.CMB.1.raw
  modified_base (276)..(276): a, c, t, g, unknown or other
  misc_feature (276)..(276): n is a, c, g, or t
tcagcgcgtatacacacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcggccggccagaccaaagtattaagaccttggttcggcctggtatcagcaagaaaccgagggaaacncccctagacctcctagactctaataacgacgtactacgttagactaggtcggggtaccacgtacgtaaggttcgaggcggcgaggtaggactcgtagggacaggtacgttcactctacctaacctagttacgactacgtcctacgacgtacgtacctaggtagttacgttactttacgaccttaaactttacgttaaccttacgaaaccctaaacgtaacgtttaaactaacgttttaacgtttacgggtaccgggttacccggttaaccgggaacccggtaaaccggggtaaccggtaaaagggttaacggaaaaacgtaccgtaaaaccgttacgttcgggtaacggtaccgtacgaacccgtaaccgtacgttccgttacgttaccttacctaaccgtttccccttacccgaccttaaccg

SEQ ID NO: 10233 - DNA, 512 bp, Homo sapiens
  misc_feature: GYAE6OF02F05YB.53.73.G07.1.454.CMB.1.raw
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
  modified_base (466)..(466): a, c, t, g, unknown or other
  misc_feature (466)..(466): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagagcctggggcctcagtgatgatttcctgcacgacatctggatacaccttcaccgactccttatacattgggtacgacacggcccctggacaggggcttggagtggatgggtctaatcaacctagtgtggatcanagttactcanaganatgcacggcaattaccatcgaccagacgacacgtccacgagtacagtacacattggagtgagcagcctgagatcgtaggaggaccgacggcagttgtaattcgtagtgacgtaattnttaggtgtattacgacttaactaagtttatttcgtacacgtacccg

SEQ ID NO: 10234 - DNA, 673 bp, Homo sapiens
  misc_feature: GYAE6OF02J1BTF.53.73.G07.1.454.CMB.1.raw
  modified_base (611)..(611): a, c, t, g, unknown or other
  misc_feature (611)..(611): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctcaggtgctcgcctccaggtgcagctggtacagtcggggctgagatgaagacgccgtgggcctcaggtgatgtactttcctgccacgacacttcgtaggtactaccgtaccttccaccgtaccttcccttaactacaggtttcgggtaccgacgtaccggtccccgtagggtaccgaggggtcttacggaaggtcggtaagttcggggtactaacgtaccgtaacccgtaaggtcgggtagtacgtacctaacgttaaacgttccttacgaacgaacgtagaactacggacgtacggggtaccctaaagttaccagtacggaaccgaaggtaacgaacctacccggtaccgtaaacggtaacggtactaacggttaccgtaacggacggttgggaaggttcggacgaccgtagaccgtagacgtagtcgtaggacggacgaccggctagtgttacttcgagngtacgagtttcgtaggtgttaacgtactacgttactaagtttattacggtacgtacgtacgg

SEQ ID NO: 10235 - DNA, 576 bp, Homo sapiens
  misc_feature: GYAE6OF02F1TJC.53.73.G07.1.454.CMB.1.raw
  modified_base (412)..(412): a, c, t, g, unknown or other
  misc_feature (412)..(412): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctgggttggcctggtatcagcagaaaccagggaaagcccctagactcctgatctataagacgtctactttagacagtcggggtcccatcaaggttcagcggcagtgtatcgtgggacagacgttcactctcacattacgcagcctgcagcctgatgtatttgacctaactttattactnacctaacacgtactaacttactttaggtcggtacggttcggaccgtaaacgggacccgaaagggtacggaaactacgaaaaccgtacgtaggtacgggtctacggcctaaccgtacgttccgttcgttaccgtttaccttattcccgtttaccccgcctaaccg

SEQ ID NO: 10236 - DNA, 775 bp, Homo sapiens
  misc_feature: GYAE6OF02HUNX0.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccagatgacccagtctccttccaccctgtctgcatctgtcggagacagagtcaccgtcacttggccggtcagaccaaaagtattaacgaccgtggttgcctggtatcgagcaagaaaaccgagggaaacgccctaagtacctcctagaacttctaagtaacgtacgttacttaacgtttacgacgtacgggttacgggtaccctattacgtaacggttcgaggtccggacgtaaggtcgggtaacttcggtagggaactaaggtacgttaccaacgttctaccgtaaccgtaagtttacgacgtaacgccttacggtacaacggtccgtagtacgttacggtttaagtttcgaacccttaaagtttaacgtttaaacgtaccggtaaccctaaaacgttaacgtaaacctttaaacgttttaacgttttacggttacggggtaacccggttttacgggaaacccggttaaaggggtaaaccccgttaaagggggttaaacggaaaacttaaccggaaaacggttaacggttcggtaccgggtaccgttaaccggacccgtaaccgtaacggtttccttaacgggttccctttaacgtacccgtttcccggttaccccgtacttaacgg

SEQ ID NO: 10237 - DNA, 176 bp, Homo sapiens
  misc_feature: GYAE6OF02GYSEB.53.73.G07.1.454.CMB.1.raw
  modified_base (163)..(176): a, c, t, g, unknown or other
  misc_feature (163)..(176): n is a, c, g, or t
tcagcgcgtatacacacgaccggtgctcgatttagctctacgctcagggcacgaccggtgctcgatttagtcacgcgagaaagggaaagggggctggccctgacgtgtttctgttcccgccctcctctcgtactgcgctgagcgggctggcaaggcgcatagnnnnnnnnnnnnnn

SEQ ID NO: 10238 - DNA, 659 bp, Homo sapiens
  misc_feature: GYAE6OF02HN1F8.53.73.G07.1.454.CMB.1.raw
  modified_base (426)..(426): a, c, t, g, unknown or other
  misc_feature (426)..(426): n is a, c, g, or t
tcagcgcgtatacacacgaccggtgctcgatttagctctacgctcgagggggatcatcccaacaacctacgatccccttctcttacagaagcctctgagaggaaagttctcaccatggactggacctggagggtcttcgtgcttgctggttcagtacgctcaggtgtactcgctccaggtgcagctggtacaagtcgggggctggagatggaaagacgccgtggggcctcgagtgatgtagtttcctgtcgagtcaattcgtaggtaacttacgaccttcaccgtactcccgttatacctagttcggggtaacacgagggccccgttggaccgagggggtcttggacgttggaagttcgggtctaacgtcgtaaccgtagtcgggtaggaactcgtacgaacgttactacgaagtacggagtaacncgactacgggaccgtaaagtaccaagtacgaacaaggtacgaccgtacgtaccaaggacgtaaacgacgttacaccgtaaggtacggaaggtcgaacgtcgaacgtaccgtaggtacgacgtacctggaacggtaacgcgggtaaccagtagttataccggtagtcgtacggattacgttagtggaactttaacgacttaccgaagttttacgtttcgtacgacggtaaccgg

SEQ ID NO: 10239 - DNA, 748 bp, Homo sapiens
  misc_feature: GYAE6OF02FNKAG.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatagaagaagccgtcggggcctcgagtgatgactttcctgcacgacatcgtggataccaccttaccacccgtaccttcccttatacgtacgttgggtaccgacgaccgggcccctgggaccgtaggggtcttaggacggtgggtagttacggggtaccttaaagttacccaaaccccgttagggttagggtagggtacttacgtaacgtaacgtttacctactaacgacggtaagaacgtacgaccgacggggtaccctaaacgtttaaccgagtaccgaaccgtaacggtacgaaccgtaccggtacccgaacggtaacgtaaccgtaacggttccgttaacgaacggttgggaacgggttggaacggtcccgtaagggtacccgttaggaacggtacgttacggtacggaaacgggaaccggtaccgggtaccaagttttacggtaacgttttaccgtgggtacgtacggtaactttacgtttacgggtacggttaacgttaacccgtattaaaccgttaagtttacgtttacgtaccgtcgtaaccccgg

SEQ ID NO: 10240 - DNA, 635 bp, Homo sapiens
  misc_feature: GYAE6OF02JQLLJ.53.73.G07.1.454.CMB.1.raw
  modified_base (240)..(240): a, c, t, g, unknown or other
  misc_feature (240)..(240): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
  modified_base (335)..(335): a, c, t, g, unknown or other
  misc_feature (335)..(335): n is a, c, g, or t
  modified_base (374)..(374): a, c, t, g, unknown or other
  misc_feature (374)..(374): n is a, c, g, or t
  modified_base (409)..(409): a, c, t, g, unknown or other
  misc_feature (409)..(409): n is a, c, g, or t
  modified_base (415)..(415): a, c, t, g, unknown or other
  misc_feature (415)..(415): n is a, c, g, or t
tcagcgcgtatacacacgaccggtgctcgatttagctctacgctcaggggaggtcagacccagtcaggacacagcatggacatgagggtccccgctcacgctccgtgggctcctgctgctctggcctcccaggtcgaccaatgtgacatccagatcgacccagtcctcccttaccacccttgtcctgctatctgtcggagacagcgtcaccgtctacgttcgccgggcacgccaaaagtntaacgcctggttcgcctgtncgancagaacgaaggaacgacccctagccactgactctagtatacggttactacttacgactaggtcgggtaccncgttacgagttacgagcggtcaggtgacgtcgtcggtanaggtctcacttcactacctagtactcacgctagcncgtcgngatgttagttcacgttactacttcgtacactacgtaacgtacagtttacgtaggttacggttccgttaggaaccccggtaaggtaaccggtaaggtaacgtaacgtaaccggaacgttacgtacgggttaccggtacgtaccgtaacgtacccgtaaacgttccgtttacggtaactttcccgttaaccgtttacccgtttaccccggtacctttaccgg

SEQ ID NO: 10241 - DNA, 704 bp, Homo sapiens
  misc_feature: GYAE6OF02H2KSW.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccaagatgacccagtcctccttccaccctgtctgcatctgtacggagacagagtccaccgtcacgttcggccggccaagaccctaaaagttattaacggaccttggttcggccgttaggtactcgaagacaacgaaaccgacgggaaaccgtcccctaagtacctcgtagatactaataacggtacgttacttaacgtttacgacgtacggttcgggtaccctatacgtaagttacgagcggcaggtgactcggtaggacgagtacgttcacctcgtaccacgtatacgcacgtcctgcacgttctagtagttgtactttgaacttaactttagttacctacgtaacctaaattacgtaacctaactttacgtttacgggtacgggtaaccgttttaccgggaacccgtaaaacgggtacccgtaaaaggggttaacgtaaaacccgttaacgtaaaccgtacgtttacgggaccggtacctaccggtacctaacccgtacgttaccgtttcgtaacctttccgtaaccgtttcccctttaccccggaaccttaacg

SEQ ID NO: 10242 - DNA, 736 bp, Homo sapiens
  misc_feature: GYAE6OF02IPKIY.53.73.G07.1.454.CMB.1.raw
  modified_base (355)..(355): a, c, t, g, unknown or other
  misc_feature (355)..(355): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatgacccagtctccttccaccctgtctgcatctgtcggagacagacgtctaccgtcacgttgccgggccagaccaaagtataagcctggtcgcctggtatcagcaagaaccgagggaacgcccctagacctcctgatactaataagtaccgttagtacttagacgtaggtcggggtaccctagtcgtaacggttcacggtaccggngtagttaggagtcgtacggggactaggtacgtttaccgtacttaccgtactaacctagtttacgaccgtacggtcccttacggacctaggtccctagtaacgttgttaacgttttacgaaccgttaactttaactttaacgtaccgtaaccctaaacgttacgttaaacctaacgttttaacgtttcggtacgggtttaacccgggttacccggaaccgggtaaacgggtacccggttaaaaggggttacgtaaaaaccttacggaaaaccggttacgtacgggttaccggtacgttaaccggacctaacccgtagtttaccgtttccggtttaaccgtttaccgtaaccgtttcccggtttacccccgacgtttaacccg

SEQ ID NO: 10243 - DNA, 646 bp, Homo sapiens
  misc_feature: GYAE6OF02H8FW2.53.73.G07.1.454.CMB.1.raw
  modified_base (241)..(241): a, c, t, g, unknown or other
  misc_feature (241)..(241): n is a, c, g, or t
  modified_base (245)..(245): a, c, t, g, unknown or other
  misc_feature (245)..(245): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagcgtaggtacaagtcgggggctgagatgaagagccgtgggcctcgagtgatgtatttcctgacacacnttcnggactacaccttcaccgtactcccttaatacagttacgggtacacgacggccccgtagggacgtacggggtcttaggagtagggagttcgggtacctaactaccgtaaaccgttaggtgggtagtacttactaacgtaagtttactacaacgtaagaagaagtcgacgacgggacctaagttacacgtcgacgagaacgacgtacgtaccgaagagtacacgttactacgaggtacgggtagtcggagtacgaggtcctagaacgtagttcgtaggacgggaaccgaccggtacctagttagttagttacgtgtacgtacggtacgtttacgttaagggtagttaccgtaacggttacttaaacgttagtttaacgttttacgtaccgtacggttacccgg

SEQ ID NO: 10244 - DNA, 681 bp, Homo sapiens
  misc_feature: GYAE6OF02JJ4YL.53.73.G07.1.454.CMB.1.raw
  modified_base (196)..(196): a, c, t, g, unknown or other
  misc_feature (196)..(196): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagntgaagaagccgtgggcctcagtgatgtatttcctgcacgacatctggataccaccttcacccgtaccttccttatacctagttcgggtaacgacgtcggcccccgtaggacgacggggtcttaggtagtggagtgggtactaagtcctaaacccgtaggtcggtaggtactccgtaactaacggtttactacgaaccgtaaggaacgtagtacggtaccgaacggggtacctaagtaacctagtacgaaccgaagggacgtaccgaacccgtaccgaacgtaagtaactacggttactaacgagtggtaggtcgtagactagccgtgtacgagttctagggaaccgacgtacccgacgtaagtttacggtaactttaccgttgtcggtaacgttaagttaggtttaacgggttagttaaacgtttaaccgttaaccggttaagttaaacgttttaacgttttcggaccgttaaccggtaacccgg

SEQ ID NO: 10245 - DNA, 565 bp, Homo sapiens
  misc_feature: GYAE6OF02JFW0T.53.73.G07.1.454.CMB.1.raw
  modified_base (232)..(232): a, c, t, g, unknown or other
  misc_feature (232)..(232): n is a, c, g, or t
  modified_base (424)..(424): a, c, t, g, unknown or other
  misc_feature (424)..(424): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgatttccngcacgacatctgatacacttccaccgactcccttatacagttcgggtacgacacggccccgtaggacgtaggggcttggaggtggagtgggtactaatcaacccgtgtggtgatctactagttactcaacagaagagtgacgacgggaccaacttacatcgacagacgacacgtaccacgagtacagtctanagtaggaggtagagacgcgctagagtatcgagacgacgaccgacagttagtacttagtgtacggacgttattacgttaggtagtaacgtttaacgtaaccttaacgtaagtttttttacgttacgtacgtaccgtaaccgg

SEQ ID NO: 10246 - DNA, 861 bp, Homo sapiens
  misc_feature: GYAE6OF02GA825.53.73.G07.1.454.CMB.1.raw
  modified_base (230)..(230): a, c, t, g, unknown or other
  misc_feature (230)..(230): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaagccgtgggcctcagtgatgactttccngcacgacatcgtggactaccaccttccaccgtacttacccttatactagttcgggtacgacacggcccctggaccgaggggtcttggaggtggagttcggggtacttaaacgtaccaacccgttaggtgggtagggtacttaccgtaacgtaaacgtttacctactaacgaaggtaacgtaaacgtacggaaccgtaacgggggaacccgttaaaagtttaaccccgaagttaccggaaacccgaaacggaaccggtaaaccgtaacccggtacccgtaaaccggtaaacggttaaacccgtaacggttaacccgttaaaccgtaacggttacgggggtaaacggggttacggaaaccgggtaccgaaccggttacccggttaacgggtaacgggtaaccgtttaccgggttaacggggaaaccgggtaacccggtaaacccggggtaaccccgtaacggtttaacggtttaacgtttaaccgttacgggttacgggtaccggtttaacgttttaaaccggttttaacggggttaacgggtttaaacgttttaaaccggtaaacccgttttaaacttaaaaggtttttaaccgttttttacggtaccggttaaccccggttaaccccgggg

SEQ ID NO: 10247 - DNA, 544 bp, Homo sapiens
  misc_feature: GYAE6OF02HOPPF.53.73.G07.1.454.CMB.1.raw
  modified_base (345)..(345): a, c, t, g, unknown or other
  misc_feature (345)..(345): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagagcctggggcctcagtgatgatttcctgcacgacatctggatacaccttcaccgactcccttatactagttgggtacacaggcccctggacgagggcttggagtggatgggtactaatcaacctagtggtgatctacagttacncacagagaatgcgagggccgaattaccatacgaccaagacgacacgtaccacgagtacagtctacgagtgggagtgagcgagccgtagagagtcgtaggacggacgacggcctagtcgttattacgtgtgtcgtaattcgttaggtacggtacttaacggaacttaacgtaatttacgttttacggtactacgtaccgg

SEQ ID NO: 10248 - DNA, 631 bp, Homo sapiens
  misc_feature: GYAE6OF02G7KVB.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgtactttcctgcacgacatcgtaggactacctacccttcaacccgtaccttacccttaatacctagttcgggtaaccgaccgaccggtcccccgtagggaccggacggggtcttggacggttggaagttcggggttactaacgtaccgtaaacccgttaggtgggtaggtacttacgtaactaacgtttactacaacgtagaagtaatcggacgtaacgggtacctaaatttaccaagtcgaccgaagacgacgtacgtaccgaacgtagtacgacgtcacgtagtaggtaggtgagcacgtcgtagagtagtcgtagacggaccgacgcgtatagtattacgtgtcgtgtactcgttaggtgtaacgttacgtacttacttagttacgtttagtacgtacgtaccg

SEQ ID NO: 10249 - DNA, 731 bp, Homo sapiens
  misc_feature: GYAE6OF02G1PGR.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtcctccttccaccctgtctgcatcgtgtcggagacagacgtcacgttctacgttcggccgggaccacgaccgtaaagttattaacgaccgttgggttcggaccgttaggtatacgagacgaagaaaccgagggaacgtccccgtaagaccttcccgtgtactacttaacgtaacgaccgttacttacgtttagaccggtacggttacggggtacccagttacgaaggttacgacggtacggactaggttgagtcgtagggaaccgtagtacgttcgacttccctaccgtaaccgttagttacggacctaacggtcctacggaccacggtccgtaggtaacgttgtttacgtttacgtaacttaaaccttttaagttaaccgtcgaacccgaagttaaccgttaactacgtttacggttttacggtacggttccgggtttaaccgggaccggtaaccgggtaaccgaacggggtaaacgtaaccaacgtaaaccggtacgttacgtcgggtactacgacgtaaccgtcgttcttacgttcgttaccctacgtttccctaccgtaccttacgg

SEQ ID NO: 10250 - DNA, 593 bp, Homo sapiens
  misc_feature: GYAE6OF02GMSWP.53.73.G07.1.454.CMB.1.raw
  modified_base (388)..(388): a, c, t, g, unknown or other
  misc_feature (388)..(388): n is a, c, g, or t
  modified_base (524)..(524): a, c, t, g, unknown or other
  misc_feature (524)..(524): n is a, c, g, or t
tcagcgcgtatacacacgaccggtgctcgatttagctctacgctcagggggatcatccaacaaccacatcccttctctacagaagcctctgaggaggaaagttcttcaccatggactggacctggagggtcttctgcttgctgtcagtagctccaggtgctcgctcccaggtcgcagctggtacgaagtcgggggctggagatggaagaacgccgtgggggcctcgagtagatgtactttcctgccacgacatcgtggatacaccttcaccgacctcccttatacagttagggtacgacacggcccctagggacgaggggtcgttgaggtggagtggggtactaacgtccgtaaaccgtaggtggtaggacttactaataacgttacnaacaggaagaatggcgaggggacctaagtaccagtgaaccgagacgacacggacccaggactacgagtactacgagttggaggtgagcacgtcgagtaacgatgtagacggacgaaccggtcagtgtattacgtgngtacgacgttactttacggagtactttaaccggacttaacgaaatttctttaggtacgtataacccggg

SEQ ID NO: 10251 - DNA, 618 bp, Homo sapiens
  misc_feature: GYAE6OF02IBNYA.53.73.G07.1.454.CMB.1.raw
  modified_base (349)..(349): a, c, t, g, unknown or other
  misc_feature (349)..(349): n is a, c, g, or t
  modified_base (424)..(424): a, c, t, g, unknown or other
  misc_feature (424)..(424): n is a, c, g, or t
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgctcccgaggtgcagcgtggtacaagtcgggggctggagataggaagaagccgtggggcctcgagttgatgtactttcctgccacgacagtcgtggataccaccttcaccgtactacccttatactagttcgggtacgacgaccggccccgtggaacgacggggtcttggacggtggagttacgggtntaaacgtacctaacccgtaggtgggtagactactaacgtaacgtactcaacagagatcgagacgggactaatacngtagaccagaacgacaccgtaccagaacgtagactacgacgtaggtgggagtgacgcgacgccgtaggacgtatacgtagaaccggaccgacggacctacgttagttacttacgtgtacggagttaacgtacgtttaggtacggtaacttaccgtaactaacgtttactttaagtttcgtaccagtaacccggg

SEQ ID NO: 10252 - DNA, 688 bp, Homo sapiens
  misc_feature: GYAE6OF02HCXK6.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatgacccagtctcccttccaccctgtctgcatctgtcggagacagagtcaccgtcacttggccgggcagaccaaagttattaacgaccgttggttcggccgtggtatcgagacaacgaaaccgagggaaaccgccccgtaagaccttccgtagtactacttaagtaacgtacgttacttacgtttagacgtagggtcggggtaccctaagtaccgtaagggttccgaacggcggtaccgtaggtacggtaacgtcggtacgggaactaggtacgttccactcctacactattacgcacgcctcgcgacgtcctgtagttgttatttacgacttaactttattacctacgtacctaagtaacgttaactaacgttacgtttggtacgggtaccggtttacggaccgtaacggggaccgtaaagggttacgaaacgtaacgaacggttacgttggtaccggtacgtacggtacccaaccgttagttaccgttaccgttactttacccgttacctttccccggtttaccccgtaccttaccg

SEQ ID NO: 10253 - DNA, 667 bp, Homo sapiens
  misc_feature: GYAE6OF02FZB4Y.53.73.G07.1.454.CMB.1.raw
  modified_base (280)..(280): a, c, t, g, unknown or other
  misc_feature (280)..(280): n is a, c, g, or t
  modified_base (353)..(353): a, c, t, g, unknown or other
  misc_feature (353)..(353): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagacagagtcaccgtcacttggccgggccagaccaaagtattaagcctggttggcctggtatcagcaagaaaccgagggaaacgcccctanactcctgatctagtaagacgtacttactttagacgtaggtcggggtccatcaaggttcagcggacgagtaggntcgtagggactagagttcctactctactacctattacgacctagccgtagccagtccgtagtagtgttacgtttacgtacttaacgtttaattaccgtacgaccctaaagtagtaaaccttacgtttacgtttacgggttacgggttaccgggttacccgggtaaccgtaaacgggggtaaccctaaagggttacggtaaaaccttaaaccgaaaccgtacgggttggacgggttcccgtacgaaccggtaccttacgtttccgttaccgtttcctttacttaacccgtcccttttacccccgagttaaccccg

SEQ ID NO: 10254 - DNA, 564 bp, Homo sapiens
  misc_feature: GYAE6OF02H1IPU.53.73.G07.1.454.CMB.1.raw
  modified_base (361)..(361): a, c, t, g, unknown or other
  misc_feature (361)..(361): n is a, c, g, or t
  modified_base (423)..(423): a, c, t, g, unknown or other
  misc_feature (423)..(423): n is a, c, g, or t
  modified_base (448)..(448): a, c, t, g, unknown or other
  misc_feature (448)..(448): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtgggcctcgagtgatgatttcctgcacgacatctggactacaccttcaccgtactcccttatacagtttcgggtacgacacggccccgtaggaccgaggggtcttggagtgggacttgggtactaactaccaacctgtggtgatctatattacncacagagaatgacagggcctaattacatacgacagacgacaccgtcaacgagtacagtctanagtggagtgagacagcctgacgtanccgtagaacggaccgacggtacctagtcgtaagtttcgtgtacgtcggtacttcgttaaggtcgtaacgttaccgtacgtaacttaagttaagttttcggaccgtacgtaacccgg

SEQ ID NO: 10255 - DNA, 823 bp, Homo sapiens
  misc_feature: GYAE6OF02H5Z71.53.73.G07.1.454.CMB.1.raw
  modified_base (165)..(165): a, c, t, g, unknown or other
  misc_feature (165)..(165): n is a, c, g, or t
tcagcgcgtatacacacgaccggtgctcgatttagctctacgctcgagggggagtcagacccagtcaggacacagcatggacatgagggtccccgctcagctccgtggggctcctgctgctctggcctcccgaggtcaccaaatgtgacatccgagatcgacccngtcctcctccgaccctgtccgctatcgtgcggagacagtacgtaccgaccgtctacgttcggcccgggaccaacgaccgtaaaaggttaacttaacgaccgttgggttacggaccttaggtatccgagaccgaaacggaaaccggaacgggtaaaccgcccccgtaaggtaccttacccgtagtaacttacgtaacgttaacgaccgtttacgttaacgtttacggacggtacgggtacggggttaccccaagttaccgtaacggttccgaaggaccggtaccgtaggttcggtaacgttaccggtaggggaccttaaggtacgtttaccgaccttaccgtaccgtaaccctaagttaaccgctaccggtacctcggaacctacggtaccgttagtacgttaggtttactttacgtaaccgttaaccgttttaaccttaccgtaccggtaaacctaaacgtaaccgttaactaaccgttttaccgtttgggttaacccggttaccgggtttacccgggaaacgggtaaccgggtaaccgtaaacgggttacgggaaaccttaaaccgtaaaccgtaagttcggtacggaccgtacgaccgtaactacggttaccttcggttactacctaccggttcccctacccggtctacgttacgg

SEQ ID NO: 10256 - DNA, 624 bp, Homo sapiens
  misc_feature: GYAE6OF02GQWEY.53.73.G07.1.454.CMB.1.raw
tcagcgcgtatacacacgaccggtgctcgatttagctctacgctcaggggagtcatccaacaaccacactcccttctctacagaagcctctgagaggaaagttcttcaccatggactggacctggagggtcttctgcttgctgtcagtagctccaggtgctcgctcccaggtgcagctggtacaagtcggggctgagatgaagaagccgtggggcctcagtgatgatttcctgcacgacatctggatacaccttcaccgacctcccttatacagttgggtacacacggcccctggacgaggggcttaggagtggagtgggtactaataccgtaaccctaggtggtggattctaacgtaagtttactacacgagagaactggaccgacgggacctaacttaccagtacgaccaagacgacaccgtaccacgagtactagtcactagtggacggtgagaccgagccgtagagtacgtacgtaggaacggaaccgtaccgggacctaagttacgttaacgtttaaccgtggttaccggacgttaacggtttaccgtttaaggtacggttaaacttacccggttaaacttaacgtaattttacgtttaggtaccctacgggtaacccg

SEQ ID NO: 10257 - DNA, 861 bp, Homo sapiens
  misc_feature: GYAE6OF02IK3QC.53.73.G07.1.454.CMB.1.raw
  modified_base (227)..(227): a, c, t, g, unknown or other
  misc_feature (227)..(227): n is a, c, g, or t
  modified_base (243)..(243): a, c, t, g, unknown or other
  misc_feature (243)..(243): n is a, c, g, or t
tcagcgcgtatacacacgaccggtgctcgatttagctctacgctcaggggatcatccaacaaccacatcccttctctacagaagcctctgagaggaaagttcttcaccatggactggacctggaggtcttctgtcttgctgtcgagtacgctccgaggtgctcgctcccgaggtcgcgagcgtaggtacgaaggtcggggctgagatagaacgagccgtgggcctgngtagagtgtacttcgngcacgacactcgtagtactacctaccgtacacccgttaccttacccgttaacgttaccggtaggttaccggtaccgtaaccggtacccggtaccccggtagggaccggttacggggttaccgttagggtacgggtacggtacggtttacggttaaccgtaaaccgttaccgtaacccgggttaggggttacggttacggtaaccgttaaccgttaaccgttaaaccgtttaccgtaaccgtacggtaacgtaaggtaaccggtacggtaaccggtaacggtaacctttaaacgtacccgtagtaaccgaccgtaggtaaaccgtacccggttaaccgtaacccggttaacggtaaccgtaaccgtaacgttacgtaacggttagggttaacgggtacggtacgtacgggtaccggtaccgtaccggtaaggtacgttaaccgttaccggtaacgggaacccgggttaacccgtaacggttaaccgtaaggttttaaccgttaagttcgtacggttaccggtacggtttaacggttacggtttaacggtacggttaaacgtttaacggtacccgtttaaacgtttaacgttttccgtaacggtacccgtaacgtacggg

SEQ ID NO: 10258 - DNA, 709 bp, Homo sapiens
  misc_feature: GYAE6OF02HXTRH.53.73.G07.1.454.CMB.1.raw
  modified_base (196)..(196): a, c, t, g, unknown or other
  misc_feature (196)..(196): n is a, c, g, or t
  modified_base (293)..(293): a, c, t, g, unknown or other
  misc_feature (293)..(293): n is a, c, g, or t
tcagcgcgtatacacacgaccggtgctcgatttagctctacgctcgagggggagtcagacccagtcaggacacagcatggacatgaggtccccgctacagctcctggggctcctgctgctctggctcccaggtgaccaaatgtgacatccagatcgacccagtcctccttccacccttgtctgcatctggtcgganacagagtccaccgtcacgttcgccgggccagacctaaaagttattaacgaccgtgggttcggccgtggtactcgaagcgaagaaaccgagggaaacnccccgtagacctcctagatactaagtaagacttcttaactttagacgtacgggttcggggtccctaagttaccgtaacggttcgacggtccggacgtacggtgggacttcggtagggaactacggtacggtttccacgttcctacaacctagttacgctacgtcctcgacctaacggtctaggtagttagttacgtttacgaccttaaacgtttacttaacgttccgaaacccttaaagtaacgtacttaaacgtttcgtttaggtacgggttaccgttacggaccggtaacggggtaaccgttaacgggtaagtaaaacctacgaaacgtaccgttggtacggtctacggaaccctaaccgttactccggttacgttaccgttaccctaccgttttaccccgtctaagttcccgg

SEQ ID NO: 10259 - DNA, 708 bp, Homo sapiens
  misc_feature: GYAE6OF02JGYJ9.53.73.G07.1.454.CMB.1.raw
  modified_base (233)..(233): a, c, t, g, unknown or other
  misc_feature (233)..(233): n is a, c, g, or t
  modified_base (241)..(241): a, c, t, g, unknown or other
  misc_feature (241)..(241): n is a, c, g, or t
  modified_base (339)..(339): a, c, t, g, unknown or other
  misc_feature (339)..(339): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagacgccgtggggcctgagtgagtgactttccngcacgacntcgtggactaccaccttccaccgtaccttcccttaatactagttacgggacaccgacggccccgtaggacgaggggtctggagtggacgtggtactanacctaaccgtggtaggtagactactaacgtaagttacacgacaggagtaagtcgacggacggtacctaattaccgatacgaaccgtaagaccgtaaccgtaccggtaccgaaggtaacgtacgtaacggtaccttaacgtaggttacgggtacggttagggactaccggtacggtcccgtaaggtaacgttaccgtaccggtaacggggacggtaaacccgaccggttaacgtacgttaaggttaccgtttaaggtcggttacggtacccgttaaggtttccggttaaggttacggtaaaccgtttaaaccggtaacgtttaaccgttaagttttaacggttttccgaacccggttaacgtaccccggg

SEQ ID NO: 10260 - DNA, 674 bp, Homo sapiens
  misc_feature: GYAE6OF02FGL7B.53.73.G07.1.454.CMB.1.raw
  modified_base (95)..(95): a, c, t, g, unknown or other
  misc_feature (95)..(95): n is a, c, g, or t
  modified_base (270)..(270): a, c, t, g, unknown or other
  misc_feature (270)..(270): n is a, c, g, or t
  modified_base (283)..(283): a, c, t, g, unknown or other
  misc_feature (283)..(283): n is a, c, g, or t
  modified_base (337)..(337): a, c, t, g, unknown or other
  misc_feature (337)..(337): n is a, c, g, or t
tcagcgcgtatacacacgaccggtgctcgatttagctctacgctcagggggagtcagacccagtcaggacacagcatggacatgagggtccccgntcagctcctggggctcctgctgctctggctcccaggtgccaaatgtgacatccagatgacccagtctccttccaccctgtctgcatctgtcggagacagacgtcaccgtcacgttgccgggccagccaaagtacttaagaccttggtcggcctggtatcagcagaaccaggaacnccctagactcctnactctataagacttctacttagactaggtcgggtcccatcaaggttcagcgganaggtggactcgtagggacagtacgtcactctcaacctagttagctacgcctggactacggtccctaggtattcggttactttacggaccttaaacgtttacttaaccgtacggaacctaaacgtaacgttaaactaacgtttaacgttttcgggtaacgggttacccggtttacgggaaccggtaaaccggggtaacctaaacggggtaacggtaaaaccgtaaccgtaaaaaccggttacgttacgggtaccggttaaccgtcggtaaccctaaccgtacttaccgttacgttaccgtttacctaccgttacccctttacccggtacttaacccgg

SEQ ID NO: 10261 - DNA, 693 bp, Homo sapiens
  misc_feature: GYAE6OF02G11MZ.53.73.G07.1.454.CMB.1.raw
  modified_base (440)..(440): a, c, t, g, unknown or other
  misc_feature (440)..(440): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctccttccacctgtctgcatctgtcggagacagagtccaccgtcacgttcggccgggccacgaccaaaagttagttaacgaccgttggttcggccgtgggtactcgagcaacgaaaccgaagggaaacgccccgtaagactcccgtgatctaataacgacgtacttaacttagacgaggtcgggtcccagtacgtaaggttcaggcggtcgaacgtggacgtcgtagggactaggtactccgtaactccgtaccaacctattaccgacacggtcccgtnaccgtacggccgtgattaggttactttcgaccgttaacttttaagttaccgttccgaaccctaaagtacgtaaactaacgtttacgtttaggtacgggttaacccgttacgggaacccgtaacggggtaaacccggttaagggtaacgtaaaacgtaccgtaaaaccgttacgtcggttacgggtactacgtaacccgacgtacgttaccgttcgttaccttaccgtttacctacccgttcccgtaacttccg

SEQ ID NO: 10262 - DNA, 646 bp, Homo sapiens
  misc_feature: GYAE6OF02IM22G.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccaggtgcagctggtacaagtcgggggctgagatgaagaagccgtggggcctgagtgagtgtactttccgtgcacgacatcgtggactactaccttcacccgtacctcccttatactagtttcgggtacaccgacggtcccctggaccgaggggtcttggagtggagtcggtactaatcaaccgtggtggtgatctaacgtaagttactacagagaagaagtgacgaacgggaccgtaattaccgaagtcgaaccgagacgaaccgaccgtaccaacggtagtaacacgttactaacgaggttcgggaggtacggagacgaggaccgtagagtactacggtaggaacggaccgaccggtcgtaagttcgttaactttacgtggttacggacgttaacggtttacgttaagggttacggttaacgtttaacggtaacttaacgttaagttttacgttttacggtaccgtaccggtaacccgg

SEQ ID NO: 10263 - DNA, 759 bp, Homo sapiens
  misc_feature: GYAE6OF02H8IFK.53.73.G07.1.454.CMB.1.raw
tcagcgcgtatacacacgaccggtgctcgatttagctctacgctcagggggagtcagacccagtcaggacacagcatggacagtgggggtccccgctcagctccgtggggctcctgctgctctggctccaggtgccaaatgtgacatccagatgaccagtcctccttccaccctgctcgcatctggtcggagacaggacgtccaccgtctacgttcggcccgggccaagtaacctaaaagttaacttaacggtacccgttagggttccggtaccgttaggttactaccgaaggacaaacggaaaaccggaacgggaaaaccgtaccccgttaagaccttaccgagtaacttactaacgttaacgacgttacgttaacgtttaagaccgtaggttccgggtacctaagttacgaacgggtttcacggcggacgtagggtagacgttcggtaagggaacgtaggtacgttactaactcctaacaacgtagttaacgcgtacgctacgactcggtactgtaattcgttatttaccgaacttaagtttacgtacctaacgtaacctaacgtaacttaactaacgtttacgttggttaacggtaacggttcgaaaccggtaacgggaacgtaagggtaacgtaaacgaaaccgtaacgaacgttcgggtaagtccggtaacgaacctaaccgtaacgttttccgtacggtttaccttaacttacccgtttaccccggttacccgttacccgtagtttaacccgg

SEQ ID NO: 10264 - DNA, 799 bp, Homo sapiens
  misc_feature: GYAE6OF02F4ON5.53.73.G07.1.454.CMB.1.raw
  modified_base (192)..(192): a, c, t, g, unknown or other
  misc_feature (192)..(192): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtcctccttccaccctgtctgcatctgtcgganacagagtccaccgtcacgttggcccgggaccagaccaaagttacttaacgacccgttgggttcggccttaggtacttcgagacaaggtaaaccgaagggaaaccgcccctaagacctccgtagtacttacgtaataacgtacgttactaacgttttaggactaacgggtccgggtacccaagttaccgtaaagggtttccgacggtaccgggtacgtaacggtacgggacgtttaccggtacggggtaacgtaacggttaacggtttacctaaccgttcccgttaccaaccgttaagttaaccggacgtacggtcccttacggaccgtacgtcccgttaggtacgttagttaacgttttacgaaccgtttaacgtttaaccgttaccgtacaacccgttaacgtaacgttaaaccttaactttaccgttttaggacgggttacccggtttaacggtacccggtaaacgggtaccgttaaacggtacggaaaaccgttacgtaaaccggtaccgtttacggacggtaaccgtggtaacctacccgttaacttacccgtttacgttcccttacggtaacccgtttccccggttacccgtaccgttaccg

SEQ ID NO: 10265 - DNA, 795 bp, Homo sapiens
  misc_feature: GYAE6OF02IUZRU.53.73.G07.1.454.CMB.1.raw
  modified_base (235)..(235): a, c, t, g, unknown or other
  misc_feature (235)..(235): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcgagtgatgtactttccgngcacgacatctggactaccaccttccaccgtacctacccttatactagttcgggtacaccgacggccccgtaggacgagggggtcttagggaggtgggtagtggggttaccttaaataccgtaaacccgttaggttgggttcggtaattaccgttaaacttaaacggttttaccctacgtaaaccgtaagggtaaaaggtaaacgttcggggaaccgtaaacggggggtaaccccttaaaacgttttaacccgaacgttaaccgggaaaccccgaaaggtaaaccgtaaccgtaaacccggttaaccccgaaacgggtaacgttaaccgtaaccgttaccttaaaccgtaggttacgggaacgggttagaacggtccgaaggtcccgtagtaacggtacgttaccggtaaggaaccggtaccgaccggtaccgtaagtttcgttaacgttcgttagggttacgtacggttaacgtttaccggtttaagggtacggtttaacgtttaacgttaaccttaacgtttaattttaccggtttttacgtaccgacgtaacccggg

SEQ ID NO: 10266 - DNA, 673 bp, Homo sapiens
  misc_feature: GYAE6OF02G96Y4.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatagaagaacgccgtggggcctcgagtgatgtactttcctggcacgacattctaggtactacctaccttaccacccgtacctccctttatacctagttagggtaccgacgtacggccccgtagggacgtaggggtcttggaggtaggtagtgggtactactaccaaccgtagtgggtagattactaacgtaacgttactactacgaagtacgaagtggaaccgacgggtaccgtaaacgtttaaccctaagtaccgtaaccgacggaacgtaccgaaccgtaccgaacgtaacgtactagtacctaacgtaggtagggtaggtaggacgacgacgtaccgtagacgtacgtcgtacgggacgtaacgaccggtacctaagttagttacgttacgtaggttacgacgttattacggtttagaaggttaacttaacggtacttaacgttaagtttacgtttagtacccgacgttaaccgg

SEQ ID NO: 10267 - DNA, 619 bp, Homo sapiens
  misc_feature: GYAE6OF02FNWM4.53.73.G07.1.454.CMB.1.raw
  modified_base (278)..(278): a, c, t, g, unknown or other
  misc_feature (278)..(278): n is a, c, g, or t
  modified_base (577)..(577): a, c, t, g, unknown or other
  misc_feature (577)..(577): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcggccgggccagacctaaagtattaacgaccgtggttcggcgtggtatcagacgagaaaccgaggaaacncccctagacctcctgactctataagcgtactacttagacgtagtcgggtaccagtcaaggttcagtcggactaggtggatcgtggacagtagttcactcgtacacgtattacgctacgcctgctacggtcctagtaattgttacgtttcgaacttaactttagttacgtacgacctaaacgtacgttaaactacttaaccgtttgggtacggttaccggttacggtaaccggtaagggaccctaaagggtaacgaaacgtaacgtaaaccgtacgtgtacggtactacgactaaccgtnttaccgttcttcgttaccgtacttcccgtacccgtacttacg

SEQ ID NO: 10268 - DNA, 694 bp, Homo sapiens
  misc_feature: GYAE6OF02IXFLP.53.73.G07.1.454.CMB.1.raw
  modified_base (198)..(198): a, c, t, g, unknown or other
  misc_feature (198)..(198): n is a, c, g, or t
  modified_base (246)..(246): a, c, t, g, unknown or other
  misc_feature (246)..(246): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgcctcccgaggtgcagctggtacagtcggggctgganagtagaagaaggccgtgggacctcgagtgatgtatttccgtgcacganatctaggatacaccttccgaccgtacctccttacgtactagttcgggtaccgacgaccggtccccgtagggacgagggtcttaggaggtggtagtcgggtataacgtaccaaccgtagttggtacgtactacgttaacgtaacgtttacctacaacgaagtaagtaagtacgaccgaagggtacccgtaaagttacccaagtaccgacgaagacgaccgtaccgtaccgacgtaaggtaacgtacgttactacgtaaggtaggtacggttaggacgtacgacggtacgtacggtaagtacgtacgtagggaaccggaccgtaaccgggtaaccgacggtttagttacgtttacgtaggtacggtacggttaacgttacggttaggtaaggttaacgttaacgttaacgttaacgttaatttacggttttacgtaccgtacgtacccgg

SEQ ID NO: 10269 - DNA, 540 bp, Homo sapiens
  misc_feature: GYAE6OF02F9JJU.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttgccgggccagccaaagtattaagacctggttggcctggtatcagcagaaaccagggaaagcccctagactcctgatctataagacgtctactttagactaggtcggggtacccatcaaggttcagcggcagtggatctgggacagagttcactctcacattagcagcctgcagctgatgtatttgactaactttattactgaccaacgagtaactaattactttagtcggtacgttccggaccgaaagggacctaaagggtagaaactacgaaacgtactaggtcggtactgaccacctagtccgtgttcttacacttccttcccgcctacg

SEQ ID NO: 10270 - DNA, 702 bp, Homo sapiens
  misc_feature: GYAE6OF02HHP8S.53.73.G07.1.454.CMB.1.raw
  modified_base (239)..(239): a, c, t, g, unknown or other
  misc_feature (239)..(239): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgcctccgaggtgcagtctggtaacaaggtcggggctgagatagaagaacgccgtggggcctgagtgatgtactttcgngcacgactagtcgtaggactactaccttccaccgtactaccttaatactagttgggtaccacgacggtccccgtaggacgacgggtcttggacggtggtagtggtaccttaaactaccgtaaaccgttaggtgggtacggtaacttaccgtaacgtaaacggttttaccaaccgtaagaaggtaacgtagtacggaacggaacggggtaacctaaacttaccgtacgtacgaaccgtaaggaacgaaccgtaccgtaaccgaacgtaagtaaccagtactacgtaggtagggtacgttagacgacgtacgtaccgtagtacgtagttacgacggtacggaaccgaccgtacgtagttaacgttaacgttacttgggttacgtagttacgttaacggtttaggaacgttaacgttaaccgtactttaacgttagttttagtttacggtacgaccgtaacccggg

SEQ ID NO: 10271 - DNA, 717 bp, Homo sapiens
  misc_feature: GYAE6OF02JD7MN.53.73.G07.1.454.CMB.1.raw
  modified_base (213)..(213): a, c, t, g, unknown or other
  misc_feature (213)..(213): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagcctgggcctnagtgatgtatttcctgcacgactatcgtaggactacctaccttccaccgtaccttcccttatactagttcgggactacgacggccccgtaggacgacggggtcttggagtggtagtgggtactaacgtccgtaaccgttaggtggtggacttacgtaacgtaacgtttacacgaacaaggaagaactcgggacgaacggggtaccctaaattaccgagtacgaaccaacgggacgaacccgtaccggtaaccgtaaccggtaacgtaaccgtaacgtaccgtaaccgtaaggtacggggtaggtacggaacgacgtacggtcccgtaaggaaccgtacttaccgggtaaggaaccgggaacccgtaaccgggtacctaacggttaacgtttaacgttaccgtggttacggacgttaacgttaccgtttaagggtacggttaagtttaaaccggtacttaacgttaagttttaacgttttaccggtaccgtaaccgtaacccggg

SEQ ID NO: 10272 - DNA, 555 bp, Homo sapiens
  misc_feature: GYAE6OF02GDZSI.53.73.G07.1.454.CMB.1.raw
  modified_base (481)..(481): a, c, t, g, unknown or other
  misc_feature (481)..(481): n is a, c, g, or t
tcagcgcgtatacacacgaccggtgctcgatttagctctacgctcagggggagtcatccaacaaccacatcccttctctacagaagcctctgagaggaaagttcttcaccatggactggacctggagggtcttctgcttgctgtcagtagctccaggtgctcgcctcccaggtgcagctggtacaatcgggggctgagatgaagaagccgtgggggcctcagtgatgatttcctgcacgacatctggatacaccttcaccgactccctataccattgggtacacacggcccctggacgaggggcttggacggtggatggggtactaactcaaccctggtggtaggatctacaagttactcacaagagaatgacgagggacctaaattaccatacgaaccaggacgacgacgtacccagagtaacagtactacgagtcggaggtgacgcgagcctgagatccgtggacgacgacgcctagtntacgttcgtggtcgtacgtattcgttaggtgtaagttacgaacttactaatttagtttcgtacgacgtaaccgg

SEQ ID NO: 10273 - DNA, 615 bp, Homo sapiens
  misc_feature: GYAE6OF02I3B21.53.73.G07.1.454.CMB.1.raw
  modified_base (229)..(229): a, c, t, g, unknown or other
  misc_feature (229)..(229): n is a, c, g, or t
  modified_base (364)..(364): a, c, t, g, unknown or other
  misc_feature (364)..(364): n is a, c, g, or t
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgattccngcacgacatctggataccaccttcaccgacctcccttatactattagggtaccacgacggcccctggacaggggcttgaggtggattgggtactaatccaaccgttaggtggtgattctaacaagtttactcaanagagaatcggcacggggacctaaattaccaagtacgaaccagacgaaccaccgtaccaacggaataaccgagtacctaactaagtgggtagtaggacgcgacgaccgttgaacggtactcgtagacgggaaccgacgggtacacgttagttaacttacgtcggtcgtacggtaacttccggttaggtacggtaacgtttacgtaacgttaactaaagttttaccgtttttaggacccgtaagtacccccgg

SEQ ID NO: 10274 - DNA, 577 bp, Homo sapiens
  misc_feature: GYAE6OF02IJ2IY.53.73.G07.1.454.CMB.1.raw
  modified_base (377)..(377): a, c, t, g, unknown or other
  misc_feature (377)..(377): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgtatttcctagcacgacatctaggatacaccttcaccgtactccttatacagttcgggacacgacggccccgtggacgagggtcttggagtgggatgggtactaacgtccaaccgtggtggtggactctagtaagttacacacagagatcgganacgggacctaattaccagtacgacgacgagaaccgcgtaccaagacgtactagtacctagagtaggagtagacgcaggtcctagacgtataccgagaacggtacgaccggtactagtacgtacgtacgtgtcgtaccggtcttacgttacggtagtacgttaacgtactaacgtagtttactttcggaccgtacgtaacg

SEQ ID NO: 10275 - DNA, 640 bp, Homo sapiens
  misc_feature: GYAE6OF02HKLIM.53.73.G07.1.454.CMB.1.raw
  modified_base (234)..(234): a, c, t, g, unknown or other
  misc_feature (234)..(234): n is a, c, g, or t
  modified_base (530)..(530): a, c, t, g, unknown or other
  misc_feature (530)..(530): n is a, c, g, or t
  modified_base (624)..(624): a, c, t, g, unknown or other
  misc_feature (624)..(624): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctcaggtgctcgctcccaggtcgcagctggtacaagtcgggggctgagatagaagacgccgtggggcctcgagtgatgtacttccngcacgctatcgtaggactaccacctcaccgtacttcctatacgtagttgggtaaccacgaccggtccccgtggacggtagggtctggtgtgggagtcggtactaatacgaaccgtagtcgggtaggtactacgtaacgtaacgtttaccacaacgaaggtaacgtagacggaccggagggtacctaaactaccgtagtacgtaacgaggaacgaaccgaaccgtaccgaacgtaagttaacgacgtacgtaacgaggttagggtacggtgacgtacgacgtcgtagagtacgtcgngggaacggacgaccgtactagtagttacgttagtggtacgcgtaagttacgtaggtaacgttacgttaacgtaagtacgtaattttacggtttntaccgtagtaaccggg

SEQ ID NO: 10276 - DNA, 808 bp, Homo sapiens
  misc_feature: GYAE6OF02H1RKV.53.73.G07.1.454.CMB.1.raw
tcagcgcgtatacacacgaccggtgctcgatttagctctacgctcagggggagtcagacccagtcaggacacagcatggacatgagggtcccgctcagctccgtggggctcctgctgctctggctccgaggtgaccaaatgtgacactccagatcgacccagtcctccttccacctgtctgcatctggtcgagacaggacgtcacgtcacgttcggaccggcacgaccaaagtacgttaacgaccgttggttcggccttagggtactcgtacgacgaacggaaaaaccgacggggtaaaccgccccgttaaggtaccgttacccgtaaggtacctaaccgttaaacgtaaacgggtaccgtttaacgttaaccgtttaacggaccgtagggtttaccggggtacctaacgtacgttaacgggttaccgtacgggaccggtacgtaacggtcgggacttcgggtacgggactacggtacgttaacacctacgtaacgacttagtacggacaacgtcgtcgacgtacgtacgtgtattagtactttacgacttacgtttactaaccgtcgaaactaacgttacgttaacgaacgtttagtttacggtacggtacccgggtttaacggaacccgggttaaacgggaccgttaaacgggggtaaacgtaaacttaaacccgggaaacggtttaccgtaacgggttacggaacccgttaacggtaccgtaacccgttacgttacccggttttaacgttacccgtttaacccttaccgggttttacccccgttaccccgtaccgtttaaaccgg

SEQ ID NO: 10277 - DNA, 797 bp, Homo sapiens
  misc_feature: GYAE6OF02IWPHP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaatgtgacatccagatcgacccagtctccttccaccctgtctgcatctgtcggagacagagtcaccgtcacttcggccggccagaccaaagtacttaacgaccgtgggttaggacagttggtatcgagacgaacgaaaccgaagggaaaccgaccccgtagtacctccgtagactactaagtaacgtcgttaccgttacgtttaacgacgtacgggttcgggtaccctaagtaccgtaaggttaccgtaacggccggacgtagggtacggtacgttaccggttacgggaaccgtaacggtaacgtttaccgtaaccgttccgttaacctaaccgttaacgtttaaccgaccgtaaccgtccgttacggtacgaccgtcgttacgtagttagttacgtttttaccgacgttaaccttttagttaccgtaccgtaaccctaaacgttaaccgttaacttaaccgttttaaggtttccggttacggttaacccgggttaccgggttaacccgaaacggggttaaccggtaaacgggttaaggaaaccgtttaaccggaaaccggttacggttacgggttaacgggtaccgttaacgaccccggttaaccgttacgtttacgttcccggttactttacccgtacgtttcccccttacccggtaccg

SEQ ID NO: 10278 - DNA, 611 bp, Homo sapiens
  misc_feature: GYAE6OF02FXRKC.53.73.G07.1.454.CMB.1.raw
  modified_base (457)..(457): a, c, t, g, unknown or other
  misc_feature (457)..(457): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtccaccgtcacgttcggccgggccaacgcctaaaaggtattaacggaccgttgggttcggccgttggtactcgagacaagaaaccgagggaaacgcccctagactcctgactactataagactactacttagactaggtcgggtacccagtctaaggttcaggcgcagtggactcgtagggacagtacgtcacttactcacctattacgcacgcctgacacgcctagattgtactttgactaacttattacgtgacctaanaacgttactacgttacgtttgacgggttacgttacgaccgaagggtaccaaagggtacgaaaacgttaacgaacgtaacgtacggtggtacacgtaccgtaaccgtacgttaccttaggttaccttacgtaccgttccttaccccggtactacg

SEQ ID NO: 10279 - DNA, 730 bp, Homo sapiens
  misc_feature: GYAE6OF02JZ3F8.53.73.G07.1.454.CMB.1.raw
  modified_base (133)..(133): a, c, t, g, unknown or other
  misc_feature (133)..(133): n is a, c, g, or t
  modified_base (172)..(172): a, c, t, g, unknown or other
  misc_feature (172)..(172): n is a, c, g, or t
  modified_base (716)..(716): a, c, t, g, unknown or other
  misc_feature (716)..(716): n is a, c, g, or t
tcagcgcgtatacacacgaccggtgctcgatttagctctacgctcaggggagtcatccaacaaccacatcccttctctacagaagcctctgagaggaaagttcttcaccatggactggacctggagggtcttntgcttgctgtcagtagctccaggtgctcgctcccaggtncagctggtacaagtcgggggctggacgatggaaagaacgtccgtgggggaccttcgaaggttgagtggaactttccgtcggactaacggactattcgttacggacttaaccgtaccgttacgacccgtaacctaccctttactaactacgttacgggttacgaccaaccggccccgttaggacggtaacgggcttaggagttcggtaagtcggggtacttaaacgaccgtaacccgttaggtacggtgggtaactaccgtagttaaacttacgtccaagtacggaaggtacgcgtacgtaccggaccggtaattaccgaatacggacctaacggaacgaacgaccgaaccgtacggtaacgtacgtacggttactaccgttagaggtagggttaccgagaacgtacgtaccgtagtaggtactaaccgtagtaacgggaccgtaacgaaccgtagttacgttaacgtcgttacggtcgttacggtacgttacgtttacgaacgggtttactaaccgttagtaaccgtttaagtacgtttttacnccgtaacgtaccgg

SEQ ID NO: 10280 - DNA, 697 bp, Homo sapiens
  misc_feature: GYAE6OF02F4JUS.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagagcctggggcctcagtgactggactttccgtgacgaccggaactagtcgtagggacttaaccgtaccttccgacccggtaccttaccccttaatacgtaacgttttggggaaccctaaccgaccgggtacccccgtagggacgaggggggtccttaggaaggttacggagttcggggtacttaacggtcaaaccccggttagtagggtacgacttacctaacgtaagtttaccgcaacgtacgagtaatcggacgtacggtaccgtaaagtttacccaagtacgaaccgagtacgtaacgaaccgttacgaccggtactacgtacgtactaacgagtggtaaggttacggacgtcgtacgaccgtgtagatcgacgacggaactaccggactaagttcgttaacgttacgtagaccgtacgtagttaaccggttacgtggtaacgtttaaccgtaacttacttaaagttaacttttcggtacctagttaaccccgg

SEQ ID NO: 10281 - DNA, 715 bp, Homo sapiens
  misc_feature: GYAE6OF02HMIZF.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccaggtgctcgctcccaggtgcagctggtacaagtcgggggctgagatagaagagccgtgggcctcgagtgatgtactttcctgccacgactaatcgtaggataccgtaccttcaccgtactcccttatactagttgggtaaccgacacggccccgtggacgtaggggtctaggacggtggagttgggttactaaacgtacgtaaccccgtagggttcggtaggtaattaccgtaaccgtaaacgtttaaccgtacaaacgaaggtaaggaacttgggaacccgaaggggtacccgttaaaacgtttaaacccgagttaccgggaacccaacgggtaacgaacccggaacccgtacccgtaaggtaacggttaaaccgtacgttaactaacgaacgggttaggggaaggttacgggtaacggcgaacgggtacccgttagaagttacgtacgtgggaaacggaccgacccgggtactatacgttaacttccgagtacgtgtagttacttagggtacgtacgtacgttaataacgttagttttaaccttgtacgtaccgtaccgg

SEQ ID NO: 10282 - DNA, 722 bp, Homo sapiens
  misc_feature: GYAE6OF02JVH3G.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagacgtcaccgtcacgttcgcccgggccagtaccaaagtattaagacccgtggttcggccgtaggttatcagacaggaaaccgagggaaacgcccctaaggacctccgtgactactaagtaagacgtacttaactttacgacgtaggtcggggtacccagttcgtaagggttccaaggtcggacgtacggtggtaacgtcgtacggggaactaaggtacgttaccgtaaccgttcgtaacctacccgtaagtttacggaccgtacggtacccgtgtaccgaacgtccccgtgttaacgtcggtttaattttcgaaccgttaaacttttaacggttaacctacggtaaccctaaagtaaacggttactaaacgtttacgtttggtaccgtaccgggtttaccggaccgtaaaggggtaacctaagggtaaacggtaaacgtacctaaaccgggtatcggtacggtacgtacgtacaccgtaagttcgtaccgtttactaccgttaccgttaccgttaccccgtacttaccg

SEQ ID NO: 10283 - DNA, 326 bp, Homo sapiens
  misc_feature: GYAE6OF02IU1BJ.53.73.G07.1.454.CMB.1.raw
  modified_base (299)..(299): a, c, t, g, unknown or other
  misc_feature (299)..(299): n is a, c, g, or t
  modified_base (317)..(317): a, c, t, g, unknown or other
  misc_feature (317)..(317): n is a, c, g, or t
  modified_base (319)..(326): a, c, t, g, unknown or other
  misc_feature (319)..(326): n is a, c, g, or t
tcagcgcgtatacacacgaccggtgctcgatttagctctacgctcagggcacgaccggtgctcgatttagctctacgctcagggcacgaccggtgctcgatttagatagatagacaggggcagttccagatttcaactgctcatcagcagcctgcagtctgaagattttgcagtttattactgtcagcagtataataactggcctcgacgttcgccaagggaccaaggtgaaatcaaacgactgtgctgcaccatctgtcttcatcttcccgcatctgatcgtatgcgctgacgcgggntgggacaaggcacatagnannnnnnnn

SEQ ID NO: 10284 - DNA, 762 bp, Homo sapiens
  misc_feature: GYAE6OF02FNN4L.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagtctcccttccaccctgtctgcatctgtcggagacagagtcaccgtcacgttcgccgggccacgaccaaagtattaacgaccgtgggttcggccttggtactcagacaacggaaaccgacgggaaaccgcccccgtagtacctccctagacttactaagtaacgtaccgttacttaactttaacggaccgtagggttccggggtaccccaagttaccgtaacgggttccgacgggtccgggtacgtaggttaggtagttacggtagggggaacctaggtacgtttccacttcctaccgtaacctagttacgcacggtcccgtaggacctacggtcccgttagtaacgtttagtttaacgttttaccgaaccctttaaacgttttaacctttaccgtacccgttaaaccctaaaccgttaagttaaacccttaaagtttaccgttttacgggtacgggttacccgttacgggaacccggtaacgggtaaccgtaaagggtaacgtaaactaaccgtaaaccggtagtacggtacggtactacggacctaaccgttacttccgttactttaccgttacctacccgtttcccttacccgtcttacc

SEQ ID NO: 10285 - DNA, 720 bp, Homo sapiens
  misc_feature: GYAE6OF02F1MN3.53.73.G07.1.454.CMB.1.raw
  modified_base (194)..(194): a, c, t, g, unknown or other
  misc_feature (194)..(194): n is a, c, g, or t
tcagcgcgtatacacacgaccggtgctcgatttagctctacgctcagggggagtcagacccagtcaggacacagcatggacatgacgggtccccgctcagctcctggggctcctgctgctctggcctcccaggtgaccaaatgtgacatccagatcgacccagtcctccttccaccctgtctgcatctgcgganacagcgtcaccgtcacgttcggccggacagaccaaaggttacttaagccgttgggttcggcctaggtactcgagacaacggaaaaccgtaggggaaaccgcccctagacctcctagacttactaagtaacggacgtacttacgtttagacgtaggtcggggtacccagttaccgtaaaggttccgaacggcggtaccgaggtacggtagttccgtacggggaacaggtaacgttcctaccgtccgttaccaaccgtagttacggacgtaacgtccgtacgcgtacgaccgtagtaacttcggttacgtttcgaaccttaaactttatttaccgtacgtaacctaaacgtacgtaaacttaacgtttacgtttacgggtacgggttaaccggttaccggaaccggtaaacgggtaacggttaaaggaacggtaaacgtaacgtaaaccgtacgtggtacggtcgtacgtacccgtacttacgttccgttacgttacgttacctaccgttacccttcccgacttaccg

SEQ ID NO: 10286 - DNA, 688 bp, Homo sapiens
  misc_feature: GYAE6OF02H96F4.53.73.G07.1.454.CMB.1.raw
tcagcgcgtatacacacgaccggtgctcgatttagctctacgctcagggatcatccaacaaccacatcccttctctacagaagcctctgagaggaaagttcttcaccatggactggacctggagggtcttctgcttgctgtcagtagctccgaggtgctcgctcccaggtgcagctggtacagtcggggctgagatggaagaagccgtggggcctcgagtgatgtactttcctgcacgactatcgtaggactacgtaccttcaaccgtactcccttatactagttcgggtacgacgacggcccctggacgtaggggtcttggagtggagtcgggtactaacgtccgtaacccgttggtcggtagactacgtaacgtaagttccacgtaacgagacgtaagtcgaaccgtacgggacccgttaaattaccgtaacgttacgaaccgtaaggtacgtaaccgtaccgtacccgtaacggtaacgttaacgtaacgttacgtaacgtaacggtagggtacggtacgacgtacgtacgtccgtaggtaacgtacgttcgtaggtaaccggaccgtaccgggtacctagttacgttaacttacgtcggttacgtacgtacgtttaccggttaggtacggttaactaccggtaacttaacgtaagttttacgtttacgtaccgtacgtaaccgg

SEQ ID NO: 10287 - DNA, 691 bp, Homo sapiens
  misc_feature: GYAE6OF02JZ8PB.53.73.G07.1.454.CMB.1.raw
  modified_base (191)..(191): a, c, t, g, unknown or other
  misc_feature (191)..(191): n is a, c, g, or t
  modified_base (414)..(414): a, c, t, g, unknown or other
  misc_feature (414)..(414): n is a, c, g, or t
tcagcgcgtatacacacgaccggtgctcgatttagctctacgctcagggggagtcagacccagtcaggacacagcatggacatgagggtcccgctcagctcctggggctcctgctgctctggctcccaggtgccaatgtgaccatccagatcgacccagtcctccttccaccctgtctgcatctgtcgganacagtacgtccaccgtcacgttcgaccggccagaccaaagtactaagaccgtggttcgcctggtactcagcaagaaaccgagggaacgcccctagacctaccgtgtactactataaggtccgtacttacgtttagaccgtagggtccgggtacccattaccgaagggttccaggtccggtacgaggtcggtaactcggtagggactagtacgtttcaaccttnacccacgtattacgcgtacgaccgttgaccgtacgtacgtagtaacttgggttaattttcgaacgttaaactttaacgtttaacgtacgtacccgtaaacgtaacttaccgttaaacgtttaccgtttagggttaccggtaccggtttaacccggaacggtaaaccgggtacccgtaaagggttaacgaaaccgttaacaaaccggttatacggtacgacgtaccgacctaccgacttctaggttcctaccgtacttacccgttccccgtacttacg

SEQ ID NO: 10288 - DNA, 742 bp, Homo sapiens
  misc_feature: GYAE6OF02JHW77.53.73.G07.1.454.CMB.1.raw
  modified_base (197)..(197): a, c, t, g, unknown or other
  misc_feature (197)..(197): n is a, c, g, or t
tcagcgcgtatacacacgaccggtgctcgatttagctctacgctcagggggagtcagacccagtcaggacacagcatggacatgagggtccccgctcagcctccgtggggctcctgctgctctggcctcccaggtgaccaaatgtgacatccagatcgacccagtcctcccttccaccttgtctgcatctggcgganacagacgtccaccgttctacgtcggccgggaccaacggacctaaaagttacttaacggtaccgttgggttcggccgttgggtaactccgaggtaccaaacggaaaaccgaggggaaaccgtcccccgtaagaccttacccgtgtaactaccgtaagtaacgtaccgttaccttacgtttagaccgtaggtcgggtacccagtacgtaacggttcgagcgactaggtcgagtcggaggacagttactactactctaccaacgttatacgctacggcctaggacccgttagcgttaggactttggtttaactttacggtaaccttaaacttttaccgttacgtaccgtaaccgtaaagttaacttaaccgtttaatttaacgggtttcggttaacccgggtaccgtttaacgggggaacccggttaaaacgggaccgtttaaaggggttaaacaaaacgtaaccgtaaaccggttacgtaggttccggacttaccgaaccgacgttactttaccggtcgttacttcctaccgttcccgtacacctag

SEQ ID NO: 10289 - DNA, 736 bp, Homo sapiens
  misc_feature: GYAE6OF02HI3G6.53.73.G07.1.454.CMB.1.raw
  modified_base (170)..(170): a, c, t, g, unknown or other
  misc_feature (170)..(170): n is a, c, g, or t
  modified_base (243)..(243): a, c, t, g, unknown or other
  misc_feature (243)..(243): n is a, c, g, or t
tcagcgcgtatacacacgaccggtgctcgatttagctctacgctcaggggatcatccaacaaccacatcccttctctacagaagcccctgagaggaaagttcttcaccatggactggacctggagggtcttctgcttgctgtcagtagctccaggtgctcgctccaggtncagctggtaaccaagtcgggggctcgagatggaaagaacgccgtgggggacctcgagtgactgtactttccgngacacggacctagtccgtaggaactacctaccgttccaaccggtacctaccccttaataccgtaagttcggggtaaacacgacggtaccccgtgggaacgacggggtacttggaacggtgggtagtcgggtacttaacgccgtaaaacccgttggtacggttggaacttccgtaaacgtaacgtttaccacaaccgtaggaaacgtaacgtcgtaacgacggggtacctaaagtttaacccgagttaccggaaccaaggaacgtaccgtaccggttacccgaacgtacggtacaacgttaaccgtacgtagtagggacggtacggagaccgaacgtccgtagacgtacgttcgtaggaaccggtacgacgggtcctaaggttacctaagttaaccgtcgtaccggctaacgttacgttacggtaggttaaccgttaacggtaaccttaacgtaaacgtttcttttacggccgttaccggaccccgttaacggg

SEQ ID NO: 10290 - DNA, 806 bp, Homo sapiens
  misc_feature: GYAE6OF02HUSNM.53.73.G07.1.454.CMB.1.raw
  modified_base (195)..(195): a, c, t, g, unknown or other
  misc_feature (195)..(195): n is a, c, g, or t
  modified_base (328)..(328): a, c, t, g, unknown or other
  misc_feature (328)..(328): n is a, c, g, or t
tcagcgcgtatacacacgaccggtgctcgatttagctctacgctcaggggagtcagacccagtcaggacacagcatggacatgagggtccccgctcagctccgtgggctcctgctgctctggcctccgaggtgaccaatgtgacatcagatcgacccagtcctcctccaccctgtactgctatcctcggtcgganaacgagtacgtccgtaccgtactacgttcggccggacacggacctaaaagttcttaaacgccgttggttacggccgtggtatcaggcaacggaaacgaaggaaccgtccctagacctcgtacgactacttaanacggtacgtacctttaacgtttcgaaacgtgggttaccgggtaccctaacgttacgtaaacgggttcgacggtaccggtacgaaacggtggtacgtaccggtagggtactaacggttacgtaccgtacgttacccgtaaccgtaaccgttagttaccggacctacggtacctaccggtacggaccgttacgtacgtacgttacggtttaacgtttacctaacgttttaaactacgtttaacccgtacgtaaaaccgttaaccgaaacgtttaacgttaaccgttttagttaccgggttaaccggttaccggggttacccggaaacccggttaacgggtaaaccgttaaacggggtaaacgtaaaagtaaccggtaaacggtacggttaccgggtaaggtcccgtaactacggtaacccttgtttacccgttcgtttaaccgtaccgttcccgtttaacccgttcccggtactttacgg

SEQ ID NO: 10291 - DNA, 616 bp, Homo sapiens
  misc_feature: GYAE6OF02GYYYR.53.73.G07.1.454.CMB.1.raw
  modified_base (316)..(316): a, c, t, g, unknown or other
  misc_feature (316)..(316): n is a, c, g, or t
  modified_base (360)..(360): a, c, t, g, unknown or other
  misc_feature (360)..(360): n is a, c, g, or t
  modified_base (392)..(392): a, c, t, g, unknown or other
  misc_feature (392)..(392): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccacctgtctgcatctgtcggagacagagtccaccgtcacgttcggccgggcagaccaaagtattaacgaccttggttcggcctggtatcagcagaaaccagggaaacgcccctaagactcctgactactataacgacgtcttacttanacgtagtcggggtcccagtctaaggtcagcgacagtcggatcgnggacagtagttcactctacacctattacgacncgcctagcaacggtcctagtattcggtatttcgacctaaactttacgttacacgacctaaactaagttaacctaactttacgtttaggtacggtaccggtttcggaaccggaacgggtaccgaaagggtacgtaaactaccgaaacgtactaggtaccgacgttcactaacccgtacttaccgtcggttacctttcgactttccccgttacccgaccttaaccg

SEQ ID NO: 10292 - DNA, 642 bp, Homo sapiens
  misc_feature: GYAE6OF02FK5EA.53.73.G07.1.454.CMB.1.raw
  modified_base (228)..(228): a, c, t, g, unknown or other
  misc_feature (228)..(228): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacatcgggggctgagatgaagaagcctggggcctcagtgatgatttccngcacgacatctggatactaccttccaccgacttcccttaatactagttgggtacgacacggcccctggacgaggggcttggaggtggagtgggtctaagtccaacccgtggtggtggtatctaactaagtttactcaacgagacgtaatgacgacgggacctaaatttaccaagtcgaccgtaacggaacgtaccgaaccgtacccaacggtaacgtaaccgtaggtacctaagacgtagggtaggtaggacgcacggtccgtggaacgtagttcgtaggacggaaccgaccgtacctaagttacggtaatttaccgttcgttaggtaccgtaagtttaccgttaggttacggtaacgtttaaccgaactttaaccgaaattttacgttttacggtaccgtaacgtaccccggg

SEQ ID NO: 10293 - DNA, 651 bp, Homo sapiens
  misc_feature: GYAE6OF02H9ZFA.53.73.G07.1.454.CMB.1.raw
  modified_base (188)..(188): a, c, t, g, unknown or other
  misc_feature (188)..(188): n is a, c, g, or t
  modified_base (191)..(191): a, c, t, g, unknown or other
  misc_feature (191)..(191): n is a, c, g, or t
  modified_base (262)..(262): a, c, t, g, unknown or other
  misc_feature (262)..(262): n is a, c, g, or t
tcagcgcgtatacacacgaccggtgctcgatttagctctacgctcagggggagtcagacccagtcaggacacagcatggacatgaggtcccgctcagctcctgggctcctgctgctctggctcccgaggtgccaaatgtgacatccagatgacccagtctccttccaccctgtctgcatctgtcgganacngagtcacgtcacttgccggcagcaaagtataacgactggttcgcgtggtatcagacagaaacgaaggaacncccgagactctagactctaatagacgtactactttagacaggtcgggtccagtctaacggtcaggcggctaggtagtatcggtaggggtaccagtacgttaccacttaccttacccaaacttagttacggacgtaaccggtaccgttcggacgtaacgtccgtacggtacgttagtacgtttacgtacttaacttaacttacgttacgacctaacgtaacgtaactaacgttagtttacggttacgtacggttaccggtaccgaacgggtacgtaaacgggtacggtaaacgtaacgaagtacccccgtaggtaccggtgtacgtacctaccgtaacttccgttcgttaccttaccgttacccgttaccgtacccggtccttaacccgg

SEQ ID NO: 10294 - DNA, 665 bp, Homo sapiens
  misc_feature: GYAE6OF02GXVAN.53.73.G07.1.454.CMB.1.raw
  modified_base (648)..(648): a, c, t, g, unknown or other
  misc_feature (648)..(648): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttcgtgcttgctgtcagtagctccaggtgctcgcctcccaggtgcagctcggtaacaagtcgggggctagagatagaaagacggccgtggggacctcgagtgatgtactttcctgctacgactatcgtggactacctaccttccgaaccgtctttaccccttaagtactgtttacgggacgacgaccggtccctagggacgtacgggcgtttagcgggttgacggttgggtactaatacccgaaccgttggtggtaggactattaaccgaacgtttactaccgaagaacgttaaggatcgggaacgtaccggggaacctaaattaccgagtacgaacgtagacgacaacgtaccgtaacgaacgtaaccgtagttaaccgaacgtacgttacgggagggttacggaagtacggacgtacccggtagacgacggttccgagggttaacgaccgaccgacctagttacggttatacgttgcgtagtacgtacgttagtagtacgtaacgacttaataattnttttacgactacgtacg

SEQ ID NO: 10295 - DNA, 709 bp, Homo sapiens
  misc_feature: GYAE6OF02GF7LL.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcgtggggcctcagtgatgatttcctgcacgacatcgtggataccaccttcaccgacttcccttatacagttgggtacacacggcccctggacgagggcttgagtggagttcgggtactaacgtaccaacccgttaggtcgggtagtacttacctaagtaaacgtttactacgaacaggtaacgaagtcggacgaacggggacctaaattaccgagtacgaaccgagacgaccgtaccgtaccgaacgtaagtaaccgacgttacctaacgtaggtagggtacgggttacgacgaccgacggtaccgtaggtaacggttacgtaccggtagggaaccgggtaaccgaaccggggtacccttaaggtttaacgtttaacgtttaccggttaggttacggtacgtttaacggtttacggtttaagggtacgggtttaacgtttaacccggtaacttaacgtttaaacgttttaacggtttttcggtaaccgtacccggtaacccggg

SEQ ID NO: 10296 - DNA, 603 bp, Homo sapiens
  misc_feature: GYAE6OF02HLYXZ.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagcctggggcctcagtgatgatttcctgcacgactatctagggatacaccttcaccgacctcccttatactagttgggtacgacgacggccccctaggacgagggggtcttggaggtggtagtgggtctaatccaacccttaggtggtggatacgtataaagtttactcaacagagataggacaggggacctaaatacccatacgaacgtagacgaacgaccgtaccgaaccggaagtacgagtactaacaggttgggaggttaggacgcagcctagaggtactacgtagacggaacgacggaccgatagtacttagtcggtagtacgtcgttacgttaaggttcggtaacgtttaacgtaacttaacgttaattaagtttttgacctacggtaacccgg

SEQ ID NO: 10297 - DNA, 577 bp, Homo sapiens
  misc_feature: GYAE6OF02F3OG3.53.73.G07.1.454.CMB.1.raw
  modified_base (270)..(270): a, c, t, g, unknown or other
  misc_feature (270)..(270): n is a, c, g, or t
  modified_base (343)..(343): a, c, t, g, unknown or other
  misc_feature (343)..(343): n is a, c, g, or t
  modified_base (393)..(393): a, c, t, g, unknown or other
  misc_feature (393)..(393): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagatcaccgtcacgttcgccgggccagaccaaagtattaagacctggttggctggatcagcaagaaaccagggaaacnccctagactcctagatactagtaacgacgttctaacttagactaggtcgggtacccatcgaaggttcaggcgnagtgtatcgtgggacagtagttcacgtctacacctatacgcagcctgacngctagtagtgtatttcgactaactttattactagtaccctaaactcgtaactaacgtttacgttgtacgggtaccgttcggaacccgtaaggtaaccgtaagtaacggaaactacgtaaacgtagtagtacggtactagacgtaacctattcgtacgttactactacgtcccctaccgtctacg

SEQ ID NO: 10298 - DNA, 667 bp, Homo sapiens
  misc_feature: GYAE6OF02GAVDG.53.73.G07.1.454.CMB.1.raw
  modified_base (235)..(235): a, c, t, g, unknown or other
  misc_feature (235)..(235): n is a, c, g, or t
  modified_base (408)..(408): a, c, t, g, unknown or other
  misc_feature (408)..(408): n is a, c, g, or t
tcagcgcgtatacacacgaccggtgctcgatttagctctacgctcaggggagtcatccaacaaccacatcccttctctacacgaagcctctgagaggaaaggttcttcaccatggactggacctggagggtcttctggcttgctgtcagtagctccaggtgctcgctcccaggtgcagctggtacagtcggggctgagatgaagagccgtggggcctcgagtgatgtacttttcngccgaacgactagttcgttacggactacctaccgtttccaaccgtaccttcccttaagtactagttacggtacgaccgacggtccccgtggacgacggggtcttcggaggtggtagtcgggtactaacgtaccaaaccgtcggtaggtacggtatacgtacgtaagttttacncgaacgtagaagtactacgtcggaaacgggtccgtaaaacgttaccgagtcgaccgtaacgagtaaccgtaccgtacctaccgtaagtaacgtacgtactacgtacggtaggaggttagacgcgaacgtccgtagacttaacgtcgtaaggaccggaccgacgtacccgtaagttacgttaacgttacgttggtacgtacgttacgtacgttaggtacgttatacgtactacgttacttagttttcgacgtaagtcccg

SEQ ID NO: 10299 - DNA, 671 bp, Homo sapiens
  misc_feature: GYAE6OF02IZP3V.53.73.G07.1.454.CMB.1.raw
  modified_base (232)..(232): a, c, t, g, unknown or other
  misc_feature (232)..(232): n is a, c, g, or t
  modified_base (600)..(600): a, c, t, g, unknown or other
  misc_feature (600)..(600): n is a, c, g, or t
  modified_base (646)..(646): a, c, t, g, unknown or other
  misc_feature (646)..(646): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagagtgaagaagccgtgggcctcagtgatgtactttccngcacgacatctggatacctaccttccaacccgtaccttacccttaatacctagtttggggaaccgacgaccggccccctgggaccgaggggtcttggaggtggagttcgggtacttaagtaccaacccgtaggtggtaggtacttaccgtaacgtaaacgtttacctacaccgaaggaacgaagtggaccgacggggtaacccgtaaacttacccgaatacggaaccgaagtaacgaccgtacccgtaccgaacgtaacgtaacctacgtacctacgaggtaggacggtacgagacgtacgtccgtagtacgtacgttcggtagacggaaccgacggtcctagtcgttaacttacgtgtcgtacgttnttacggttaggttacggtaactttaccgtaacgttactaacgtttnttttaccggaccgtacgtaacccgg

SEQ ID NO: 10300 - DNA, 640 bp, Homo sapiens
  misc_feature: GYAE6OF02IVEE7.53.73.G07.1.454.CMB.1.raw
  modified_base (195)..(195): a, c, t, g, unknown or other
  misc_feature (195)..(195): n is a, c, g, or t
  modified_base (307)..(307): a, c, t, g, unknown or other
  misc_feature (307)..(307): n is a, c, g, or t
  modified_base (309)..(309): a, c, t, g, unknown or other
  misc_feature (309)..(309): n is a, c, g, or t
  modified_base (332)..(332): a, c, t, g, unknown or other
  misc_feature (332)..(332): n is a, c, g, or t
  modified_base (416)..(416): a, c, t, g, unknown or other
  misc_feature (416)..(416): n is a, c, g, or t
tcagcgcgtatacacacgaccggtgctcgatttagctctacgctcaggggggagtcagacccagtcaggacacagcatggacatgagggtcccgctcagctccgtggggctcctgctgctctggctcccaggtgccaaatgtgacatccagatcgacccagtcctccttccaccctgtcctgcatctgtacgganacagagtcaccgtcacgttcgccgggacaggacctaaagttataacggaccttgggttcgccttaggtactcagacaacggtaaaccgaagggaacgccctagactccgtananctataagcgttctaattagacgnggtcgggtccattacgaggttcagtcgagagtgatcgtagggactagacgttcactcgtacaactagtacacgagtctcggacncgtacgtagacgttatacgtttacaccgttaattaccttacgtcgactaaacgtacgtaactaaagttaacgttcggttagggaacccgtttcggaacccgtaaggggtaaccgtaaacggtggaaaacgttaaccgaaaggttaaccgtggttaaccgggtctaagtacccaaccgttaggttaccttaggttaccctccttacgaccctttccgaccgttac

SEQ ID NO: 10301 - DNA, 750 bp, Homo sapiens
  misc_feature: GYAE6OF02GQGTW.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggcctcccaggtgccaaatgtgacatccagatgacccagtctccttccaccctgtctgcatctggtcggagacaggacgtcaccgtcacgttcggccggaccagacctaaagtattaacgaccgtgggttcgccgtggtactcgagacgaacgaaaccgaaggggaacacccccgtagaccttcctagtactactaagtaacgtaccggttacctttaacgtttaacggtaacgtacgggttacggggtacccctaacgttaccgtaaacgggtttccgaacgggccggacggtaacggttgggaactcgggtacggggaactacggtacgttactaccgttccctaacctaaccgttaacgttacgtaccgtacgtaccctacggtaccgtacggtccctaacggtatttacggttacgtttacgtaaccttaaactttacttaaccgtaccgtaacctaaacgtaacgttaaacttaacgtttacggtttaggtaccggttacggttacccggtaaccggtaacgggtaacgtaaagggtacgtaaacgtaacgaaacgtacgtagtcggtactacggacctacgtacttcgtcgttcgttacctaccgtaccgttcctacgttacc

SEQ ID NO: 10302 - DNA, 659 bp, Homo sapiens
  misc_feature: GYAE6OF02GTF68.53.73.G07.1.454.CMB.1.raw
  modified_base (234)..(234): a, c, t, g, unknown or other
  misc_feature (234)..(234): n is a, c, g, or t
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctccaggtgctcgctcccaggtgcagctggtacagtcggggctgagatgaagagccgtggggccctcgagtgatgtactttccgngaccacgacattcgtggtactacctaccttccgacccgtaccttccccgttaataccgtagttacgggtaaccgcgaaccgggcccctaggggaccgtaggggtcgttaggaggtggtacgttcgggtaccttaacgtacccaaccgttggtcgggtaggtactacgtaacgtagttaacctacgaataggaagtagtggaccggtaacgggacctaacgtaccaagtcgaaccacggacgaaccaccggtacccgagacgtaacgacgtactagagtaggagggtgacgacgtcggactaggacgaacgttcgacggacgaccgacgctagtagtacgttacgtgtacgtagtacgtttcgtaggttacgttaacgttaaccgacttaacgttaatttacgttttaggacctacggtaacccgg

SEQ ID NO: 10303 - DNA, 728 bp, Homo sapiens
  misc_feature: GYAE6OF02GP0RL.53.73.G07.1.454.CMB.1.raw
  modified_base (95)..(95): a, c, t, g, unknown or other
  misc_feature (95)..(95): n is a, c, g, or t
  modified_base (189)..(189): a, c, t, g, unknown or other
  misc_feature (189)..(189): n is a, c, g, or t
  modified_base (225)..(225): a, c, t, g, unknown or other
  misc_feature (225)..(225): n is a, c, g, or t
tcagcgcgtatacacacgaccggtgctcgatttagctctacgctcagggggagtcagacccagtcaggacacagcatggacatgagggtccccgntcagctcctgggctcctgctgctctggctccaggtgccaaatgtgacatccagatgacccagtcctccttccaccctgtctgcatctgtcgganacagagtcaccgtcacttcgccggcagaccaaagtnttaagacctggttcggcctggtatcagcaagtaaaccgagggaaacgccccgtagacctcctagactctaataacggtacgttaccttaacgtttaggactacggttcggggtaccccagttacgtaaggttcgaacggcggctaggtggactcgtagggacacggtacgttaccacgttactactaaccgtagtttacgacctacgtcccgttacgacctaacggtccctaggtacttggttaacttttcggaacttaaaccgttttatttaccgtcggttaaaccaacgttaaacgttaactaaacgttttacgttttacgggtacgggttaaccggtttacgggaacccgtaaacgggggttaaccctaaaaggggtttacggaaaaacttaacccgtaaacgggtaacctttacgggtacggtaccttacgggacctaacccgtacgtttacgttacgttacggttacctactttcccgttacccgtaccgtttaacgg

SEQ ID NO: 10304 - DNA, 788 bp, Homo sapiens
  misc_feature: GYAE6OF02GV8WY.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgacatccagatcgacccagtctccttccaccctgtctgcactcgtgtcggagacagagtccaccgtacacgttcggccgggaccagacctaaaagtacttaacggacctggttcggaccttggtactacgacgacaacggaaaaccgaacggggaaaaccgtcccccgtaagtaccttacccgtagtaacttaccgttaaacgtaaacggtaccgtttaccgttaaccgttttaacggaaccggtagggttccgggggtaaccccctaagttaaccggtaacgggtttacgaaccggtcgggacgtaaggtacggacgttaccggtacggggaactaggtacgtttaccgtaacctaccttacccgtaaccgttaagttaccgaccgtacgcccgtagccgacgtccgtagtattacgtagtttacgaccttaaactttacttacgtactacccgtaacgtaacgttaacttaagtttacgtttaggtacgggttaaccggttccgggaaccggtaacggggtaacccgtaaacgggttaacgtaaaacgtaccgtaaaaccgtacggtggttacggtaccgtacggtaacctaccttacgtcgttacgttcccttacgttaccctttccgttacccacttaccgg

SEQ ID NO: 10305 - DNA, 687 bp, Homo sapiens
  misc_feature: GYAE6OF02GBJVF.53.73.G07.1.454.CMB.1.raw
  modified_base (299)..(299): a, c, t, g, unknown or other
  misc_feature (299)..(299): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagacgtccaccgtcacgttggcccgggccagaccaaagttattaaacgaccgtggttcggcctggtatcagcaacgaaaccgaggaaacgcccctaagacctcgtanactactaataacgtacgttaccttaacgtttaacgaacgtacggttcggggtaccctaagttaccgtaaacggttccgacgcggtcaggtggtactcgtagggacagtacgttctactcgtaccaactatacgctacgtccgtacgtacgacgtctagtagtagttacgtttagaccttaaatttacttaacgtccgaaccctaaacgtaacgttaacttaaacgttacgtttttacgggacggtttaccggtccggtaaaccgtaacgggaaaccgttaaagggtaacgtaaagtaaccgtaaccgtaagtacggtacggtctaaccggtaccaaccgttacgtcgttacgttccgttacaccggtttccctacccgtacttaaccg

SEQ ID NO: 10306 - DNA, 726 bp, Homo sapiens
  misc_feature: GYAE6OF02F0MLD.53.73.G07.1.454.CMB.1.raw
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcgggggctgagntagaagaagccgtggggcctnagtgatgtatttccngcacgacatcgtaggataccaccttaccacccgtaccttcccttaatactagttgggtaccgactacggccccgtggacgaggggcttggacggtggtagttcgggtactaactaccgtaacccttagggtcggtaggtactactaacgtaagttacctacaacaaggtaagtaacgtgacggaacgggtacccgtaaactttaccgataccgaccgtaacggaacgaccgaaccgtacccgaacaacggttaaccgtaacgtacctaaccgtaggttacggggtacgggttacgacggtccgtaaccgtcggtaggtaacggtacgtacggttaacggaacgggtaacccggaacccggtaacccggttaagttacggtttaaccttacgttacgggttacgtaccggttaacgtttaccggtttagggttaccggtaacgtttaacgtaacttaacgttattttacgtttacccgtacgcccggttaaccgg

SEQ ID NO: 10307 - DNA, 760 bp, Homo sapiens
  misc_feature: GYAE6OF02GOH53.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagacggaaagttcttcaccatggactggacctggagggtcttctgcttgctgtcagtagctccaggtgctcgctcccaggtgcagctgtacagtcggggctgagatgaagagccgtggggacctcgagtcgatcgtatttccngacacgtactatcgtaggtaactacctaccttaccgaacccgtaccgttacccttaacgtactagttacggggtaaccgtaccggtacccggtaccccgttagggaccggtaacggggtccgttaggacggtacgggtacgttacggggttactaaacgttacccgtaacccgttagggtcggtaggtacttacgtaacgtaacggtttacctacgaacgtaggaagtaacgtcgaacgtaacggggtacctaaacttaccgaagttaccgaaccgtacgaacgtaccgaacccggtaccaacggtaacgtacgtacgttaccgtagtaggttacgggtacggtacgacgtccgtaagtaccgttagacgttaccgtagtaccgggaccggtacgaccgtacgtacgttacgtaacgttcggtcgtagtaaccggtagttaccggttaacgggttacggttaaccgtaccgttaacgtttaccttaacgttttacgttttaccggtacctacccgggttaacccggg

SEQ ID NO: 10308 - DNA, 649 bp, Homo sapiens
  misc_feature: GYAE6OF02GFHN0.53.73.G07.1.454.CMB.1.raw
  modified_base (231)..(231): a, c, t, g, unknown or other
  misc_feature (231)..(231): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcggggctgagatgaagaagccgtgggcctcgagtgatgatttccngacacgacatcgtggataccacctttccgaacccgacttaccccttatacctaagttgggtaccgacgacggccccgtgggacgtacgggtcttaggaggtggagttggggtacttaaataccgtaaaccccgttaggttcggtcggtattaccgtaactaaggtttaacctcaacgagaaaggtaatacggacgaacggggacctaaagtttaaccacgttacgaccgaagaacgacgaaccgtcgaacgagtaacacgtactacgagtagggagtagacgagacgtccgtagagtattcgtaggacggaaccgacgtcgtattcgttaagttcgtaggtcgtacgttattacgttaggtacggttaataacggttaactacttaagttttagttttcgtaccgtacgtaacccggg

SEQ ID NO: 10309 - DNA, 618 bp, Homo sapiens
  misc_feature: GYAE6OF02IZ3QN.53.73.G07.1.454.CMB.1.raw
  modified_base (328)..(328): a, c, t, g, unknown or other
  misc_feature (328)..(328): n is a, c, g, or t
  modified_base (397)..(397): a, c, t, g, unknown or other
  misc_feature (397)..(397): n is a, c, g, or t
  modified_base (439)..(439): a, c, t, g, unknown or other
  misc_feature (439)..(439): n is a, c, g, or t
  modified_base (459)..(459): a, c, t, g, unknown or other
  misc_feature (459)..(459): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgttcagtagctccaggtgctcgctcccaggtgcagctggtacaagtcgggggctgagatagaaagaagccgtggggcctcgagtgatgactttcctgacacgacatcgtaggactacaccttacacccgtaccttacccttatactagttcgggtaacgaccgacggtccccgtgggacgacggggtnttcggaggtgggagtgggtacctaactcctaaccgtagtcggtggtaactcgtaactaagttactacanagaagatgacgagggacctaactactatacgacagagaaccncgtaccaagatacgatacanagtaggaggtgaagccgaagccggtagtacgtacgtcgtacggaacggaacgaccggactagttcgtattacgttggagtacctaaggttccgttaggttaacggtaacgtttaacgaacgttaacgttaagtttactttacggacgtacggtaaccgg

SEQ ID NO: 10310 - DNA, 672 bp, Homo sapiens
  misc_feature: GYAE6OF02GLM0T.53.73.G07.1.454.CMB.1.raw
  modified_base (222)..(222): a, c, t, g, unknown or other
  misc_feature (222)..(222): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaacgccgtggggcctcagtnatggatttcctgccaacgactatcgtaggactacctaccttcgaccgtaccttacccttatactagttcgggtaaccacgacggtccccgtgggaccgaggggtcttggaggtggagtcggtctaactccgaaccctaggtcggtggacttcaacgtaacgttcacaacaggtagaatcggaccggagggtacccgtaaattaccaacgttacgacccgtaaggaacgaaccgtaaccgtacgaaccggtaacgtacgtacgttacctacggtaacgttgggagggttacgagacgacgtaccgttaggacgtacgttcgacgggtaacggaccgacggtacctagttaagttacttacggtagtcggtacggtaatttaccggttacggtaaggttacgttaacccgtattaacgttaacgtttagttttcgtacgtacccgtaaccgg

SEQ ID NO: 10311 - DNA, 713 bp, Homo sapiens
  misc_feature: GYAE6OF02JB981.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggaggtcttctgcttgctgtcagtagactccaggtgctcgctcccaggtgcagctggtacaagtcgggggctgagatgaagaagccgtgggcctcgagtgatgtatttcctgacgaccgactagtcgtggactaacctccttaccgaccgtaccttacccttatacctagttacgggtacgacgacggtcccctaggacgaggggtcttggagtggagttgggtactaactaccgaaccgttggtcggtaggtacttacgtaacgtaacgtttacctacaacgaacggtaagtaacgtacggaaccggtacgggtaacccgtaaacttacccgagtaaccgaaccgtaaggtaaccggtaaaccgtaaccggtcccggaaacggtacggtaaccgtaacgtaccctaaacgtagggttacgggtacgggagttacggacgaccggtacgtaagacgtacgttaccggtaggtaaccggacccgacgttacctagttacggttaacttcggtccgttaggtaccttacggttacgttagttacgggtaacttacgtacttaacttaagttacgtttacgacgtacccgtacgg

SEQ ID NO: 10312 - DNA, 692 bp, Homo sapiens
  misc_feature: GYAE6OF02GYUCQ.53.73.G07.1.454.CMB.1.raw
  modified_base (235)..(235): a, c, t, g, unknown or other
  misc_feature (235)..(235): n is a, c, g, or t
  modified_base (419)..(419): a, c, t, g, unknown or other
  misc_feature (419)..(419): n is a, c, g, or t
  modified_base (553)..(553): a, c, t, g, unknown or other
  misc_feature (553)..(553): n is a, c, g, or t
  modified_base (569)..(569): a, c, t, g, unknown or other
  misc_feature (569)..(569): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatgaagaacgccgtggggccctagagtgagtgtctttccncgcgaccgactatcgtaggactacctaccttaccacccgtaccttacccttatactagttcgggaccacgaccggtcccgtgggacggacggggtcttgggtagtagggtaggttcgggttaactaacgtaacccaaccggttaggttcgggtaggtacttaccgtaaacgtacgtttaaaccnctaacgaagtaagaaacgttcggaaccggtacggtaacgtaactttaccgagaacgacgaacggacgacgaccgtaccgaacgtaagacgtactacgaccgtaaggacggtaagggtcgagtacgccgtacggngttagacgtttacggnggaacgtaaccggtccgtaacgtcttaacgttattaccggttgtacgtctaaggttaccgttagtcggttaacgtacgtaacgtaactttaacgttacgttttacgtacgtaccggtaaccgg

SEQ ID NO: 10313 - DNA, 818 bp, Homo sapiens
  misc_feature: GYAE6OF02H2GED.53.73.G07.1.454.CMB.1.raw
  modified_base (206)..(206): a, c, t, g, unknown or other
  misc_feature (206)..(206): n is a, c, g, or t
  modified_base (807)..(807): a, c, t, g, unknown or other
  misc_feature (807)..(807): n is a, c, g, or t
tcagcgcgtatacacacgaccggtgctcgatttagctctacgctcgagggggagtcagacccagtcaggacacagcatggacatgagggtccccgctcagctccgtggggctcctgctgctctggctcccgaggtcgacctaaatgtagacatccagtatcgacccagttcctcccttaccaccctgtcctgcatcctggtcggancagactccgaccgtctacgttcggccgggcagacctaaagttataacggcgtgggttcggccttggtactgaacggtcaagaaaccgaggggaaacctcccctaagtcctaccgtgtaacttactaagttaaacggtaccggttacttaacgtttaacgacgtacgggttcgggtaccccaagttacgtaaaggttccgaacgggtccggaacgtgggtacgggtactacgggttacggaaaccgtaggttacgtttaccaccttacgtacctaacctaaggtttaaccgaccgtaacgtccggtacggtacctcggtaacccgttggtaacgttacggttaacggttttcaaacgttttaaactttaacggtttaacctaacccgggtaacttaaacccggtaaagttaacctttaacgtttaccgggttttaacgttacggggttaacccgggttaccgggtaaacccgggtaacgggttaaccgttaaacggggtaacggaaaaccgttaccggaaacgtaccggttaggtaccgggtactaccgtacgtaacccgtacgttcgtacttaccgttaccgttattaccccggttacccncgttaacccgg

SEQ ID NO: 10314 - DNA, 859 bp, Homo sapiens
  misc_feature: GYAE6OF02GHNQY.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctcaggtgctcgctcccaggtgcagctggtacaagtcgggggctggagatgaagaacgccgtggggcctcgagtgatgtacttcctgctacgactatacgtggtactacctaccttaccaccgtaccttacccttatacctagttacgggtaccacgtaccggccccgttagggaccggtacggggtccgttaggacggttagggacgttacggggtacctaaaccgtaccgtaaaccccggttaggttacgggtacggtaacttacccgttaaacgtaaacgttttaccgtaccgtaacgtaacggaacgtaaacgtcggaaccgtaaccgggggtaacccgttaaaacttaaccccgtaaaggttaccgaaacccggtaaggtaaacccggtaaacccgtaacccgggttaaccccggaaaccgggtaacgttaaacccggtaaaccgggttacctaaaccgttagggttaacgggtaaccgggttaggaacggacccgtaacgggtacccgttagggaacggttaacgttcgggtaaccgggtaaccgggtaaccgaacccggttaaccgttaagttccggttaacgtttaccgtacgggttaccgtaacggtttacgttaacggttttaacgggtaccggttaaacgtttacccggtaaactttacgttaaagttttacgtttacccgtaccgtacccggtaaccgg

SEQ ID NO: 10315 - DNA, 570 bp, Homo sapiens
  misc_feature: GYAE6OF02FG4ML.53.73.G07.1.454.CMB.1.raw
  modified_base (190)..(190): a, c, t, g, unknown or other
  misc_feature (190)..(190): n is a, c, g, or t
  modified_base (271)..(271): a, c, t, g, unknown or other
  misc_feature (271)..(271): n is a, c, g, or t
  modified_base (565)..(565): a, c, t, g, unknown or other
  misc_feature (565)..(565): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttgccgggccagccaaagtattaagacctggttcggcctggtatcagcaagaaaccagggaaacncccctagactcctagatctaataagacgttacttactttagactaggtcggggtacccagtcgtaaggttcaggcggcagtggatcgtgggacaggtagttcactctacacctattagctacgcctgcagtcctagatgtatttcgacttaacttattactcgaccaaactataactaagttctttaggtacggttacgttaccggacgtaaacgggtacctaaacgggtagaaacgtaacaaacggtactggtaggctacgacacctagtctcgttactctacctcctcccgnttacg

SEQ ID NO: 10316 - DNA, 577 bp, Homo sapiens
  misc_feature: GYAE6OF02FHP0S.53.73.G07.1.454.CMB.1.raw
  modified_base (369)..(369): a, c, t, g, unknown or other
  misc_feature (369)..(369): n is a, c, g, or t
  modified_base (385)..(385): a, c, t, g, unknown or other
  misc_feature (385)..(385): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
tcagcgcgtatacacacgaccggtgctcgatttagctctacgctcagggggagtcagacccagtcaggacacagcatggacatgaggggtccccgctcagctcctggggctcctgctgctctggctcccaggtgccaaatgtgacatttcagatgacccagtctcccttccacccctgtctgcatctgtcgggagacagagtcaccgtcacttgcccgggcagccaaagtattagacctggttgcctggtatcagcagaaaccagggaaagcccctagactcctgatctataagacgtctactttagacaggtgggtccatcaaggttcagcggcagtggatctgggacagagttcactctcacattancagcctgcagctgatnatttnactacttattacnctaccaacagtaactaaatttacttggacgtcgtcggtaccgaaacgggtaaccgaaacgtaggtaaacgtaaccgtaaaacgtacgttacggtagggtcgtaccgtacccgtaacctaaccgttacttacgtttccttaccctttactacccccgtttcccgtacccttaccg

SEQ ID NO: 10317 - DNA, 644 bp, Homo sapiens
  misc_feature: GYAE6OF02FIY3X.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagacgtcaccgtcacgttggcccgggccacgaccaaaagttacttaagacccgttgggttcggccgtggtatcagcaacgaaacgaaggaacgccctagactcctagatactataagtacgtacttacttagacgtagtcgggtacctagtacgtaaggttactagcggcgagtggtatcgtaggacgagtacgttactacgctttttttacacctacgttacgacgacgtccgtcgctacgccgtgtagttagtactttcgactaactttacttacgtacgtaccgtaacgtactaacgtaacgttagtttacggttacggtacggttacggtaaccgtaacggtaaccgtaacggtacgtaaacgtaacgtaacgtacgtaggtacggtcgtacgaccgtaccgtacttacgttacgttcgttactacgttacccttacccgtacctacg

SEQ ID NO: 10318 - DNA, 604 bp, Homo sapiens
  misc_feature: GYAE6OF02FIP7G.53.73.G07.1.454.CMB.1.raw
  modified_base (190)..(190): a, c, t, g, unknown or other
  misc_feature (190)..(190): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcgganacagagtcaccgtcacttgccgggccagccaaagtattagacctggttggcctggtatcagcagaaaccagggaacgcccctagacctccgtagactactaataagacgttaccttactttagacgtaggtcgggggtaccctaagtacctaagggttcaggcggacaggtggatcgtgggacagtagttcactctcacctattacgcacgcctgccacgcctagatgtatttcgactaactttattactcgaccctaactaactaactaagttactttaggtacggtacggttacggaccgtaacgggaccgtaaggtacggtaaacgtacgtaaacgtacgtaggtcggtactcgacctaccgtacgtacgttacgtacctttacctacgtttcccgttacccgtacctacg

SEQ ID NO: 10319 - DNA, 733 bp, Homo sapiens
  misc_feature: GYAE6OF02GGE8M.53.73.G07.1.454.CMB.1.raw
  modified_base (236)..(236): a, c, t, g, unknown or other
  misc_feature (236)..(236): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcgggggctgagatagaagaagccgtagggcctcgagtgatgtatttccgngcacgacatctggataccaccttccaaccgtaccttacccttaatactagttacgggaccgaacgaccggtccccgtagggacgtaggggtccttaggacggttggtacgttacggggtaccttaaacgtaccgtaaaccggttaggtcgggttaggacttacgtaaacgttaacgtttaccgtacgtaaccgtaggaagtaactacggtacgaacgggtacctaaacgtttaacccaaggttacgaacccaagggaacgaaccgaccgttaccgaaacggtacgtaacctacggtacctaacgaggttaggacggtagtaccggactacgtaccggtagaacgtaccgttggaacggacgggtaacccgacggttaacctaggttaccgttaacgttacggtgtaaccgtcggttaacgtttccgttaaggttaggtaaccctttaacggtaacttaagttaacttttacgttacgtaccgtaaccggtaacccgg

SEQ ID NO: 10320 - DNA, 744 bp, Homo sapiens
  misc_feature: GYAE6OF02GW1GZ.53.73.G07.1.454.CMB.1.raw
  modified_base (357)..(357): a, c, t, g, unknown or other
  misc_feature (357)..(357): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatcgacccagtctccttccacctgtctgcatctgtacggagacagagtcaccgtctaccgttcggacccggaccagaccaaagttattaacggaccgttgggttacggtccgtggtactcagaccaaagaaccgaacgggaacgacccctagacctcctgtactactagtaacgtacgttcttacgttagacgtaggtcgggtacctntacgtaaggttcgaggtcggacgtaggtggacgtacgtacggaacgaggtcgttactacttccgtaccacttacgttacgccgtacgtccgtacgaccacggtaccttaggtacttacggttacgttttacgtaacccgtttaaactttacgttaaccgtacgtaaccgtaaacgttacgtaaacgtttaacttaccggttttaggtaaccgggttacccggtttaccgggacccggtaaaggggttaaccgtaaagggttaacggaaaacgtaaccggtaaacgttaacgtaccgggttagtaccggttaccggaccgtaaaccgttacgtttaccgttacggttacctttaacgacccgtttacccgttacccgtaccttacccg

SEQ ID NO: 10321 - DNA, 869 bp, Homo sapiens
  misc_feature: GYAE6OF02I7W8S.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacgttcgccgggccagaccaaagtacttaacgaccgtggttggcctggtatcagcaagaaaccgaggaaacgcccctagacctccgtgactactaagtaacgtaccgtacttaacgtttacggacgtaggtcggggtaccctaagttaccgtaaacggttcgaacgggtccgggtactacggttaggacttcggtagggtaacgaacggtacgtttaccacgttacctaccgtaacccgtaagttacgaccgtacggtcccgtacggtacccgtacgtcccgttagtaagtttacggttaacgtttttcgaaccgtttaaacttttaacggtttaaccgtacccggttaacctaaaaccgtttaaccgttaaaccgttaaacgtttttacgttttaaccggggttaccggggtttacccggtttaacccgggggaaaaccggttaaccgggggttaaaccccgttaaaaggggggttaaaccggttaaaaaccggttaaacccgtaaaaccggggtttaaccggtttaccggggttaaacggttccccggttaaaccgggtaacccctaaaccccggtttaacgtttacccggttaaccgttttaccggtttacccgtaacccgtttttacccccgtttacccccgggtaacccgtttaacccgg

SEQ ID NO: 10322 - DNA, 1049 bp, Homo sapiens
  misc_feature: GYAE6OF02FSPQY.53.73.G07.1.454.CMB.1.raw
  modified_base (181)..(181): a, c, t, g, unknown or other
  misc_feature (181)..(181): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttcacctgtctgcatcngtcgagacagagtcaccgtcacgttcgccggtcagaccaaaagttacttaaacggaccgttgggttcggaccttagggtaactaccgaggtactaacggtaaaacccgaggggtaaaccgacccccgttaggtaaccttcccgtacggaacttaccgttaacgtaaacgtaccggttaccttaaccgttttaggaacctacgggttaccgggggtacccctagttaccgtaaacgggttttacgaacggtcgggtacctaacggttacgggtaactttaccgggttacggggtaaaccgtaacgggtaacggttttacccgtaaacccgttacccgtttaacccgtaacccccgttaaacgttttaaacccgggtacccggtaaacccggttaccccggtttaacgggaccccggttaaacgggttaacccccgttaggggttaaaaccggtttcggttaaaaccggttttttaccggaaacccggtttaaaaccgttttaaaccggtttaaacccgtttaccggtaaaccccgttaaaaccgtttaaaccggttaaaccgtttaaaaccttttaaccgggtttttaaccgggttaaacccgggggtttaacccgggttttaaccccgggggtaaacccggtttaaaaccgggggtaaaccccgggttaaaaccgggtttaaaccgggtaaaaaaccgtttaaccgggtaaaaaacccgggttaaccgtttaacggggttaccgggttaaaccggttaccgtaaccccggggttaaaccccttaaacggtttacccgttaccggttttaaccctttaccggtttaacccgtttaccccggtttaccccgtaaccccgtttaaacccgg

SEQ ID NO: 10323 - DNA, 628 bp, Homo sapiens
  misc_feature: GYAE6OF02GFWJ3.53.73.G07.1.454.CMB.1.raw
  modified_base (159)..(159): a, c, t, g, unknown or other
  misc_feature (159)..(159): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccngtcctccttccaccctgtctgcatctgtcgagacagagtccaccgtcacttcggcccgggccagacctaaagtattaaacgaccgttggttcggccgttggtatcagacaagaaaccgaggaacgcccctagacctcctagactactataacgtacgtccttacgttagacgaggtcgggtccagtacgaacggttcgacgcggcagtcggatcgtaggacagtacgttcactcctacacctagttacgcacgcctgacacgctagtattgtactttcaactacgttactttacgctacaactaagtacctaaagtttcgttaggtaccggttacggttccgaaccggtaacggtaaccgtaaggtaaacggaacgtaacgtaaaccgtacgttacggtaggtaccgtagaacctacccgtaagttccgttacgttccttaccgcctttcccgttacccgaccttaacg

SEQ ID NO: 10324 - DNA, 823 bp, Homo sapiens
  misc_feature: GYAE6OF02H4YXE.53.73.G07.1.454.CMB.1.raw
  modified_base (293)..(293): a, c, t, g, unknown or other
  misc_feature (293)..(293): n is a, c, g, or t
  modified_base (408)..(408): a, c, t, g, unknown or other
  misc_feature (408)..(408): n is a, c, g, or t
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctccaggtgctcggcctcccgaggtgcagctggacaaggtcgggggctggagtagtagaagaacgccgtcgggcctcgaggtgatgtactttccgagaccacgacatcgtaggactacctaccttccgaccgtactacccttanactagttagggtaccacgaccggtccccgtagggacgtcgggggtcttaggacggtagggagttacggggtactaacgtaccaaacccgtgggttaggtaggtactaccgttaanaaacggttttaccaccggaacaaggtaacgtaaacgttcggaaccggttaacggggtaacccgttaaacgttaaccgacggttaccggtaaaccgtacggtaaaccgttaccgaacccggtttaaccgtaaccgggtaacgtaaccggtaacgttacccgtaacggttaacggtaggggtacggttaacggaacggtccgtaacggacccggttaacgggaacgtaacggttcgttaaccggggaaaccggtaaccggtaccccgggtaacgtaaacggtttacgtttaaccggtttaccgtacgggttaccggtaaccgtaagtttaaccgggttacggtaacgggttaaccgtttaactacccggtttaaacgttaagttttaccggtttacgtacccgtacggtaacccggg

SEQ ID NO: 10325 - DNA, 733 bp, Homo sapiens
  misc_feature: GYAE6OF02F7J39.53.73.G07.1.454.CMB.1.raw
  modified_base (233)..(233): a, c, t, g, unknown or other
  misc_feature (233)..(233): n is a, c, g, or t
tcagcgcgtatacacacgaccggtgctcgatttagctctacgctcaggggatcatccaacaaccacatcccttctctacagaagcctctgagaggaaagttcttcaccatggactggacctggaggtcttctgcttgctgtcagtagctccaggtgctcgctcccaggtgcagctggtacaagtcgggggctgagatgaagaagccgtggggcctcgagtgatcgtatttccngcacgacattcgtggaactacctaccttccacccgtaccttccccttaataccgtagtttggggtaaccacgtacggtacccccgtagggaaccggcgggggtccttaggaggtcggtaaggttcgggtacttaacgtacctaacccgtaggttcggtacgggtaacttacgttaacgtaacgtttacctccgtaaacgtagtaagtaagtacggaccggtaacgggtacccgtaaatttaacccgaacgttacggaacccgaaacggtacgtaaaccgaccgttaccccgaacggtaacctaaaccgtcgttaacccgtacgtaaggtagggtacggttacgacgtcgtacggtacccgtagtacggtagttcgtacggaacggtacccgacggtacctagttacgtaacttaccgttgtacgtacgttacgttcgttaagggtgtaacctttaccgaacttaactaacggtttactttacggtaccctaggtacccgg

SEQ ID NO: 10326 - DNA, 667 bp, Homo sapiens
  misc_feature: GYAE6OF02HO6LX.53.73.G07.1.454.CMB.1.raw
  modified_base (560)..(560): a, c, t, g, unknown or other
  misc_feature (560)..(560): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccgaggtgcagtcgtggtacaaggtcgggggctggagagtcggaaagaacgccgtggggcctgtagtgatgtattctgacacgtacatcgtaggacttaccgtacccttacgaccgtaccttacccttaactacgtaggtttacgggaccaaccgaaccggtccccgtagggacggtacggggtcttaggagtggtacgtgggttactaacgtcctaaaccgtggtgggtacgattacctaagtaacgtttcaccgacgtaagtaacgaagtcggacgtaaccgggtaacctactaacgagtaccgacgtaacgaactacgaccgaaccgagtaacgtacgacgttaactacgtaggtagggtacggtagaccgcgaacgttccgaggtaaacgngttaccggaggaaccgacgaccgtacctagtagttacgttgcgttagcgtgttaacgttggtaagtaccgttaagtaccttaagtaattttgtacgtcacggtaacg

SEQ ID NO: 10327 - DNA, 819 bp, Homo sapiens
  misc_feature: GYAE6OF02GLZZP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggcctcccaggtgaccaaatgtgacatccagatcgaccagtcctccttccaccctgtctgctatctagtcgagacagtacgtcaccgttcaccgttggcccgggaccacgtacctaaaagttacttaaacggacccgttgggttacggccgttaggtacttcgacggtaccaaacggtaaaaccggaacggggtaaaccgtacccccgtaaagacccgttaccgtacggtaacttaccgtaaattaacggtaccgttaccgttaacgttttaacgaacggtacgggtacggggtaccctaacgttacgtaacggttcgtaacggcggtacgaggttaggtacttcggtacggtaacgagtaacgttccgtaaccgttcctaccgtaaccgtaacgttacgaccgtaggcccgtaggcctaccggtacgtacgtacgttacggttacgtttacgtaaccttaccgtttaacgttacgtaccggtaaacctaacgttaaacctacttaaacggtttacggtttcgtaaccgggttaacggttacccggtaacggtaaaccgggtaaccggttaaaggtaaacggtaaacgtaccgtaaaacggtacgttcgggtaacggtaacgttacggaccctaaccgttagttcccgtttaacgtaccgtttacctaccgtttaccccggtaccccgtattacccgg

SEQ ID NO: 10328 - DNA, 777 bp, Homo sapiens
  misc_feature: GYAE6OF02GD10X.53.73.G07.1.454.CMB.1.raw
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctcgaggtgctcgctccaggtgcagctggtacagtcggggctgagatgaagagccgtgggcctcagtgatcgtatttcctgcacgacatctggataccaccttcaccgtaccttcccttaatacctagttacggggtacacgaccggtccccgtagggaccgtacgggggtccttggagggtcggtaacgttggggtaccttaaacgtaccgtaaaccccgttggttcgggtaggtactttacgttaaacggtaacgtttacctaccgaacgtaaggtaacggtaacttcgggaccgtaacgggggtaacccttaaacgtttacccgaagttacccggaaccgaacggtaacggaacccgtaaccgggtaccccgtaacggtaaccgtaaccgtaacggttacccgtaacgagggttacggggtaacggttacggaaccggaccgtaccgggtaccttagggaaccgttacgttacggtaacgggaaacggtaccggacccggttacgaaggtttacgttaacttaccggttacgggtcgtaacggttacgttaccggtttaggtacggttaacgttaacggaactttaaccgttaatttacggttttacgaccgtaccggtacccgg

SEQ ID NO: 10329 - DNA, 837 bp, Homo sapiens
  misc_feature: GYAE6OF02F9EQD.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccacctgtctgcatctgtcggagacagagtcaccgtcacttgccggccagaccaaagtattaagacctgggttgcctggtatcagacagaaaccgaggaaacgcccctagacctcctggtatactaataagacgttccttaactttaggacgtagggtcgggtacccagtacgtaacggttcgaaggccggtactacggttacgggacttccgggtacggggaacgtacgggtacgtttaccgtaaccttcgttacccgtaccgttaattaaccggtaccgtaacggtacccggttaccgaccggtaaccgtccggttaacgggtaagtttacggtttaaacgttttcgggtaaaccctttaaacgttttaaacgttttaaccgtaacgttaaacccgtaaaaccgttaaaggtttaaacccgttaaaagtttttaccggttttaacggggtttaccgggttaacccgggttttaacccggggtaaacccggtaaaccggggtaaacccggtaaagggttaaaccgggttaaaacgtttaacccgaaaaccgggttacgttacgggttaacgggtccgttaaggtacccgtaaaccgttaacgtttaccctttacgggtttacctttaaccggttacccttacccggtttccccgtaacccgttaacccgg

SEQ ID NO: 10330 - DNA, 691 bp, Homo sapiens
  misc_feature: GYAE6OF02HLVFI.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctccaggtgcagctggtacagtcggggctgagatgaagagccgtggggcctcgagtgatgtactttccgtgccacgacactcgtaggactacctaccttcaccccgtaccttccttatactaggttacggtaccgacgaccggtccccgtgggaccggacggggtcttaggaggtggtagttcggggtacttaacgtacccgtaacccgttagggtggtacggattaccttaacgtaacgtttaccacaagaagtagtaagtacgacggtacgggtaaccgtaaacttaccgacgtacgaacgaacgacgaaccgtaccgtaccgaacgtacgtactacgtacgtacgtaggtacgggtaggtagacgacgtacgtaccgtagaacgtacgtcgtaacggaaccggtaccgacgtacgtacgttacgttatacgttagtacgtacggttacttaggttacgggtaacgttaacgtttaccgtaacttaacgtttaacgttttacgtttacggaccgttaccgtaccggg

SEQ ID NO: 10331 - DNA, 737 bp, Homo sapiens
  misc_feature: GYAE6OF02J00XU.53.73.G07.1.454.CMB.1.raw
  modified_base (175)..(175): a, c, t, g, unknown or other
  misc_feature (175)..(175): n is a, c, g, or t
  modified_base (716)..(716): a, c, t, g, unknown or other
  misc_feature (716)..(716): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgtcttgctgtcagtagctcaggtgctcgctcccgaggtgacngtcgtggtaacaagtcgggggctaggaagtagtagaaaggaacgtccggtcggggcctcgagtgtattggttactttccgtgccgaacggactacgttcgtacgggacttaccgtacccttacctacccgtaccttaccccttaagtacttaggttacgggtaacccggtaacgtaccggtccccgtagggaccggtacgggggtctttagggaggtttaggacggttacggttactaacgtccgtaaaccgtgggtcggtagtaaccttacgtaacgttaagttccgtacaaacgaagtagaagtcgtaccgaacggggtaactaaccgtactagtaccggaacagggaccacgaaccgtaccgacgtaacgtaaccgtacgtcctaagacggttaggtacggtagacggaccgtacgtaccgaggtacctaggtacgtacgaacggaccgtaaccgtcgtaacgttagttacgttactacggtaggtccgttaagttacgttaggacttaacggttaacgtagttaactaagtttttanaccgttagtaccgtaaccggg

SEQ ID NO: 10332 - DNA, 692 bp, Homo sapiens
  misc_feature: GYAE6OF02HC05T.53.73.G07.1.454.CMB.1.raw
  modified_base (158)..(158): a, c, t, g, unknown or other
  misc_feature (158)..(158): n is a, c, g, or t
  modified_base (225)..(225): a, c, t, g, unknown or other
  misc_feature (225)..(225): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgcctgtcagtagctccaggtnctcgcctcccgaggtgcagctggtacaagtcggggctgagatgaagaagccgtggggcctcgaggtnatgtactttcctgccacgacatctggactacaccttcaccgtactcccttatactagttgggtacacgtacggccccgtaggaccgaggggtccgtggaggtcggagtggggtactaactacgaaccctaggtggtcggactcgtaactaagtttacctctaacgagaagaagttcggacgacggggtaccgaaactttaccgaagttacgaccgaaggtacgaaccgtaaccgtacccgtaaccggtacgtaaactacgtaccttaccgtaaggttgggcgggttaacggcgtaccgaggtccgttaacggacgttacgttagtacgggacggttaacgaccgggtaccacgttacgtttattaaccgttggtacgtacggtaacttcgttacggttaaggtaccgtttaaccggtacgttaaaccttaagtttaagttttacctaccggttacccgtaacccggg

SEQ ID NO: 10333 - DNA, 146 bp, Homo sapiens
  misc_feature: GYAE6OF02JZ4BC.53.73.G07.1.454.CMB.1.raw
  modified_base (115)..(115): a, c, t, g, unknown or other
  misc_feature (115)..(115): n is a, c, g, or t
  modified_base (136)..(146): a, c, t, g, unknown or other
  misc_feature (136)..(146): n is a, c, g, or t
tcagcgcgtatacacacgaccggtgctcgatttagctctacgctcagggcacgaccggtgctcgatttagctctacgctcaggcacgaccggtgctcgatttagcagacgtctgngcggctggcaaggcgcatagnnnnnnnnnnn

SEQ ID NO: 10334 - DNA, 688 bp, Homo sapiens
  misc_feature: GYAE6OF02GP7BM.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctggagatagaagaagccgtggggcctcgagtgatgtatttcctgaccacgacatcgtggatacctaccttcgaacccgtaccttacccttatacctagtttcggggaaccgaccgaccggccccgtgggaccgagggggtccttggaacggtgggtagttcggggttactaaactcccgtaaacccgttggtacgggtaggtacttaccgttaacgtaaagtttaccgtacaacgaagaagtaatggacgacggaccgtaacttaccgatacggaccaagacgaacgaccgtaccacggtagtacgtagtacctacgtagtgggaggtgacgtcgacggtccgtgacgtacgtcgaaggtacggaccgacggtacctagttagtaacgtttacgtggttacggtaccgtaaggtttacgttacgggtaacggttacgtttaaccggaacttaacgttaagttttacgttttacggtaccgaaccggttaaccccgg

SEQ ID NO: 10335 - DNA, 701 bp, Homo sapiens
  misc_feature: GYAE6OF02HC6VI.53.73.G07.1.454.CMB.1.raw
  modified_base (191)..(191): a, c, t, g, unknown or other
  misc_feature (191)..(191): n is a, c, g, or t
  modified_base (231)..(231): a, c, t, g, unknown or other
  misc_feature (231)..(231): n is a, c, g, or t
tcagcgcgtatacacacgaccggtgctcgatttagctctacgctcaggggatcatccaacaaccacatcccttctctacagaagcctctgagaggaaagttcttcaccatggactggactggagggtcttctgcttgctgtcagtagctccaggtgctcgcctcccgaggtgcagctggtacagtcggggntgagatagaagagccgtgggcctgagtgatgtactttccngcgaacgacactcgtaggactacctaccttccaccgaccttccttaagtactaggtttacgggtacaccgtaccgggcccctaggaacggtacggggtcttggaacggtgggtagttcggggttacctaaactaccgtaaacccgttaggggttagggtacggaacttaccgttaaacgtaaacgtttacccaccaacgtaaggaaagtacggttaggaccggaacggggtaaccgtaaactttaccagtacggaaccgaaggtacgaactaccggtacctaacggaacgtaaccacgttactaacgtacgggttagggacggttagacgacctacggccttagggactagtcgtacggaggacccgacgggtactacgtacgttaacttcgtacggttcgagttacgtagttacgggtataaccggtttaactacttaactaagttttcgtttcgacctacgtaaccgg

SEQ ID NO: 10336 - DNA, 739 bp, Homo sapiens
  misc_feature: GYAE6OF02GB3BL.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagtgtcaccgtcacttggccgggcagacctaaagtatttaagaccgtggtttggcgttggtagtcagcaagaaaccgagggaaacgcccctagactaccgtgacttctaagtaacgacgttaccgttaacttttagaaccgtaggttcgggggtacccctagttaccgaaggtttaccgaagtccgggtacgtacggtaggtacgtacgtacggggaacgtacggtaggtttaccaacttcgtacaccgtacttaacgcaggtcccgtagcgtacgcgtagacgttacgttaggtttacgaccttaacgtttaacttaccgtacgtacctaaaccgtaagttaacctaaacgttttctttaacgggttacggttaaccggtttcgggtaaccccggtaaaggggtaccctaaaaggggtttaccggtaaaacgttaacgaaaaccgggttacgttacggttacggtacttaccggaaccgtaaccgttaacgtttccgtacgttccgtttaaccgaaccgttttcccgttaaccccgtccttaacgg

SEQ ID NO: 10337 - DNA, 695 bp, Homo sapiens
  misc_feature: GYAE6OF02J0RP2.53.73.G07.1.454.CMB.1.raw
  modified_base (231)..(231): a, c, t, g, unknown or other
  misc_feature (231)..(231): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgctccgaggtgcagctggtacaagtcgggctgagatgaaagagccgtgggcctcgagtgatgtactttcngcaacgacatcgtggaatacctaccttccaccgtaccttacccttatatacgttgggtaacgaccgtaccggccccgtaggacgaagggtcgttaggagggttaggtagtggggtacctaacgttaaccgaacccgttaggtagggtagtaacgtcgtaaacgtaacgtttacctacgaacgtaagtaagaacgtggaacggtacgggtaaccgtaacgttaaccgacgtaacggaaaccgtaagaacggaaaccgtaaccggttcccgaaacggttaaccgtaaggtaaccgttaccgtaaccgtaggttaaggggacggtaggacgtacgtaaccgcggttaagacgtaacggtcgtaaacggacggaaccgtacgaacctagtaacgtattagcgtagtccgtagttaccgtggtacgtattaacgtacttaaacttagtttcgttagtacacgttaacgg

SEQ ID NO: 10338 - DNA, 822 bp, Homo sapiens
  misc_feature: GYAE6OF02IZNCA.53.73.G07.1.454.CMB.1.raw
  modified_base (109)..(109): a, c, t, g, unknown or other
  misc_feature (109)..(109): n is a, c, g, or t
  modified_base (200)..(200): a, c, t, g, unknown or other
  misc_feature (200)..(200): n is a, c, g, or t
tcagcgcgtatacacacgaccggtgctcgatttagctctacgctcagggggagtcagacccagtcaggacacagcatggacatgagggtccccgctcagctcctgggtnctcctgctgctcgtggcctcccgaggtcgacctaaagtcgtagactactccagatccggaaccctgttccttacccttccacccttggtcngactatcgtaggtacggacgtaacagtacgtcctaccggtctacggttccgggcccggtaccgacgtaaccgtaaaagttacttaacggccggttgggttccggcttcggtatacgacgacaaacgaaaccggaacggaaccgtacccgtagtacccttacgacgtaacttactaaagtaacgtaccgttacctttaacgttaacgtacgtacgggtaccgggtccctaaggttaccgtaacggttacgaccgggtcggacggtaacggtggtaaccgtcgggtacgggtactaaggttacgtacctacgttacctacctaacgttaacgtcggacaaccggttctacgggcctaacgtaccgtagtacgtttacgtttaagtttacccgaacttttaacgtttctttaaccggtaacctaaccgtaaacgttacgttaaccttaacggttttaccgtttaaggggaccgtttaccggggtaccggtaaacccgggaacgggtaaccggtaaagggttaaccgaaacgtaaccggtaaaccttagggttcggtacggtaccacggtaccttaaccgtgttacggttctttaccgtacctttaccgttcccgtacccgttacg

SEQ ID NO: 10339 - DNA, 740 bp, Homo sapiens
  misc_feature: GYAE6OF02JY0QO.53.73.G07.1.454.CMB.1.raw
  modified_base (691)..(691): a, c, t, g, unknown or other
  misc_feature (691)..(691): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccaggtgccaatgtgacatccagatgacccagtctcctccacctgtctagcatctgtcggagacagacgtccacgtcacttcggccgggacacgaccaaagttacttaacggaccgttggttcggcctggtatcacgacaacggaaccgaagggaaaccgtaccccgtaaggacctcctagtactactaacgtaacgtacgttacttaacgttagaccggtacggttacggggtacctaagtacgtaaggttacgacggtacgggtactaggtacggtacgttacggtagggtaactaggtacggttacacctacctacgtacctaacgttacgactacgtcgtacgacgaacgttccgtaatagttacgttaacgtttcggaaaccttctttaagttaccgactaacccgtaaatacgtaaacgtttacgtttaaccgttacgggttacgggttacccggtaccgggttaacccggtaaacggggttaaccgtaaaggggttacgaaaaccgttaaacgaaacccggttagtacggttaaccgcgggtaacctctaaacccgttnttacgttaccttacggtacccttctttaacccgttccccgtagttaccg

SEQ ID NO: 10340 - DNA, 721 bp, Homo sapiens
  misc_feature: GYAE6OF02IRWF7.53.73.G07.1.454.CMB.1.raw
  modified_base (350)..(350): a, c, t, g, unknown or other
  misc_feature (350)..(350): n is a, c, g, or t
tcagcgcgtatacacacgaccggtgctcgatttagctctacgctcagggatcatccaacaaccacatcccttctctacagaagcctctgagaggaaagttcttcaccatggactggacctggagggtcttctgcttgctgtcagtagctccaggtgctcgctcccagtgcagctgtacgagtcggggctgagataggaagaagccgtggggacctcgagtgactagtactttctagcgacgacagtcgtggactactacccttcaacccgtctacccttatactacgttacggtaacgtacaccggtccccgaggacgtacgggacgttggaggtggacgttcgggttanaaacgtactaacccggttagtacggggtaagtactaccgttaaacgtaacgtttaccgtactaaccggaaaggtagtaaccgtggaccggtaacggaacccggttaaacttaaccgtagtaaccggtaaccaagggaaaccggaccgtaccgtaaccgaacggtaaacgtaaccgtaaccggtactacgtaaacgggtggtaacgggtagtacggacgaaccgtcggtagaacgtacggtctacgggtaacggaaccgaccgtacgaaagtttcgtaacgttaccgtcgttcgacgttaagttaacccggtggttaacgtacgtaagttacctaacgtttgttaacgtttaccgtacggtactaacccggg

SEQ ID NO: 10341 - DNA, 568 bp, Homo sapiens
  misc_feature: GYAE6OF02GZXUU.53.73.G07.1.454.CMB.1.raw
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (242)..(242): a, c, t, g, unknown or other
  misc_feature (242)..(242): n is a, c, g, or t
  modified_base (268)..(268): a, c, t, g, unknown or other
  misc_feature (268)..(268): n is a, c, g, or t
  modified_base (458)..(458): a, c, t, g, unknown or other
  misc_feature (458)..(458): n is a, c, g, or t
  modified_base (509)..(509): a, c, t, g, unknown or other
  misc_feature (509)..(509): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctggagatgaagacgccgtggggcctcgagtgatgattccngcacanatcngatacgccttcaccgtactcccttanacgtattacggggtacacacgggtcccctagggacgacggggtcttggagtggatgggtactaatcaaccgtggtggtaggatacgtacgaagtttaccacaacgagacgaatcgacgacgggacctagtacccagtacgaccagacgaacgccgtaccaacgacgtacacggtctaacgtagtggaggngagcagctggagtatcgtacgacgaccgacgctattgtattaccgtgtcgngtacttacgttaggcgtaacgttacgacgtactaagtttagttccgtacgactacccgg

SEQ ID NO: 10342 - DNA, 749 bp, Homo sapiens
  misc_feature: GYAE6OF02H8OZR.53.73.G07.1.454.CMB.1.raw
  modified_base (78)..(78): a, c, t, g, unknown or other
  misc_feature (78)..(78): n is a, c, g, or t
  modified_base (195)..(195): a, c, t, g, unknown or other
  misc_feature (195)..(195): n is a, c, g, or t
  modified_base (200)..(200): a, c, t, g, unknown or other
  misc_feature (200)..(200): n is a, c, g, or t
  modified_base (243)..(243): a, c, t, g, unknown or other
  misc_feature (243)..(243): n is a, c, g, or t
tcagcgcgtatacacacgaccggtgctcgatttagctctacgctcagggatcatccaacaaccacatcccttctctanagaagcctctgagaaggaaagttcttcaccatggactggacctggagggtcttctgcttgctgtcagtagctccaggtgtctcgctcccaggtgcagtcgtaggtacaggtcggggntgganagtagaagaacgccgtcgggcctcgagtgagttagtactttcngacaacgactagtacgtaggactaacctcccttacgaaccgtaccttaccccttaattaacgtaagtttcgggtaaccgaccgtacgggtcccccgtagggaaccgtacggggtcttaggtacgtagggtaagttcgggttaacgtaacttaacccgaaacggttaaggtggtacgttacgtaaccttaaacgtaacgtttactaacgaagtaagtaagtaaagtcggaacgtaggggtaaccttaaacgttaacgaacgtaccgacgaaacggtactaacccgtaacgtaccgaaacgtaagtaaccgtaacgtaccgtaagaggttaacgggtagtaacgacgtacgtacgacgttaggtaacgtacgtcgtaacggaacgaacccggtactaccggtagtagtttaacgtttcgacggtagttacgtgtttaacccgtagggtaacgttaacgttaacgttaacgttaaactagttttacggtttccgtaccacggtaaccgg

SEQ ID NO: 10343 - DNA, 813 bp, Homo sapiens
  misc_feature: GYAE6OF02FLWA9.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcgggggctgagatgaagagccgtggggcctcgagtgatgtactttcctgcacgacatcgtggactaccaccttccaccgtactcccttatactagttagggtaccacgacggccccgtagggacgaggggtcttaggacggtgggagttggggtacttaacgtaccgtaaacccgttagggtacggtagggacttaccgttaacgtaacgtttaccgtaccaacgaaggtaacgtaacgtacggaccggtaacggggtaacccgtaaacgttttaacccgaagttaccgaaaccgtaaggaacggtaaacccgtaccggtacccgtaaaccggtaaagttaacccgtaacggttacccgtaaccggtaaggttacggggtaagggttacggtaaccgggacgtaaccgggtaccgtacggtaaacgggtacgttaccgggttaacgggaaccgggaaccgtaacccggggtacctaaacgggtttacgtttaaccgtttaccggttacgggttacggtaaccggttaacgttaccgggttttaaaggggtaccggtttaaacgtttaaaccggttaaccttaacgttaaacgttttaacgttttacggtacccgtaacggttaacccgg

SEQ ID NO: 10344 - DNA, 707 bp, Homo sapiens
  misc_feature: GYAE6OF02F67YU.53.73.G07.1.454.CMB.1.raw
  modified_base (266)..(266): a, c, t, g, unknown or other
  misc_feature (266)..(266): n is a, c, g, or t
  modified_base (484)..(484): a, c, t, g, unknown or other
  misc_feature (484)..(484): n is a, c, g, or t
tcagcgcgtatacacacgaccggtgctcgatttagctctacgctcagggggagtcagacccagtcaggacacagcatggacatgagggtccccgctcagctccgtggggctcctgctgctctggcctcccgaggtgaccaaagtgtgacactccagatcgacccagtcctcctccacctgtctgctatctgtacggagacgagagtccaccgtcacgtcgccggacacgaccaaagtataacgaccgttggttcgcgttaggtacncgacgacgtaaacgaaacggtaacggaaccgccccgttaagaccttcccggtagtaacttacgttaacgtaaacggtaccggtttaacttacgtttaagacgtagggtccgggtaccagttaccgtaacggtcacgggcggtgacgtagggataccggtaggaacgtaggtacgttccgtactaccgactaccgtaagttacgacgccgtccgtacgngacgttcgacggtattacgtttgtttacgtacttaacgttacgttaccgccgtaaacgtaacgactttaacgttaattaggtttccgggaacgttaccgggtaccggtaaaccggaaccgggtaaacgtaacggtaaacgttaacaacgtaaacgcgtggttacgccgtaacgaccgtacgtcttaccgttacgtcttaccgacctacccgtccgaacttccg

SEQ ID NO: 10345 - DNA, 670 bp, Homo sapiens
  misc_feature: GYAE6OF02GKP7Y.53.73.G07.1.454.CMB.1.raw
  modified_base (452)..(452): a, c, t, g, unknown or other
  misc_feature (452)..(452): n is a, c, g, or t
  modified_base (665)..(665): a, c, t, g, unknown or other
  misc_feature (665)..(665): n is a, c, g, or t
tcagcgcgtatacacacgaccggtgctcgatttagctctacgctcagggggagtcagacccagtcaggacacagcatggacatgagggtccccgctcagctcctggggcctcctgctgctctggctcccaggtgccaaatgtgacatccagatgacccagtcctccttccaccctgtctgcatctgtcggagacagagtcaccgtctacgttcggcccgggaccagacccaaagttacttaagacctggtcggcctggtactcagtccaacggaaaccgagggaaaccgccccgtaagaccttaccgtagactacctaagtaaacgaccgttacctaactttacggactaggttcgggtacccatactaacggttcagcggactagtaggactcgtacgggactaggacgttctactctaccgtactattacggacctacgccgtcgtaccncgaccgtcggagttacgttactttacgaccgtaacctttagttaccgtacgacctaaacgtaacgttaacctaacgttaacgttttcgggtaacggttaccggttccgaacggtaacggggtacccgtaaagggtacggaaactacgaaaccgtacgtaggtacgctacgacctaactgttaccgttacgttctaccgtactccgttacccgntaccg

SEQ ID NO: 10346 - DNA, 774 bp, Homo sapiens
  misc_feature: GYAE6OF02H6OH8.53.73.G07.1.454.CMB.1.raw
  modified_base (259)..(259): a, c, t, g, unknown or other
  misc_feature (259)..(259): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtacagtagcctccgaggtgctcgcctcccgaggtgcacgcgtaggtacaaggtcgggggctaggagataggaaacggaacggtccgtggggtacctcgagtgaattggttactttcgngactacgatatacgtagtactaccgtacccttcacccgtaccttaccccttatacttaggttacgggtaaccgaccgaccggtacccccggtagggtaaccggagggggttcttagggtagggtacggtaggtttcgggttaccttaaccgtaacctaaccgttaggggtacggtacggtacttacgtaaacgttaaacggtttaccagtaacgaaggtaacgtaacggtccgtaacggaacgggtaacctaacgttaccgactaacgaacgaacggaccgtaccgtaaccgaccgtaaacggtacgtaaccgtgttaaccgtaaggtacggtgggtaaggtacggagtaccgagaccggtagtacgtacgttacggacggtaacggaaccggtacgtaccgtagttaacgtttagtacgttacgtacgtcggtttaacgtgtttacgggtaagttaaccgttaacgttagtaaacgtttacgttttacggttacgtaccgtaccggtaaccggg

SEQ ID NO: 10347 - DNA, 651 bp, Homo sapiens
  misc_feature: GYAE6OF02FLIJ7.53.73.G07.1.454.CMB.1.raw
  modified_base (187)..(187): a, c, t, g, unknown or other
  misc_feature (187)..(187): n is a, c, g, or t
  modified_base (607)..(607): a, c, t, g, unknown or other
  misc_feature (607)..(607): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccaggtgccaaatgtgacatccagatgacccagtctccttccacctgtctgcatctgtcganacagagtcaccgtcacgttcggccgggccacgaccaaagtacgtaagtaccgtgggttcgcgtggtatcgagcgaagaaaccgaggaacgccctagactcctagatactaagtaacgtaccgtttactacgttagacgtacgggtccgggtaccacttacggtacggttccgacggcgtacgtacggtagtacgtcgggtacggaagtacgttacgttaccgtactaccgtacgaacctagttacgacgctacgtcgcgtacgtcgtcgtaatacgtttaggtttccaacgtttacgttaacttccgtacgaacctaattaccgttaaacttaaccgttagtttcggtaccgtaccggttaccgaaacgggaacgttaacgtaagggtaaactaacgaacgaacgtactggtacgtcganaccctgtacttcgttcgtaccttactacctcccgtacctattcg

SEQ ID NO: 10348 - DNA, 505 bp, Homo sapiens
  misc_feature: GYAE6OF02GAZ7N.53.73.G07.1.454.CMB.1.raw
  modified_base (436)..(436): a, c, t, g, unknown or other
  misc_feature (436)..(436): n is a, c, g, or t
  modified_base (444)..(444): a, c, t, g, unknown or other
  misc_feature (444)..(444): n is a, c, g, or t
  modified_base (459)..(459): a, c, t, g, unknown or other
  misc_feature (459)..(459): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaatcgggggctgagatgaagaagcctggggcctcagtgatgatttcctgcacgacatctggatacaccttcaccgactcccttatacattgggtacgacaggcccctggacaggggcttgaggtggatgggtctaaatcaaacccgtagtggtggatctacaaagttactcacagagaatgacagggccaaattaccatagaccagagaacacgtcacgagtaacagtctacatggaggtgagcagctgagtatntgaggacncgccatgtatactgngcgtatcttagtgtattacgacgtacaattactttgtcagtacccg

SEQ ID NO: 10349 - DNA, 838 bp, Homo sapiens
  misc_feature: GYAE6OF02HS9KR.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccaggtgcagctggtacaagtcgggggctgacgatgaagagccgtggggacctcgagtgatgtacgtttcctggtccgaacgtaactacttaccgtggtaactaacctacctttccaacccggtaccttaccctttaagttactaacggtttaggggtaaccgaacggtaccgggtacccccgtggggtaaccgtacgggggggtcttacgggaaggttcgggaagttcggggtaccttaaacgtaccgtaaacccgttgggtacgggttacggtaagttaccgtaagtaaacggtttacctacgaaccgtaaaggtaacgtaaacggtacggaccgtaaccgggggtaaccgtaaaccgttttaacccgaacggttacggtaacccgaaacgggaaaccggaaccggttaaccggtaccgtaaacggtaacggttaacccgaggttaaccgtaacgtaacgggttaggggtaacgggtacggtaccgaacgacggtacccgttagaacggttactcggtagaacggtaccgaccggtaccgtagtaagtttacgtatagggttacgtacggtaagtttaccggttaacggttagggttaaaccgttaacggtttaacctaaaccggtttaaacgttttagtttttaaccggacgttacccgggtaacccggg

SEQ ID NO: 10350 - DNA, 789 bp, Homo sapiens
  misc_feature: GYAE6OF02FVQ51.53.73.G07.1.454.CMB.1.raw
  modified_base (205)..(205): a, c, t, g, unknown or other
  misc_feature (205)..(205): n is a, c, g, or t
  modified_base (277)..(277): a, c, t, g, unknown or other
  misc_feature (277)..(277): n is a, c, g, or t
  modified_base (737)..(737): a, c, t, g, unknown or other
  misc_feature (737)..(737): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtcctccttccaccctgtctgcatctgtcggagacagagtcaccgtnacgttggccggccagaccaaagtattaacgaccgtggttcggcctggtatcagacaagaaaccgagggaacnccctagactcctagatactaataacgacgttactactttagacgacggttcggggtacccaagttaccgtaaagggtttacgacggtaccgggactagggttacggtaacgttcggttacggggtaactaaaggtacggtttacctaaccttaccgtacccgtaacccttaacgtttacggacctaacggtccccgttaggacccgtaacggtcccttaggtaacgtttcgggttaaactttttccgggaaaccttaaaccgttttaaaccgtttaaccgtacccggtaaacctaaaaccgttaacggttaaaccttaaacgttttaccgttttagggtacccgggttaaccgggtttaccgggaaccggttaaacggggtaacccgttaaagggtaacgggtaaaactaccggtaaaaccgtacgggttagtacgggtactacggacccgtaacccgtnttaccgttacgttccgtttaaccgtaccgtttcccgttacccgtaccgtacg

SEQ ID NO: 10351 - DNA, 766 bp, Homo sapiens
  misc_feature: GYAE6OF02HEVSM.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggaggtcttctgcttgctgtcagtagctccaggtgctcgctcccaggtgcagctggtacaagtcgggggctagagagtagaagaagccgtacggggcctcgagtacgatggtactttccgtgacacgacatcgtaggactacgtaccttacgaccgtaccttacccttatactagttcgggtaacgacgtacggccccgtaggacgacggggtcttaggagtggacgttaggggtacctaaacgtaccgaacccgttagggttacgggtacggtaacttaccgttaacgttaaacggtttacttaacccgtaacggtaacggtaaacggtaaacgttcgggaaccggtaaacgggggtaaccccgtaaaacgttttacccgaagttacgaaacccgagggtaacgaaccgtaaccggttaacccgaacgttacgtaacgtacgtaccgttacgaaggttgggaaggttcgaacggaccgtacggtaccgtaggagttaccgtaccggttagggaccggaacgtacccgggtacctaagttacgttattaccggttgtacggtaccggttagttaccgtttaaggttacggttaacgttaccgtacttaacgtaagttttacgttttacggacgtacgtaaccggg

SEQ ID NO: 10352 - DNA, 667 bp, Homo sapiens
  misc_feature: GYAE6OF02G2YBC.53.73.G07.1.454.CMB.1.raw
  modified_base (240)..(240): a, c, t, g, unknown or other
  misc_feature (240)..(240): n is a, c, g, or t
  modified_base (344)..(344): a, c, t, g, unknown or other
  misc_feature (344)..(344): n is a, c, g, or t
  modified_base (397)..(397): a, c, t, g, unknown or other
  misc_feature (397)..(397): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacgaagtcgggggctggagatagaaaggaagccgtggggcctcgagtgagtgtactttccngcacgacatcgtgactacaccttcaccgaccttccctaataccagtttgggtaccgaccacggtcccctggacgaggggtcttggagtggagtgggtactaacncccgaaaccgtaggtggtgtacgtactacgtaaacgtttcacgaacaggtaanaacgtcggaccgacgggacctaaacttacccatcggaaccgagacgaaccgaccgtacccgaacggtacgtaacgtagttaccgaacgtacgttagggagggtacggagaccgacggtccgtagagtacgtacgtaggaacgggaccgtaaccgggactaaggttacgttaacgtttacgtaggtcggtacgtacgtttacggttacggttagttacgtttaaccgtaacgttaacgttaactttagttttccgtacgacgtaacccggg

SEQ ID NO: 10353 - DNA, 720 bp, Homo sapiens
  misc_feature: GYAE6OF02HYGNQ.53.73.G07.1.454.CMB.1.raw
  modified_base (278)..(278): a, c, t, g, unknown or other
  misc_feature (278)..(278): n is a, c, g, or t
tcagcgcgtatacacacgaccggtgctcgatttagctctacgctcaggggagtcagacccagtcaggacacagcatggacatgaggtccccgctcagctcctgggctcctgctgctctggctcccaggtgccaaatgtgacatccagatgacccagtctccttccacctgtctgcatcgtgtcggagacagagttccaccgtcacgttcgccgggaccagacctaaagttattaacgccgttggtcgcgtggtatcgagacaacgaaaccgaggaacnccccgtagacctcgtagacgttactaagtaacggtaccgttacttaacgtttaacgacgtacgggttccggggtaccctaagtaccgtaaggttccgacggtaccggtaccgtaggtacggtacgtacggtacgggactaaggttacgttaccaccttactacccgtaaccgtagttacgaccgtacgtcccgtacggcctaacggtccctaaggtacttaggttaaccgttttcgaacccgtttaaactttagttaacccgtactaaccgtaaaacttacgttaactaaacgttttcgtttaacggtacgggttaaccggttaccgaaccggtaacgggaaaccgttaagggtaacgtaaactacgtaaaccgtagtcggtaggtcctacggtacaccgttattccgttacgttcctaccgtacttcccgtaccgtctacg

SEQ ID NO: 10354 - DNA, 637 bp, Homo sapiens
  misc_feature: GYAE6OF02H7O9B.53.73.G07.1.454.CMB.1.raw
  modified_base (135)..(135): a, c, t, g, unknown or other
  misc_feature (135)..(135): n is a, c, g, or t
  modified_base (243)..(243): a, c, t, g, unknown or other
  misc_feature (243)..(243): n is a, c, g, or t
  modified_base (286)..(286): a, c, t, g, unknown or other
  misc_feature (286)..(286): n is a, c, g, or t
  modified_base (390)..(390): a, c, t, g, unknown or other
  misc_feature (390)..(390): n is a, c, g, or t
  modified_base (516)..(516): a, c, t, g, unknown or other
  misc_feature (516)..(516): n is a, c, g, or t
  modified_base (540)..(540): a, c, t, g, unknown or other
  misc_feature (540)..(540): n is a, c, g, or t
tcagcgcgtatacacacgaccggtgctcgatttagctctacgctcgaggggatcatcccaacaaccacatcccttctctacagaagcctctgagaggaaagttcttcaccatggactggacctggagggtcttcngcttgctgtcagtagcctccgaggtgcctcgcctcccaggtgccagctggtacaaggtcggggctgagataggaagaaggcctggggcctcgagtgatcgtatttccngcacgacgtattctggatacgtaccttcacctacctcccttanacgtattcgggacgaccacggtcccctggaccgagggtcttgagtgatgggtacctaatacgaaccttagggtgtcggtatactacgtaagtttccacacgtanaaggaacttgcgtaagggacctaaattaccaagtcgacccgaaagacgaacgtaccgaaccgaacggtaaactaggtacctcgttaacgagttacgggagtaggaacgacgaacgctagacgtacncgtagaaggtaccgaacgccggtnaacgttaccgttatcggtacggtacggtcgttacgttaggtagtaacccgtttaggacttaaccgtaaatttcgtttaacggtcgttaaacgcccgg

SEQ ID NO: 10355 - DNA, 586 bp, Homo sapiens
  misc_feature: GYAE6OF02JLYEL.53.73.G07.1.454.CMB.1.raw
  modified_base (171)..(171): a, c, t, g, unknown or other
  misc_feature (171)..(171): n is a, c, g, or t
  modified_base (383)..(383): a, c, t, g, unknown or other
  misc_feature (383)..(383): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtncagctggtacagtcggggctgagatgaagagcgtggggcctacgagtgatgactttcctgcacgactatcgtggactaccaccctttcacccgaccttacccttatactattaggggtacacacggaccccgtggacgaggggtcttggagtcgggtatcggggtactaactcaaccccgtaggtcggtaggtatacctaagtaacgttacncgtaacagaagagttaggacgagggtaccgaattaccgatacgacacgagaccacgccacgagtacagtacacagtggtacggtgacgcacgcgtacgaggtactcgtacgacggtacgacggctagtagttacgtactcggtagcgttatacgtttaggtgtacttacggacttacgtattacttttacggcgtacgtacgg

SEQ ID NO: 10356 - DNA, 799 bp, Homo sapiens
  misc_feature: GYAE6OF02JV4CV.53.73.G07.1.454.CMB.1.raw
tcagcgcgtatacacacgaccggtgctcgatttagctctacgctcagggggagtcagacccagtcaggacacagcatggacatgagggtccccgctcagctccgtggggctcctgctgctctggcctcccgaggtgaccaaagtgtgaacatccaagatacgacccagtcctcccttcccacctgtctgccattcgtcgtcggagacgaggtcgtccaccgtactcggttcggcccggacacgaacctaaagttacttaacgccgttgggttcgccgttggtatcgaagactaacgaaaccgaagggaaccgacccgtagtaccttaccaggtaactacgtaacgtaacggtaccgtttaccgttaacgttacggtaccgtacgggttccggggtaccctaacgttagttaaaccgggttcgaacggcggtaacgtacgggttcgaacggttccggtagggtaaccgtacgttaaccgttaccttactaaccgtacccttaccgtaaagtttccggacgttaccgtaccgtaccgtaactacgggtaccttacggtacgttacgtttaacgtttcctaacggttaactttccgtttaaccgcgtaacccgtaacggttaattaaccgttaacgttttacccgggttaattaccgggttaaccggttaccggggaaccgtaaccggggtaactaaacggggtaactaaaccggtaaccgaagtaccgtggtaccggtcgtaacccgtacgtaccgtagttaccttccgtacgttacctccgtttaccctcgtaccgtacg

SEQ ID NO: 10357 - DNA, 196 bp, Homo sapiens
  misc_feature: GYAE6OF02GJXJ2.53.73.G07.1.454.CMB.1.raw
  modified_base (106)..(106): a, c, t, g, unknown or other
  misc_feature (106)..(106): n is a, c, g, or t
  modified_base (125)..(125): a, c, t, g, unknown or other
  misc_feature (125)..(125): n is a, c, g, or t
  modified_base (148)..(148): a, c, t, g, unknown or other
  misc_feature (148)..(148): n is a, c, g, or t
  modified_base (150)..(196): a, c, t, g, unknown or other
  misc_feature (150)..(196): n is a, c, g, or t
tcagcgcgtatacacacgaccggtgctcgatttagctctacgctcagggcacgaccggtgctcgatttagctctacgctcagggcacgaccggtgctcgatttagngacatctcgcagttcttgngggcgtggcgagacggcataagngnnnnnnnnnnnnnnnnnnnnnnnnnnnnnnnnnnnnnnnnnnnnnnn

SEQ ID NO: 10358 - DNA, 705 bp, Homo sapiens
  misc_feature: GYAE6OF02IIJMN.53.73.G07.1.454.CMB.1.raw
  modified_base (240)..(240): a, c, t, g, unknown or other
  misc_feature (240)..(240): n is a, c, g, or t
  modified_base (247)..(247): a, c, t, g, unknown or other
  misc_feature (247)..(247): n is a, c, g, or t
tcagcgcgtatacacacgaccggtgctcgatttagctctacgctcagggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagtccgtggggaccctcgagtgatgtacttttccgngcacganatctggactacaccttcaccgtactacccttagtactagttgggtacgacgacggcccctaggacgtaggggtcttggacggtggagtcgggtactaactacctaaaccccgtaggtggttaggactacgtaacgtaaagtttacctacgaactagtaagaaacgtcgacgtaacgggacccgtaaattaacccgacgttacgaacccgaaggtaacgaccgtaacggtacccaacggtaaccgtaacgacgttactaacgagttacgggtaagtgggtaacgcgacgtaccgtaggaacgtattcgtaggtaacgggaacgtacccgggacctaaggtttacgtaacgtttaccgttcggtcgtaaccggtaatttaccggttaggttaacgggttaaactttaccggtaacttaaccgttaaagtttacttttacgggtcctaacggtaaccccgg

SEQ ID NO: 10359 - DNA, 762 bp, Homo sapiens
  misc_feature: GYAE6OF02IIXYT.53.73.G07.1.454.CMB.1.raw
  modified_base (400)..(400): a, c, t, g, unknown or other
  misc_feature (400)..(400): n is a, c, g, or t
tcagcgcgtatacacacgaccggtgctcgatttagctctacgctcaggggatcatccaacaaccacatcccttctctacagaagcctctgagaaggaaagttcttcaccatggactggacctgggagggtcttctgcttgctgtcgagtagctccgaggtcgctcgtcctcccgaggtcgcagcgtggtaacgaacggtcgggggctggagtagtaggaaaggaacgtccggtacggggccttcggtagtaggtagtacgttactttccgtagcccgaacgtacctacgttcgtacggacttaaccaccctttccgaacccgtaccctttacccttattaaccgtgtttacgggaaccgaccgtccggacccccgtaggaaccggacggggttcgtaggnggtacggtaggttcggtacttaaacgtaccgttaaccggttaggtggtaacggtacttaccgtaacgttaacgttacctacgaacgtaggttaaacgagtcggaacgtacgggtaacctacgttaccacgtacgaccgaagacgaacgtaccaccgacgtacgtacgtacgttacgtaactaggttacggcggttagacgacgtggacccgtagtaagtaacgccgtaggaaccgtaccggtacggaccgttattcgtttaagttacgttgagttaccggtaacgttcggttagggttaaccgttattaaccgtagttaaaccgttaagttttacggttaactacggtacccggtaaccggg

SEQ ID NO: 10360 - DNA, 607 bp, Homo sapiens
  misc_feature: GYAE6OF02GZBLB.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcggggctgagatagaagagccgtgggcctcagtgatgtacttccgtgcacgacatctagactacctaccttcacccgtaccttcccttaatacgtagttcggtacgacacggcccctgggacgacggggtcttaggaggtggtagtggtctaactctaaccgtgtggtgattcgtaacaacgtttactacgaacgagtaagaatcgacggacggtaccgaattaccagtacgaccaaaggacaccgtactaccgtacgtaacgtacacggttacacgacggtaggacggtcgagacacgtaccgtagacgtagtcgtaggaacggacggacgtaccaagtttgtaacgtttgtgtcgtcgttataccgtttgtacgttacgttactaacgttaacttagtttattaccgtcgaacgtaccgg

SEQ ID NO: 10361 - DNA, 780 bp, Homo sapiens
  misc_feature: GYAE6OF02I978E.53.73.G07.1.454.CMB.1.raw
  modified_base (135)..(135): a, c, t, g, unknown or other
  misc_feature (135)..(135): n is a, c, g, or t
  modified_base (200)..(200): a, c, t, g, unknown or other
  misc_feature (200)..(200): n is a, c, g, or t
  modified_base (218)..(218): a, c, t, g, unknown or other
  misc_feature (218)..(218): n is a, c, g, or t
tcagcgcgtatacacacgaccggtgctcgatttagctctacgctcagggatcatccaacaaccacatcccttctctacagaagcctctgagaggaaagttcttcaccatggactggacctgggagggtcttctgnttgctgtcagtacgctccaggtgcctcgcctccgaggtgcagctggtacagtcggggctgacgangaagagccggtggccctnagtgatcgtacgttcctcgcacactagtcgaggtactactacctccgaccgtaccttaccgttactacgtgttacgggtaccgtaccgcgggtcccgtacggacgtagggtcttggtacgtcggtcgggttcgttacctaacgtacccgacggttacgggttacggtaggtaacctaccgttaacgttaaacgttaccctacgaacgaacggtagtaactacgggcgtaaaccggggtacgtaacctttaaccgaaggttacggaacccgtaacgacgaaccgttaacccgggtacccgaaggttaacgtaacgacgtttaaccgaacgtacggttagggtaggtaacggtaccaggttacggaccgttaggaccgttacgttaaccgtagggaccggtaacggacccggttacgtaaccgtttaacggttaccgtttaccgggtacgttacggttaccgtaaggttttaccggtacgggttaacggttaaaccgtttacctaaccggttaggttttaaaccgtttcggtttaaaccccggttacgacccggtttaacccgg

SEQ ID NO: 10362 - DNA, 799 bp, Homo sapiens
  misc_feature: GYAE6OF02IYP10.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggaggtcttctgcttgctgtcagtagctccaggtgctcgctccagtgcagctgtacagtcggggctgagatgaagaagcctgggggggcctacgagtacgagtcgtactttcctagacacgactacgtcgtaggactaacctacctccaccgtaccttaccttaatacctagttacggtacgacgaccggtacccgtacggacgtacgggtcgttcggtaggtacggtagttacgggttaccgtaaactaaccgtaacccgttaggttacgggttaggaaccgttacgttaacgtaaacgtttaccgttaccgaacgtaacgtaacggtaactacggacgtaacgggaaccggtaaaccgttaaccgtaacgttacggaaaccgtaacgaaacggaaccctaccggttaaccgaacggttaacgtaaccgtaacgttaccgaaacgttagggttaagggaccggtttaacgggactaacccgtacggttaccgtacgggaacgttaacgtttacggaacgggttaaaacccggtacgaaccggggttacccttaagttaacccggtttaagttaacccggtgttaccggacgtttaacggttaccgtttaagggttaacccgtaagttaccggttaactaacgtttaaacgtttgttaacgtaccgaccgtaaccggg

SEQ ID NO: 10363 - DNA, 788 bp, Homo sapiens
  misc_feature: GYAE6OF02JGVFP.53.73.G07.1.454.CMB.1.raw
  modified_base (251)..(251): a, c, t, g, unknown or other
  misc_feature (251)..(251): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtctctgcttgctgtcagtagctccaggtgctcgctcccgaggtgcagtctggtaacacgtcggggctagagataggaagaacggtccgtgggggcctacgtaggtgtaagtcgttactttccgngaccaacgatacgtcgtacgtactaaccctaccttaccgtaacccgtacccttacccttaagtaacgtacgggttaccgggaaccgaccggtacccggtacccggtaacggtaccggtacgggtcgttaggaggttagggtacggttacggtaccgtaacgtaccgtaaccgggttaggtacggttacgtaccttacgttaaccgttaaactaccgtacgaagtaaggaacggtaacgtacggaaccggtaacggtaacctaaacgttaccgacgtacgaaccgtaacgaaccgtaccgtaccgtacgtaacgtacgtactacgtacgtacgtaggtaggtaggtacgacgtaccgtacgtacgtaacgtacggtacgtaccggtaacggaccggtacccgtaccgttaacgttaacgttacgttaacgttacgtaccgttacggtacgtttcggttaacggttaacggttaccgttaacttaaccgttaacttaacgtttacgttacggtttaccggtaccgtaacccggtaacgg

SEQ ID NO: 10364 - DNA, 163 bp, Homo sapiens
  misc_feature: GYAE6OF02H4NV8.53.73.G07.1.454.CMB.1.raw
  modified_base (136)..(136): a, c, t, g, unknown or other
  misc_feature (136)..(136): n is a, c, g, or t
  modified_base (141)..(163): a, c, t, g, unknown or other
  misc_feature (141)..(163): n is a, c, g, or t
tcagcgcgtatacacacgaccggtgctcgatttagctctacgctcaggccacgaccggtgctcgatttagctctacgctcagggcacgaccggtgctcgatttagcagacgtctgtacgcgggctggacaaggccnatagnnnnnnnnnnnnnnnnnnnnnnn

SEQ ID NO: 10365 - DNA, 722 bp, Homo sapiens
  misc_feature: GYAE6OF02JTO5O.53.73.G07.1.454.CMB.1.raw
  modified_base (244)..(244): a, c, t, g, unknown or other
  misc_feature (244)..(244): n is a, c, g, or t
tcagcgcgtatacacacgaccggtgctcgatttagctctacgctcagggatcatccaacaaccacatcccttctctacagaagcctctgagagaaagttcttcaccatggactggacctggagggtcttctgcttgctgtcagtagctccaggtgctcgcctcccgaggtgcgagctggtacaagtcggggctgagatgaagagccgtgggcctcgagtcgatgtactttccgagccgacgacncttcgtaggactaacctaccgttaccaccgtaccttacctttacgtacctagttcgggtaccgaccgacggtaccccgtggaccgtacgggtcgtttaggagtcggtaacgttggggtaaccttaaacgtaacccgaaccccgtttaaggtcgggttacgagttaccgtaacgtaacgtttacctacgtaacgacgtaagtaacgtgaaccgtacgggaaccgtaactaaccgtaacgtcgaacccgagtaccgacctaacgtaccgaaccgtaagtacgtacgtacctacacggttagaacggttggaacgaccggtagtccgtaagtacgtacgtacggtacggaacggtacccgaacggtcctaaacgtgtttaacttccggtttagcgtacggttcgttaacgtttacggtaaggttacgttacgttaaacttaccgtaacggttttaagtttacgttacgaccgttaacccgg

SEQ ID NO: 10366 - DNA, 807 bp, Homo sapiens
  misc_feature: GYAE6OF02HZ0TS.53.73.G07.1.454.CMB.1.raw
  modified_base (254)..(254): a, c, t, g, unknown or other
  misc_feature (254)..(254): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttcgtgcttgctgtcagtagctaccgaggtgtctcgcctcccgaggtgcagcgtaggtacaaggtcggggctggagagtagaagaacgccgtgggcctacgagttagatgttacttccgtagacncgactatcgtaggactacctacctccgaccgtacctacccttatacgtagttaggtaaccgaccgaccggtaccccgtaggaccgggtaggggtcgttaggtaggtgggagttagggtacctaacgtaccgtaacgttggtagggttacgagttaaccgtagtaaacgtttaccaacgtaacgaagtaacgtagtacggaccggaaccgggtaaccgttaaacctaaccgtaacggtaccgaacccgaacggtaaccgaaccccggtacccgtaacccggtaaacgtacggttaaaccgacggttaaccgttaaccgaaggttacggggtagggtacacgggaccgtaacgggtccgtaggttaaccgtagttaccggtaacgggaaacgtacccggaccggttaaccgtaggttacgttttaacgttaccggtagttacccggttaggtaacggtttttaccgtaagggtttacggtaaccgttaaacccgtttaccgttaacgttttaaccgtttaacggttttaccggttaaccgacccggttaaccggg

SEQ ID NO: 10367 - DNA, 751 bp, Homo sapiens
  misc_feature: GYAE6OF02FQZRS.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggcctcccgaggtgccaaatgtgacatccagtatcgaccccagtccttcccttaccacccttgtctgccatcgtggtcggacacgagtacgtcaccgtcacgttcggcccggacgacgactaaagttattaacgaccgttgggttcggccttaggtactcgaacgacgtaaacgaaaaccgtaacgggaacctccccgtaagtcctaccgtagattacgtaagtacgtactcgttaactagacgtaggtccggtacctagtacgtacgtcgacggtcggcgtagtagacgtaggtaggacgtacgtactttccgactccgtacctaacgtacgttacgcgtacgtccgacgtaccggacgtactaagtcgttacgttacgttacgtaccttaaacctttaggtaacctaccgaactaacgtaactttaacgtttaaaggttacggtttacgggtacgggttaccggtaccggggtaaaccggtaacggggtaaaacccgtaagggtaaaccgtaaacgtaaacccggtaaggttacggtacgtacgggtaccgtaacctaacggtaacccttatttacccggtacgtttaccgttacctttcccgggtacccgtttaccccaccgtttcg

SEQ ID NO: 10368 - DNA, 858 bp, Homo sapiens
  misc_feature: GYAE6OF02HDQF3.53.73.G07.1.454.CMB.1.raw
  modified_base (316)..(316): a, c, t, g, unknown or other
  misc_feature (316)..(316): n is a, c, g, or t
tcagcgcgtatacacacgaccggtgctcgatttagctctacgctcagggggagtcagacccagtcaggacacagcatggacatgagggtccccgctcagctcctggggctcctgctgctctgctcccaggtgccaaatgtgacatccagatcgacccagtctcccttccacccctgtctgctatccgtggtcggagacgagacgtactaccgtactacttcggccccgggacaacgaccaaagtaattaacggaccttgggttggcctggtactcgagacgaagaaaccgaacggaaccgtaccccgtagctccgngtacttacgtaactaaggtccgttaccgttactttacggaacgtacggttccggggtacccctaagtaccgtaaagggttcacggtaccggacgtaggtacggtatcgggtacgggaacgtacggtacgttacctacgttaccctaccgaaccttagtaccgtccgtaaccgtcccgttacggtccgaaccgtaccgttaggttacgtttaggtttaacgttttaccgtaaacccgttttaacgtttttaaccgttaacgttaacccgtaaaccgtaaacgtaaaacccgttaacgtttaaacgtttttacgttaccgggggtttaccggttaaccggtttaacccgggaaacccgggtttaaaccgggtaaaccggggttaaaacgggttaaaccggtaaaaagttaacccgggtaaaacggtaccgggtttacgggttacccggaggttacccggaacccggttaaacctccggtttacccttacgggtttacccttccggttaaccctttcccccggtttaaccccggtcgttacccgg

SEQ ID NO: 10369 - DNA, 665 bp, Homo sapiens
  misc_feature: GYAE6OF02GA607.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagagccgtggggcctcagtgatgatttcctgcacgacatctggatacaccttcaccgactcctatacattgggtacgacacggccccgtggacgaggggtcttggaggtggatgggtactaactccaaccgttaggtggtagggactcgtaacgtaagtttacctacaaccaggtaagaagtcggacggaggggaccctaaaggtttacccaagttacggaaccaaggacgaaccgaccgttacccgaacgtagtaacgacggtaccgtaactaaggttcgggagggtgaagggcctaacgggcccgttaggaagtacgttcgtagggaacgggactaaccggggaccttaaggtacgtttaagttaccgtagtcggtaacgtacgttacgtttaaggttacgggttaacgttaaccgtaaccttaacgttaaagtttgttttacggtaccggtaccgtaaccgg

SEQ ID NO: 10370 - DNA, 597 bp, Homo sapiens
  misc_feature: GYAE6OF02F6LJN.53.73.G07.1.454.CMB.1.raw
  modified_base (361)..(361): a, c, t, g, unknown or other
  misc_feature (361)..(361): n is a, c, g, or t
  modified_base (367)..(367): a, c, t, g, unknown or other
  misc_feature (367)..(367): n is a, c, g, or t
  modified_base (409)..(409): a, c, t, g, unknown or other
  misc_feature (409)..(409): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccgaggtgaccaaatgtgacatccagatcgacccagtccttccttcccaccctgtctgctatcgtgtcggagacagagtccgaccgtctacgttcggcccggccacgaccaagtataacgacgtggtcggcgtgtatcagacaacgaaacgaacggaacgccccgtagactctgtactataataagacgttactaacgttagacgtaggtcggtaccagtacgtaggtcagcggngtaggngtatcgagggacagtagtccactctacactagtacgcgcgcngcgtagcgtgtgtgtactttgaactacttatacgtcaacgaactaagtaacttaagtttcgttagtacgggttaccgtaccggaacggtaacggtacgtaaaggtaacgaaacgtaacgtaaacgtacgtaggtaccgtcgacgtaccgaccttgtccttcgttacctgtcctccgttcccgattacg

SEQ ID NO: 10371 - DNA, 803 bp, Homo sapiens
  misc_feature: GYAE6OF02FZ2P3.53.73.G07.1.454.CMB.1.raw
  modified_base (194)..(194): a, c, t, g, unknown or other
  misc_feature (194)..(194): n is a, c, g, or t
tcagcgcgtatacacacgaccggtgctcgatttagctctacgctcagggggagtcagacccagtcaggacacagcatggacatgagggtccccgctcagctccgtggggctcctgctgctctggctcccaggtgaccaaatgtgacatccagatcgacccagtcctccttccaccctgtctgcatctgtcgganacagagtccaccgtcacttcggacccgggccacgaccgtaaaagttactaaacggtaccgttgggttcggccttggtaatcgaacgaccgtaaaggaaaaccgaagggaaaccgtccccgtaacgtaccgttaccctaggaactacgttaaacgtaaacggtaccgttacgttaaccgtttaaggaaccgtacgggttaccggggtacccctaagttaccggtaaacggttaccgtaacggccggtacgacggttgggactttacggacgggggaactacggtaacgtttacctaccgtacctaccgtaacccgttaagttaacgaccgtacgtccgttacggacgaaccgtccgtaggttacgttaggttactttaacgtaccttaaaaccgttttagttaaacccgtagtaaccccgaaacgttaacgtaaactttaaacgttcggtttttaagggacccggttaccggtttaccgggaaacccggtaacggtaacccgggtaaaggttacgtaaaaccgtaacgtaaaaccgtagttacgggtacgtcggttaaccgctaaccgtacttcgtacgttactccgttaccttccttaccccgctaacg

SEQ ID NO: 10372 - DNA, 157 bp, Homo sapiens
  misc_feature: GYAE6OF02G22VC.53.73.G07.1.454.CMB.1.raw
  modified_base (136)..(157): a, c, t, g, unknown or other
  misc_feature (136)..(157): n is a, c, g, or t
tcagcgcgtatacacacgaccggtgctcgatttagctctacgctcagggcacgaccggtgctcgatttagctctacgctcaggcacgaccggtgctcgatttagcagacgtctgagcggctggcaaggcgcatagnnnnnnnnnnnnnnnnnnnnnn

SEQ ID NO: 10373 - DNA, 780 bp, Homo sapiens
  misc_feature: GYAE6OF02JCN7D.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgactgtcagtagctccaggtgctcgctcccaggtgcagctggtacagtcggggctgagatgaagacgccgtgggcctcagtgatgatttcctgcacgcatctggactaccgtacttccaaccgtccttacccttataacttagttcgggtacgaccgtaccggtccccgtaggaccgtaggggtcttaggacggtgtaacgtggtactaactaaccgtaaccgtggtaggtaggtacttactaacgtaacgttacctcaaagtaggaagtacgtaggaccggtaacgggaacccgttaaattaccgaacgttacggaacccgtaagggaaacccgtaacgtaacccggtaacccgtaacggttaaacggtaaccttacgggttaccaacgttcggggtaacgggttaaggtacggtacggaccgttaaccgggtccgtacggtaaggttacgttacggaagggtaacgaacccggtacggtaaccttaccggttttaagttacggtttaacggtaccgggttacggtacgggttaactttacgggtttacgggtaacggtttaacccggtttaaccgttaaccggttaaactttttaaacgttttcggttttaaccgtacccggtaacccggttaaacccggg

SEQ ID NO: 10374 - DNA, 730 bp, Homo sapiens
  misc_feature: GYAE6OF02JBTGM.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgcttgtcagtagctccgaggtgctcgcctcccgaggtgcagtcgtggtacaaggtcggggcgtaggagataggaaagacggccgtggggcctcgtacgtgatgtacttccgtgacacgactagtctagtactacctaccttaccaccgtaaccttcccttaatacgtagttggtaaccgacgaccggtacccgtggtaccggtagggtcgttaggtacgtgggtaaggtacgggttactaaccgtaccgttaaaccgttaggtacggttacggacttaacgtaactaacggtttactacgaacgtaaggaacgtaacgtcggacggtacgggtaaccgtaaacgttaacacgtacggaacgactaacggaccaaccgtaccgtaagtacgtaaacgtacgtacaccgtaggtcgggatacgagccgagttaccgagtaacgtgtcgtaacggacgtaacccggtcggtacctaaggttacgttagttaccgttggaacccgttacggttaccttaggttaaagggtccttaaaggttacccggtaattaaacttaccgtttacgtttaacggtaccgtaaccggtaacccggg

SEQ ID NO: 10375 - DNA, 681 bp, Homo sapiens
  misc_feature: GYAE6OF02IBD3K.53.73.G07.1.454.CMB.1.raw
  modified_base (183)..(183): a, c, t, g, unknown or other
  misc_feature (183)..(183): n is a, c, g, or t
  modified_base (262)..(262): a, c, t, g, unknown or other
  misc_feature (262)..(262): n is a, c, g, or t
  modified_base (353)..(353): a, c, t, g, unknown or other
  misc_feature (353)..(353): n is a, c, g, or t
  modified_base (436)..(436): a, c, t, g, unknown or other
  misc_feature (436)..(436): n is a, c, g, or t
  modified_base (450)..(450): a, c, t, g, unknown or other
  misc_feature (450)..(450): n is a, c, g, or t
  modified_base (478)..(478): a, c, t, g, unknown or other
  misc_feature (478)..(478): n is a, c, g, or t
  modified_base (494)..(494): a, c, t, g, unknown or other
  misc_feature (494)..(494): n is a, c, g, or t
  modified_base (503)..(503): a, c, t, g, unknown or other
  misc_feature (503)..(503): n is a, c, g, or t
  modified_base (507)..(507): a, c, t, g, unknown or other
  misc_feature (507)..(507): n is a, c, g, or t
tcagcgcgtatacacacgaccggtgctcgatttagctctacgctcaggggggagtcagacccagtcaggacacagcatggacatgacgggtccccgctcagctccgtggggctcctgctgctctggctcccgaggtcgaccaaatggtgaacatccaggtatcggacccagtcctccctaccncccgtgtctgcagtccttggacgagaccgagtacgtcctaaccggtcacggttccggcccggcaacacgtaaaacgttnttaaccgggtcgttgggttcgaccggttcggtatacaggtacaacggaaacggaacgggaaccacccgttaagcctacggtataacgttanaaacgttacggtacctaactttaccggtacgtaacggtcgggtccgggtacctaaggttacggaaacggttcgacgggaccgngttacggaacggtntacgggttcggaactaagggtcaccttnctacacgtgtcacgcngtcacgtcngtcngttcttacgtctaacgttacttagtacgtacgacgtaaaccgtataaccgtagttcgttacgccggttacgttcggaaccggtaaggtacggtaaggaacgtaaacgtacgtaaccgtacgtacggacgttcgacacctacgtactgttactcgtacttcgtcctcccgatccg

SEQ ID NO: 10376 - DNA, 787 bp, Homo sapiens
  misc_feature: GYAE6OF02H7L5K.53.73.G07.1.454.CMB.1.raw
  modified_base (156)..(156): a, c, t, g, unknown or other
  misc_feature (156)..(156): n is a, c, g, or t
  modified_base (325)..(325): a, c, t, g, unknown or other
  misc_feature (325)..(325): n is a, c, g, or t
  modified_base (476)..(476): a, c, t, g, unknown or other
  misc_feature (476)..(476): n is a, c, g, or t
tcagcgcgtatacacacgaccggtgctcgatttagctctacgctcgagggggagtcacgacccagtcaggacacagcatggacagtggacgggtccccgctcagcctccgtgggctcctgctgctctcggcctccgaggtcgacctaaatcggtanactactccagtactcgaacctgtccttccctccctacccgtgttctacgctacgtcgtcgggaccggagaaccgagtaccgtcccgtaccgtcgtaccgtccgggcccggtacaacggtaacctaaaagttcgtaaccgtacggttcgggttaccgtacgttaggtacncgacgtaacgaaacggaaaccggaacgggtaacctccctaaacgccgttacgactaacgttacgtaaacgttaccgttacttaacgttacgtacgacggtaccgggttcggtactaacgtagtaacgtcgacggtcgtacgtgtacggacncggtaggaactcgttacgtccgtaatcctaacgtaactacgtacgctacgtcgacgtcgtacgtcgtcgtaacgttcgtttaacgtaccttctaaacgtttactaaccggtaactaaccgtaacgtaacgtttactaacctttgggttacgggttacccgtacgggttacggaaccggtaccgggtaaagggtacgtaaagtaaaccgtaaccggtagtaaccgtgggtacctacggtacctaccgttacgtaccgtttaccggtttaccgacctttaccggtaccccttccggtacccgtactttcccgg

SEQ ID NO: 10377 - DNA, 680 bp, Homo sapiens
  misc_feature: GYAE6OF02HG81K.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcaccgtcacttcggcccgggccagaccaaagtattaagacctgggttcgccgtggtatcagacaacggaaaccgagggaaacgcccctaagacctcctagactactaagtaacgtacgttacttaacgtttaagacgtacgggttcggggtaccctagtaccgtaaggttacgaggaccggtcgaaggttcggtagtcggtaggggaactaaggtacgttactaccgtctaccaacgtagttacgcgtacgtccctgacctagccgtagattcgttatttcgacttaacttagttacgtacgacctaactacgtaactaacgttactttgggtacggttaccggttaccggaccggtaaacgggtaccgtaaagggtacggtaaactaaccgaaacggtacgttaggtaccggtctaacggacctaaccgtacgttccgttacgttccttaccgtaccgtttacccgttacccggacttaacg

SEQ ID NO: 10378 - DNA, 641 bp, Homo sapiens
  misc_feature: GYAE6OF02I5XCT.53.73.G07.1.454.CMB.1.raw
  modified_base (460)..(460): a, c, t, g, unknown or other
  misc_feature (460)..(460): n is a, c, g, or t
tcagcgcgtatacacacgaccggtgctcgatttagctctacgctcaggggggagtcagacccagtcaggacacagcatgggacatgagggtccccgctcagctcctggggctcctgctgctctggctcccaggtgccaaatgtgacatccagatcgacccagtctccttccacctgtctgcatctggtcggagacagacgtcaccgtctacgttcggcccgggaccacgacctaaaaggttattaaacggaccgttgggttcggccgtggtatcagcaacgaaaccagggaacgccccgtagacctcctgactctataagacgtactacttagacaggtcgggtccatctacggtcgagcggcagtggagtcgtacggacagtacgtcactacgtctactagttacgcacgccgtgaccagtccgtaggacttagtagtttcgacttaacttacgttacnctaccaacgtacgttaacgtacttacgtttggtacgttaccggtcgggtacccgtaaggggtaaccgtaaagggtacggaaaacgttacgaaacgttacgtacggtcggtacctcggtaccgtaccctagtttacgttacgttacctttagtacccgtttccgttaccccggtacctaccg

SEQ ID NO: 10379 - DNA, 845 bp, Homo sapiens
  misc_feature: GYAE6OF02IXP7P.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccagggtcgaccaaatggtgacactccagatcgaccccagttcctcccttccaccctgtctgctatctggtcggagaccgagtacgtcaccgtcacgttcggcccgggccacggaccaaagttattaacggaccgttgggttcggccgttggtactacgaacgtacgaaacggaaaacccggaaggggtaaaccgaccccctaacggaccttcccgtaagtacttactaacgtaacggtaccgttaccttaacgtttaacgacgtacgggtcgggtaccctagtaccgtaaggttcgaggcggactaggtaggtacgtcggtacgggaactaggtacgttacctacgtaccctacgtaacctaacgttacgaccgttacgtacccgtcggccgtaacgtccggttagtaacgtttcggtttaagtttaccggtaaacctttaaccgtttatttaacccgttacccggaacccttaaaccggtaaccgtttaacctttaaagttttaacccggtttggggtttaaccgggttaccccggggttttaacgggaaaccccgggttaaacggggaacccggttaaaaggggttaaccggttaaaaccgttaaccgtaaaaccggttacggtacggtaccgggtaacgttaccggaccgttaacctacgtttaccgttccgtttaacttacccttaccttccccggttaccctacccgttaccg

SEQ ID NO: 10380 - DNA, 548 bp, Homo sapiens
  misc_feature: GYAE6OF02GAN12.53.73.G07.1.454.CMB.1.raw
  modified_base (349)..(349): a, c, t, g, unknown or other
  misc_feature (349)..(349): n is a, c, g, or t
  modified_base (408)..(408): a, c, t, g, unknown or other
  misc_feature (408)..(408): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgatttcctgcacgacatctggatacaccttcaccgactcccttatacattcggtacgacacggcccctggacaggggcttgagtggagtgggtctaatcaaccctagtggtgatctacaagttacncacagagatgacaggcaattaccgatgaccagacgacacgtaccacgacgtacagtcanagtaggagtgacgcacgccgtgacgtagtcgtaggaacggacgaccggaccagttcgttagttacgtgtagcgtattacgttaaggtcgtacgttaacgtaactaacttaaacgtttagttttacgtacgtacgtacccg

SEQ ID NO: 10381 - DNA, 705 bp, Homo sapiens
  misc_feature: GYAE6OF02H0DTA.53.73.G07.1.454.CMB.1.raw
  modified_base (166)..(166): a, c, t, g, unknown or other
  misc_feature (166)..(166): n is a, c, g, or t
  modified_base (184)..(184): a, c, t, g, unknown or other
  misc_feature (184)..(184): n is a, c, g, or t
  modified_base (187)..(187): a, c, t, g, unknown or other
  misc_feature (187)..(187): n is a, c, g, or t
tcagcgcgtatacacacgaccggtgctcgatttagctctacgctcagggggagtcagacccagtcaggacacagcatggacatgagggtccccgctcagctccgtggggctcctgctgctctggctcccaggtgcctaaatgtgacacgtccaagtatcgaacccngtccttccttccaccctntcncgctatcgtgtcgagacagactcacgtcacgttcggcccggcacgaccaaagttacttaacgtaccgtggttacggccttaggtactacgacgaccaacggaaaccgaaggtaaccgtaccccgtaagtccctacctagtacttaactaacgtaacgtaccgtacttaacgtttaacgacgtacggtccgggtaccacgttagaacggtacgacggcgtcgagtcgtagtcgagacagtctactctctacctagtacgttacgactacgtccgtagcctacggtctaggtattgttacgttctacgtaagtttacttaccgtacgaccaagttaacgtaacttaaacgtttggttaccgaacgggtttaccgtaccggacggtaacgggaaccgttaagggaaagtaaacccgtaacgtaaacgtaaccgggttcggtacgtcgtaccgttacaccgttaacgttcgttaaccgtttcgttaaccgttaacccgttcccgttacccgtacttaaccgg

SEQ ID NO: 10382 - DNA, 716 bp, Homo sapiens
  misc_feature: GYAE6OF02GIFUL.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccgaggtgcagctaggtacaaggtcggggctgagagtaggaagacgccggtggggcctcgaggtagatgtactttccgtgacaaccgacatctaggactacctacctccaaccgtccttaccttaatacgtgttagggtaccaacggtccgacccgtgggaacggtacggggtcttaggacggtgggtagtcgggtaaccttaacgtacccgaaccgttaggtcggtgtaacgtactaaacgtaacgtttacctacgaataagaacgtacgtacggaaccggtacgggtaccttaaacgtaccaagtaccgaacgtaacggaacgaccccgtaacgacccgtaaggtaaccgtacgtaacgttactacggtaagtagggtacgttaggaccgtacgacgtaccggagtaccgtagttcggaggaaccggtacggacccgtaacttagttacgttaacttcggttgacgtacggttgtttaacgttacggttaggtaaccgttactaacgttaactttaacgtttgtttaacgtaccggtacgtaacccggg

SEQ ID NO: 10383 - DNA, 794 bp, Homo sapiens
  misc_feature: GYAE6OF02JASPH.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctgggagggtcttctgcttgctgtcagtagctccgaggtgctcgctcccgaggtgcagcgtggtaacaagttcgggggctggagagtagaaggaacgccggtcggggacccttcgaggtagagttacgttacgttttccgtcgaccgaccgaactacgtcgttaggtaactacctacccgttacccgacccgtaccttacccctttaattaccgtaggttacggggtaaccgacccgtaccgggccccgttacggggaccggtacggggtccttaggagggtaggtacggttcgggttaacctaacgtaaccgtaacccggttagggttagggtacggtattaccgtaacgttaacgttacctaccgtaagaacggtaagtacgtacggacgggtaaccgggaacccggttaaactaaccgtacgtaacgaaccgacggaacgaccgtaaccggtaccgacggtaataccgtacgtacgtacgtaggttggacggtacgacgacgacgtccgtaggaacgtacgtacgtacggaacggtaccgacgttaccgtagttacgtttacgttacgttcggtacggtacgttacggtttaacggtttggtaacggttaactttaaccgtaacgttaacgttaagttttacggtttaaccgttaccggaccgttaaccggg

SEQ ID NO: 10384 - DNA, 787 bp, Homo sapiens
  misc_feature: GYAE6OF02J0AOX.53.73.G07.1.454.CMB.1.raw
  modified_base (139)..(139): a, c, t, g, unknown or other
  misc_feature (139)..(139): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgntgtcagtagctccaggtgctcgctcccgaggtgctggctaggtaacaaggtcggggctgagagtagaagtaacgccgtgggtccctcgaggttagacgttacggtacttttccgtcggacctaaccgaacgttacttcggttacggaacttaccttaaccctaccgtaccgacccttacccgtttactaaccgtaaggttcgggttaaccgacgtaccggtacccccggtaggtaccgaggggtcttaggtaggttacggtgttaccgggttaactaccgtaaccgtaaacccgttggttacgggtagtacgttaccgtaattaaccgtttaactacctagaacgaaaggtaacctacgtacgggtaacggtccgttaaaacgtaccgttacgaccgtaaacggtaacgacggttaaccgtaacccgtaccggaacgtaagttaaccgtacgttacgtaacgtaaggtaacggttgttaaagccggactacggtagttaacgacgtagtaccgtaacggaacggaacccgtacgggtacctaaggttcgttaacgtgttacggccgttaagtaacttcggtttaaggaccggtttaagaacgttaactttaaggtactttacgtttacggtacgtccgttaaaccggg

SEQ ID NO: 10385 - DNA, 842 bp, Homo sapiens
  misc_feature: GYAE6OF02FR70B.53.73.G07.1.454.CMB.1.raw
tcagcgcgtatacacacgaccggtgctcgatttagctctacgctcgaagggggagtcagacccagtcaggtaccaccagcatggacatgagggtccccgcgtcagctaccgtggggcctcctgctgctctggctcccaggtgaccaaatgtgacatccagatcgacccagtctccgttccaccctgtctgcactctggtcggagacaggactcgaccgtctacttcggccgggccacgaccaaaagttacgttaaacgaccgttgggttacggtccgttaggtacgtaccgaggacgaacggaaaaccggtaacggggaaaccgtaccccgtaagaccttaccgtacgtacttactaacgtaacgtacgttacttacgtttacgacgtacggttaccggggtaccctaagttaccgtaacggttccgaacggtccgggacgtacggtacggtacgttaccggttacggggaacgtaacggttacggtttaccaaccgtttccgtaaccaaccgttaacgttaacgaccgtacgtccgtacgaccgtacgtacccgtaggtaacgttacggtttaacgtttacgaaccgtttaaactttacgtttaaccgtaccgtaaccgtaaacgtaaccgttaaaccgttaacgttttaaccggtttcggttaaccgggttaccggtttaccgggaaaccggtaacgggtaacccggttaaagggtaaaccggtaaaccgttaaaccggaaaccgttacggtacggtacggttaaccgacggtaaccctaaccgttacgttcgtttacggttcttacccgttactttccccggttacccaccggttaccg

SEQ ID NO: 10386 - DNA, 861 bp, Homo sapiens
  misc_feature: GYAE6OF02IMAI4.53.73.G07.1.454.CMB.1.raw
tcagcgcgtatacacacgaccggtgctcgatttagctctacgctcaggggatcatccgaacaaccacactcccttctctacagaagcctctgagaggaaagttcttcaccatggactggaccgtggaggtcttctgtcgttgtcgtgtcagtacgtcgttcctaggtgctacgtctcccgaggtgccgagtcgtggtacgaaggtcggggctggagtagtagaaggaacgtcctaggacggaccgtacgaggtagtattcggtaactttccgtcgtacgtaaccggtactacgttaccgtacggtaacttacccgtaaccgttcccgtaaccccgtacctttaccccgtttaagtaacccgttaacggttttaacggggtaaccgtaaccggtacccggtacccccgttacggggtaacccgggtaacgggggtcctttaagggacggttcgggtaaacggttcgggttaaacgtttaaccgttacccgtaaaccccgtttaggggttacggtaccgggtaactttaccgtaaaccgttaaacgtttaccgtaacaaacggtacggtaaacggtaacgtaccgtaacgggtaaccgggacccgttaaacgtttaacccgagttaaccgaaccgtaaacggtaacgaaccgtaccggtaccgtaacggtacgtactaacgtaacaacgtacgtacggaaggtacgacgtagaccgtacgtagtacgtacgtaccggtaggaccggaacgccggttaaccgagtttacgttacttcgttacggtcggtaacgtccggttaacgttaggtaacgttaacgttaccggaacttaacgttactttacggtttaccgaccgtaacgg

SEQ ID NO: 10387 - DNA, 696 bp, Homo sapiens
  misc_feature: GYAE6OF02I7GK6.53.73.G07.1.454.CMB.1.raw
tcagcgcgtatacacacgaccggtgctcgatttagctctacgctcagggggagtcagacccagtcaggacacagcatggacatgagggtccccgctcagctccgtggggctcctgctgctctggcctccaggtgaccaaatgtgacatccagatgacccagtcctccttccacctgtctgctatctggtcggagacagagtcacgtcacgttcggccgggccaacgacctaaagttattaacgccgttgggttcgcctggtatcagacaacgaaaccgaggaacgtccctaagactctgactactaataagtacgttacttaacgttagacgtacgggttcgggtacctagtacgtaacggttcgacggccggtacgtaggtacggtacttcggtagggaacctaggtacgttaccacgtactaccgaacgtagttacgacacgtcgtcgactacgtccgtagtagttgttacgtttacggaccttaaacgtttacgttactaccgaacctaactaacgttactaaacgtttaccgtttggtaaccgggttacgttaccggaacgtaacgggtaacctaagggttaacgaaacttaacgaaaccggtacgtacggtaggaccttaggaacctaaccggttattaccgttcgtttaacccttacgttacccgtttaccgttaccccgtacgttaacg

SEQ ID NO: 10388 - DNA, 569 bp, Homo sapiens
  misc_feature: GYAE6OF02I3SD1.53.73.G07.1.454.CMB.1.raw
  modified_base (251)..(251): a, c, t, g, unknown or other
  misc_feature (251)..(251): n is a, c, g, or t
  modified_base (367)..(367): a, c, t, g, unknown or other
  misc_feature (367)..(367): n is a, c, g, or t
  modified_base (371)..(371): a, c, t, g, unknown or other
  misc_feature (371)..(371): n is a, c, g, or t
  modified_base (430)..(430): a, c, t, g, unknown or other
  misc_feature (430)..(430): n is a, c, g, or t
  modified_base (459)..(459): a, c, t, g, unknown or other
  misc_feature (459)..(459): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatgaagaagccgtggggcctcagtgatgtatttcctgccacgacatctggatacnccttcacccgtactccttaatacatttgggacgacgacggcccctgggacgaggggtcttggaggtggagtgggtactaatccaaccgtaggtggtggatctacaagttactcaanaganagtgacgaggactaataccatacgacgtaagacgacacgtaccacgaagtacagtctanacgtaggagtgtagcgaagctagatagtntaggagacgacggtcagttgttacttacgtagttacgcgttagttacgtaggtcggttaacgttacgtaacgttacttaaacgtttagttttacgacgtaccgtaaccgg

SEQ ID NO: 10389 - DNA, 733 bp, Homo sapiens
  misc_feature: GYAE6OF02H63IP.53.73.G07.1.454.CMB.1.raw
tcagcgcgtatacacacgaccggtgctcgatttagctctacgctcagggatcatccaacaaccacatcccttctctacagaagcctctgagaggaaagttcttcaccatggactggacctggagggtcttctgcttgctgtcagtagctccgaggtcgctcgcctcccgaggtcgccagcgtggtaccagtcgggggtctagagataggaagacgccggtggggacctcgagtgagttgtactttcccagccgaacgtactagttaccgtggtaacctacctaccgttaccgaccgtaccttaccccttaatacgtacggtttacgggtaacctaacgtaccgggtcccctagggaccgtacgggggtctaggtaggtaggtacgttacgggttactaaacgtacccgtaaccggttaggttcggtacggtaacttaccgtaacgttaacgtaccgtacgaacgtaaggtaagtaacggttcgaacggtacgggaccttaaacgtaccgtacgtacgtaaccgaacgacgtaaccgtaccgtaaccgtacggtaacgtacgtacgttactaacggtaggttaggtaggtgacgtcgaccgtacgtggacgtaatcgtaacggacgaacgtccgtacagttacgtttacgacgtgttacgtacgtactttcggtaacggtacgttaactaccgtaagttaacctaagttttcttaaccgttccgaacgttacgg

SEQ ID NO: 10390 - DNA, 679 bp, Homo sapiens
  misc_feature: GYAE6OF02HEYI5.53.73.G07.1.454.CMB.1.raw
  modified_base (194)..(194): a, c, t, g, unknown or other
  misc_feature (194)..(194): n is a, c, g, or t
  modified_base (239)..(239): a, c, t, g, unknown or other
  misc_feature (239)..(239): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacagtcggggctganatgaagaagccgtgggcctgagtgatgtatttccgtgccacgacntctaggatacaccttccaccgtacctcccttatacctagttacgggaccgacgaccggccccgtagggaccgaggggtcttaggaggtggtagtgggtactaactacctaacccgttaggtggtggacttaccgtaacttaacgttacctacgtacgaagaagtaacgtgaacggacgggtaccgtaaacttaaccgataccgaccgaggaacgaaccgtacggtaaccgacggtaacgtacgtacgtactaagcggttagggaggttgacgtacgacggtccgttaggagttactcggtacgaacggaacccgtacgtacgtaaggttacgttacgttaggttcggtacgtacggttaagtttaccggttagttaacggtaactttaaccgtaactttaacgtaatttttacggttttacggtccgtaaccggtaccgg

SEQ ID NO: 10391 - DNA, 678 bp, Homo sapiens
  misc_feature: GYAE6OF02JDXV2.53.73.G07.1.454.CMB.1.raw
  modified_base (479)..(479): a, c, t, g, unknown or other
  misc_feature (479)..(479): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgcctcccaggtcgcagctggtacaagtcgggggctgacgataggaagaacgccgtggggcctcgagtgatgtattcctgcacgacatcgtaggataccgtaccttccaccgtaccttccccgttatacctaggttcgggtaaccacggaccggtccccgttagggaccgtagggggtccttggaacggtgggacgttgggttactaacgtacctaacccgttaggtgggtaggacttacgtaacgtaacgtttactcgaagtaaggaagtagtacggacggtaacggggacctaaacttaccgaagtacgaaccggtanaaccgaccgtaccgtacccgaaggtaacgttaacacgttaaccgtacttaagggtcggtaggtagtaccgcgacgtccgtaagaccgttataccgacggtacggaaccgccgaaccgttataagttacttacgtcgagtccttaagtccgttaggtacgtagtaacgtacttacaagttttcttacgacgtacgtccgg

SEQ ID NO: 10392 - DNA, 860 bp, Homo sapiens
  misc_feature: GYAE6OF02IGUD9.53.73.G07.1.454.CMB.1.raw
  modified_base (241)..(241): a, c, t, g, unknown or other
  misc_feature (241)..(241): n is a, c, g, or t
tcagcgcgtatacacacgaccggtgctcgatttagctctacgctcaggggatcatccaacaaccacatcccttctctacagaagcctctgagaggaagttcttcaccatggactggacctggagggtcttctgcttgctgtcagtagctccaggtgctcgctcccaggtcgacagctggtacaaggtcggggctgagatcgaagacgccgtaggggcctcgagtgtatagtacttttccgngtaccgacgtactagtcgtagggacctacctacccttacctaccggtacccttccccttaaatacgtagtttacgggtaaccgacccggtaaccggtcccccgtagggtaaccggtagggggtaccgttggtacggttagggtacggttacggggttaaccttaacgttaaccccgtaacccggtttaaggggtggggtttaacggtaattaccggttaaccgtaacggttttaaacaccgtaacgaaggtaacggtaactcggaaccggtacggggtaacctaacgttaccgaacgtacgtaacggacgtaacggaaccgtaccggtacctaacggtaaacgttaacgtacgttaacccttaaggcggtaacgggtacgggttagacccggtacgaacggtacccgttaagggtcgtaaacttccgggaacgggtaaaccgggtaccgtaacccgtaaccggttacgttaaccgtttaacggttacgtaccggttacggtaccggtaaccgtttttacgggtaggtttaaacccgttaaccggttaaccgtttaacccgttaacggttttaaagttttaccgtttaaccgggtacccttaaacgggttaacccccggg

SEQ ID NO: 10393 - DNA, 774 bp, Homo sapiens
  misc_feature: GYAE6OF02F05TT.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccgaggtgctcgctcccaggtgcagctggtacaagtcgggggctgagatagaagagccgtggggacctcagtgatgtatttcctgacacgactatccgtaggaactaccacctttccaccgtacctacccttaatactagttgggtaaccgaccacggccccgtaggacggtaggggtcttggaggtggtacgttgggtacctaactacccgaaccgttaggtgggtaggtacttacgtaacgtaaagtttaccacaacgtaagaagtaacgttacggaccgtacggggtaacctaaaacgtttaccgaacgtaacgaacccgaaaggaaccggtaaccgaacccggtacccgtaaacgttaaccggtaacctaacgtacccgttaacggtaacggttagggtacgggttaacggccggtaaacaccgggtaccgtacgggtaagaacgttaccggtaaggggaccggaaccgcccgggtaacttaggttaaccttttagtttaacggtcggttacggtacgttaacgtttaccggtttaaacggttcggttaacccgtttacgtaaccgttttaacgtttaaccctttaagggtttttacctaccggtacccggtaacccggg

SEQ ID NO: 10394 - DNA, 697 bp, Homo sapiens
  misc_feature: GYAE6OF02HSR4A.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatggaagagccgtggggcctcgagtgatggtatttcctgcacgacatcgtaggactaccaccttcaccgtactcccttaatactagttcgggtacacgacggccccgtaggacgaggggtcttaggagtggacgtcggggtactaacgttacctaaacccgttaggttagggtacgtataccgttaacgtaaacggttttaccacgtaacgtaaggaacgtaagtcggaccgtaacggggacccttaaacgttaccagtacggaaccgaggaacgaaccgaaccggtaccgaacgtaacggttacaacggttacgtaaacgtaggtacgggtaggttacggacgcgtaacgtccgtaaggaacgtattacgacggtaacggtaccgacgtaccgtagtacgttacgttacgtggtagtaccgtagttacgttaggtcggttaaacgttaccggtaactttaacgttaagttttacgtttacgtaccgtacggtaacccggg

SEQ ID NO: 10395 - DNA, 858 bp, Homo sapiens
  misc_feature: GYAE6OF02GXUS8.53.73.G07.1.454.CMB.1.raw
  modified_base (157)..(157): a, c, t, g, unknown or other
  misc_feature (157)..(157): n is a, c, g, or t
  modified_base (322)..(322): a, c, t, g, unknown or other
  misc_feature (322)..(322): n is a, c, g, or t
tcagcgcgtatacacacgaccggtgctcgatttagctctacgctcaggggatcatccaacaaccacatcccttctctacagaacgcctactgagaggaaagttcttcaccatggactggacctggaggtcttctgcttgctgtcagtagctcaggtnctcgctcccaggtgcagctggtacaagtcggggctgagatgaagagccgtggggcctcgacgtgactgtacttccgtgcacgacatcgtaggtactacaccttcaccgtaccttacccttatacgtagttcgggtaacaccgtacggtaccccgttagggaccgnggggtaccttaggacggtaggtaagttcggggttacctaaacgtacccgtaaaccccggttagggttacgggtacgggtaactttaccggtaaccgtaaacggtttacccgtaccgtaaacgaacggtaaacggtaaacgtcggaaccgtaaccgggggtaacccgttaaaacgtttaaccccgaaagttaccgggaaacccgtaaaacgggaacccggtaaacccggtaacccggttaaccccgaaaccggttaacggtaacccgtacggtttaacccgtaaacgtaacgggttacgggtaacgggttacgaaccggtaccgaacggtacccgttagggaaacgttacgttaaccggtaggaaacgggtaccggtaaccgttcccggtaaagtttaacggttaaccggttaccttagggtccggttaaccgtaacggtttacggttttaacgggtacggtttaaacgtttaacccggaacctttaacgttaaacggttttacggttttccgttaaccggtaccggtaaccccggg

SEQ ID NO: 10396 - DNA, 799 bp, Homo sapiens
  misc_feature: GYAE6OF02FM932.53.73.G07.1.454.CMB.1.raw
  modified_base (233)..(233): a, c, t, g, unknown or other
  misc_feature (233)..(233): n is a, c, g, or t
  modified_base (253)..(253): a, c, t, g, unknown or other
  misc_feature (253)..(253): n is a, c, g, or t
  modified_base (284)..(284): a, c, t, g, unknown or other
  misc_feature (284)..(284): n is a, c, g, or t
tcagcgcgtatacacacgaccggtgctcgatttagctctacgctcagggggagtcagacccagtcaggacacagcatggacatgagggtccccgctcagctcctggggctcctgctgctctggctccgaggtgaccaaatgtgacatccagatcgacctagtctcctccacctgtctgactatctgtcgagacagacgtcaccgtcacgtcggccggcagacaagttataacnccgtggtcgccgtaggtacncgagacgtaacggaaaccgacgggtaaaccnccccgtaaggtaccccttacgtagtaccgtaacgtagttaaaccggtcgttacctttacgttaacgacgtagggttaccgggtaccctaagttaccggtaaacgggttcgaaccggtacggtaccgagggtttcggtaacgtttaccgggaaggggaaccttacggacgtttacctccgttaaccgttacgaaccggtttagttaccgaggtacccggtaccttcggaccgttacgtacccggtaggttaattacgtttaccgtttaagacccttaaacttttaccggttaacctaccgtttaaccgtaaaccgttacgtttaaactaaaccggttttccggtttcggttaaccgggtacccgtttaccggggaaccgtaaaaccggggtacccggttaaaggtacccggttaaaacgtaaccggtaaaccggtaggttacggcggttaaccggtccgtaaccgacgtttaccgtacgtttagttccctaacgtcttacccgtccgtacttaccg

SEQ ID NO: 10397 - DNA, 746 bp, Homo sapiens
  misc_feature: GYAE6OF02IC5P9.53.73.G07.1.454.CMB.1.raw
  modified_base (161)..(161): a, c, t, g, unknown or other
  misc_feature (161)..(161): n is a, c, g, or t
  modified_base (172)..(172): a, c, t, g, unknown or other
  misc_feature (172)..(172): n is a, c, g, or t
  modified_base (243)..(243): a, c, t, g, unknown or other
  misc_feature (243)..(243): n is a, c, g, or t
  modified_base (334)..(334): a, c, t, g, unknown or other
  misc_feature (334)..(334): n is a, c, g, or t
  modified_base (456)..(456): a, c, t, g, unknown or other
  misc_feature (456)..(456): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcncctcccaggtncagctggtacagtcggggctgagatagaagacgccgtgggcctcgagtgatgtacttcctgaccacgactntcgtggacctacgtaccctaccaccgtaccttcccttaatacgtacgtttcgggaccaccggtaccggtccccgtaggacggtacggggtnttggacggtggtagttcgggtacttaacgtaccctaaccggttggtcggtagtactacgttaacgtacgttactacaacgagtaagtacgtacggacgtaacgggtacctaattaccggtanaccggtaacgaggaaccgtacctaccggtaccgaacgttacgtaaccgtacggtaccttagaagggttagggtaacggtacgacggacgtaacggtccgtaagtaacggtactaacgggtaacgggtacgggaaccctaaccgggttactaacggttacgtttacttccggtagggttccggaagtttaaccggtttaccgttaagggttaaacccgttaacggttaacccgtttaaaccttaggtttaaactttttccggtttacggacccgtaaccgggttacccggg

SEQ ID NO: 10398 - DNA, 648 bp, Homo sapiens
  misc_feature: GYAE6OF02HDYTK.53.73.G07.1.454.CMB.1.raw
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcgggggctgagatagaagaacgccgtaggggccctcgtaggtgacttgtactttccgngcacgacntactggactacctaccttacaccgtaccgttcccttatacagttacggtaccgaccgacggccccgtaggacggtagggcgtggtaggtggagtcggtactaactaccaccgtagtggtaggtactacggggtactaacgttactacgacgagaagtagtcgacgacggacgtactacgtacgtacgacgagaacgaccgacgtaccgaacgtacgtacgagtacgtacgtacgtgggtacgtagagacgtacggcttaggaacacgttacgtaggacggaccgtacgggacctaagttacgttagttacgtgtacggttacgtcgttacgttaaggtaggttaacgttacgtaacttaacgttaagtttagttttacgtaccgtacgtaacccgg

SEQ ID NO: 10399 - DNA, 795 bp, Homo sapiens
  misc_feature: GYAE6OF02H42S6.53.73.G07.1.454.CMB.1.raw
  modified_base (303)..(303): a, c, t, g, unknown or other
  misc_feature (303)..(303): n is a, c, g, or t
  modified_base (470)..(470): a, c, t, g, unknown or other
  misc_feature (470)..(470): n is a, c, g, or t
tcagcgcgtatacacacgaccggtgctcgatttagctctacgctcgagggggagtcagacccagtcaggacacagcatggacatgacgggtccccgctcacgctccgtggggctcctgctgctcgtggcctcccgaggtcgaccaaatgtgactactccagatcgaccctagtccttccctccctaccctgtctgctacttcgtggtcggaacacgagtacgtcctaccgtactaccggttcggccgggtaccaagtaacctaaaggttactaacggtcgttgggttacgcgttagtacgtanacggaacaacggaaaccgacgggaacctacccgtagtacctacgtaagtactactaacgtacgtacgttacttaacgtttacgacggtacggttaccgggtacctagtacggtaacgtcggagtcggtagtacggtatacggtggtacggactacggtacgttaccnccgttactaaccacgttacgtacgacgtcgtcgtacaccgtacgtcgtagttacgttagttaacgtttacgtaacgttacctttaacgtacgttaccgtaacctaacgtttaaacgttacgtttaaacttccggttttaacgggtaccggttaaccgggtccggaaaccggttaacgggtaaaccggttaaccgggtaaaggaaacccgtttaaaccggtaaacgttacggttacgggaccgtccgtaaccgtaccgtaaccctttagtaacccgtttcgttacctaccgtttaccccggtttccgtaaccccgtacgttaacgg

SEQ ID NO: 10400 - DNA, 629 bp, Homo sapiens
  misc_feature: GYAE6OF02FYMVZ.53.73.G07.1.454.CMB.1.raw
  modified_base (88)..(88): a, c, t, g, unknown or other
  misc_feature (88)..(88): n is a, c, g, or t
  modified_base (197)..(197): a, c, t, g, unknown or other
  misc_feature (197)..(197): n is a, c, g, or t
  modified_base (243)..(243): a, c, t, g, unknown or other
  misc_feature (243)..(243): n is a, c, g, or t
  modified_base (254)..(254): a, c, t, g, unknown or other
  misc_feature (254)..(254): n is a, c, g, or t
  modified_base (294)..(294): a, c, t, g, unknown or other
  misc_feature (294)..(294): n is a, c, g, or t
  modified_base (333)..(333): a, c, t, g, unknown or other
  misc_feature (333)..(333): n is a, c, g, or t
  modified_base (438)..(438): a, c, t, g, unknown or other
  misc_feature (438)..(438): n is a, c, g, or t
tcagcgcgtatacacacgaccggtgctcgatttagctctacgctcaggggatcatccaacaaccacatcccttctctacagaagcctntgagaggaaagttcttcaccatggactggacctgggaggttcttctgtcttgctgtcagtagcctccaggtcgctcgcctcccgaggtgcagctggtaacagtcggggntagagagtagaagacgccgtcgggcctcgagtgatgtactttccgngcgaacgtacnttcgtacgactaccaccttaccgaccctaccttaccttanaacgtaggttcggaacgaccgaccggtcccgaggaccgngggtacttaggagtggtacgtggtacaactaccgtaccgtagtcggtagtactacgtaacttagtaccagtacaggaatacgcgagtaacggtacctaagtacgngtacgtaaccgagacgtaaccacgtacgaacgacgtacgtacgtacacgtaggtaggtacggcagtacgtactacgacgtagatacgacgtacgacgacgtacagttagtacgttagtcgtacgtacgttacgtgttaacgtagttacgtaactacgtatttaacttcggtttacgacgtacgtaaccggg

SEQ ID NO: 10401 - DNA, 620 bp, Homo sapiens
  misc_feature: GYAE6OF02GS56V.53.73.G07.1.454.CMB.1.raw
  modified_base (520)..(520): a, c, t, g, unknown or other
  misc_feature (520)..(520): n is a, c, g, or t
  modified_base (570)..(570): a, c, t, g, unknown or other
  misc_feature (570)..(570): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtgcagctggtacaagtcgggggctgagatagaagagccgtgggcctcagtgatgtatttcctgacacgactatctaggactaccaccttcaccgtaccttacccttatactagttcgggtaccacgaccggtcccctgggaaccgtagggggtccttaggacggtagggtagttcggggtacttaacgtacccgtaaccccgttaggtcggtaggtacttaccgtaacgtaacgtttacctacgaacgtaagagtaatcggacgtacgggaccgtaacttaccgagtaccgaacgagaacgaccacgtaccgaacgacgtactagttactacgaggtaggaggtagagacncgacgtagatagtcgaggacgaccgacgctagtgtactcgtgtcgtagtnttaccggttgtacgtattaccgattaacgtattatttacgcgacgtacgg

SEQ ID NO: 10402 - DNA, 684 bp, Homo sapiens
  misc_feature: GYAE6OF02GFJ8V.53.73.G07.1.454.CMB.1.raw
  modified_base (209)..(209): a, c, t, g, unknown or other
  misc_feature (209)..(209): n is a, c, g, or t
  modified_base (603)..(603): a, c, t, g, unknown or other
  misc_feature (603)..(603): n is a, c, g, or t
tcagcgcgtatacacacgaccggtgctcgatttagctctacgctcaggggatcatccaacaaccacatcccttctctacagaagcctctgagaggaaagttcttcaccatggactcggacctggagggtcttctgcttgctgtcagtagctccgaggtcgctcgctcccaggtgcagctaggtacagtcggggctgagatggaaacganccggtacggggcctagagtcgtagtacgttacgttttccaggaccacggaacctattcgtaggtactacctaccttccgaccgtacccttaccttaacgtaacgtaggttacgggtaacccgaccgtccggtccccggtagggaccgtaggggtcctttaggacggtggtacgttcggtaactaacgtaccgtaacgtaggtcggtcgattacctagtaacgttctacaacgaggtagtaacgtcggacgaacgggtacctaactaccgagtaccgaccgtaagacgacgtaccgtcaacgtacgtacgtactaccgtaagaagttggagtcgaacgtacgtcgacgtagacgttagtcaggacgtacgcgtatacgttgttaacgtgtaccgngaccgttgtaacgttacggtacgttaacgtacccggtaactacggtttaactttcggtaacgtccgtaccggttaacccgg

SEQ ID NO: 10403 - DNA, 701 bp, Homo sapiens
  misc_feature: GYAE6OF02GCFCX.53.73.G07.1.454.CMB.1.raw
  modified_base (236)..(236): a, c, t, g, unknown or other
  misc_feature (236)..(236): n is a, c, g, or t
  modified_base (544)..(544): a, c, t, g, unknown or other
  misc_feature (544)..(544): n is a, c, g, or t
  modified_base (681)..(681): a, c, t, g, unknown or other
  misc_feature (681)..(681): n is a, c, g, or t
tcagcgcgtatacacacgaccggtgctcgatttagctctacgctcaggggatcatccaacaaccacatcccttctctacagaagcctctgagaggaaagttcttcaccatggactggacctgggaggtcttctgcttgctgtcagtagctccaggtgctcgctccaggtgcagctggtacagtcggggctgagatagaagacgccgtcgggcctcgagtgagtagtacttttccgngccacgaactcgtcgtaggactacctccgttacgacccaccgttcccttatacgtagtttacgggtaaccgaccgaccgggccccgtagggacggtacggggtccgttaggacggtggtagtcgggtactaacgtcctaaacccgtgggtacggtagtacttcgtaaacgtacgtttaaccactaacgaaggtaagtaacgtcgtacgggtaacggaccgttaaacttaaccgacgttacggaaaccgtaacgggactaaacccgtaccgtaaccggtaacggtaacgtaccgtaacgtactaacggnggtaacgggtaggtcgaacgtcgacgtacgagtacgtacgtacgtacggaacggaccgaccggtaacgtgttacgttcgtagtgacgttagtcgttacgttaggtacgttacgtaacgttactaacgttaacgtttntacggtacgtcgtaaccggg

SEQ ID NO: 10404 - DNA, 701 bp, Homo sapiens
  misc_feature: GYAE6OF02IT3D5.53.73.G07.1.454.CMB.1.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
  modified_base (297)..(297): a, c, t, g, unknown or other
  misc_feature (297)..(297): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctccaggtgcagctggacaggtcggggctgagagtagaagacgccgtgggcctcgagtagatcgtactttccngcagactntcgagtactacacctcgaccgtctacctatacagttacggacgacacggtcccgnggacgagggtctggacggtaggtcgtagggttactaacgtcccgtaaccggttaggtaggtacggtactacgttaaccgtaacgtttccacgtaaacgtagtaagtaacgtcgaaccggtaaacggggtaccttaaaccgtaaccgtagtaaccgaacgtacgaaccgtaacgtacccgtaccgaacgtaacgtacgaacgttacgaacgtacggtaggtaggttaacgacgacgtacgtcgaacgtaacgacgtacgtacggaacggtaccgaaccgaccgtaacgtacgttaacgttacgtacgtcggtaacggtccgtaacggtttacggtaccggtttaacgttaacgtaaccttaacggttaactttaacggttaggttacccgtaccggtaacccggg

SEQ ID NO: 10405 - DNA, 953 bp, Homo sapiens
  misc_feature: GYAE6OF02IUJXK.53.73.G07.1.454.CMB.1.raw
  modified_base (124)..(124): a, c, t, g, unknown or other
  misc_feature (124)..(124): n is a, c, g, or t
tcagcgcgtatacacacgaccggtgctcgatttagctctacgctcagggggagtcagacccagtcaggacacagcatggacatgacgggtccccgctcagctccgtggggcctcctgctgctcnggcctcccgaggtcgaccaaagtgtagacactccagactacgaccctacgtccttaccccttacccacccttcgtcctcgactacttcgtacggtacggacgacgagacgtcctaccgtcctaccgttccggcccggtaccaacgtaacccgtaaagttaacgttaacggtacccggttagggttccggtaccgttaggttaactacgaaccggaaccgtaaaaccggaaaacccgggaaccggggaaaaccccgtacccccgttaacgtacccgttacccggtagttaaccttaaccgttaaacgttaacggttacccgttttaaccgttaaacgttttacggaccggttaccgggggtttaccgggtaccccttaagttaaccgtaaccgggtttacgacgggtccggtaaggtacggtacggtacgtccgggttaggacgttacgttaacgttacctaaccttaccgtaacctaacggttactacgtaccgtacggtccgtcgtacctacggttactacggttaacgtttcggtttaaacgtttccgtaaacttttaaccgttttacgttaccgttacccgttaaaaccgtaacgtttaaaccgttaacgtttaaccgtttcggttttaaccggggttacccgggttaccgggtttaaacccggaacgggtaaacccgggtaacgttaaacggggtaaacgtaaacgttaaaccggtaacgggttaccggtaggtacccggtaacgtacccgttaacgtaccgtacgttttcccggttacctacctttcccgtacccggtttccccctttacggccctttaaccgg

SEQ ID NO: 10406 - DNA, 705 bp, Homo sapiens
  misc_feature: GYAE6OF02HMOSX.53.73.G07.1.454.CMB.1.raw
  modified_base (299)..(299): a, c, t, g, unknown or other
  misc_feature (299)..(299): n is a, c, g, or t
  modified_base (455)..(455): a, c, t, g, unknown or other
  misc_feature (455)..(455): n is a, c, g, or t
  modified_base (475)..(475): a, c, t, g, unknown or other
  misc_feature (475)..(475): n is a, c, g, or t
  modified_base (698)..(698): a, c, t, g, unknown or other
  misc_feature (698)..(698): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatcgacccagttctcccttccaccctgtctgctatcttgtcggagacagtacgtccacccgtcaccgttcggcccgggccagaccctaaaagtacttaacgaccgttgggttcggccttggtatcgagcaagaaaccgaacgggaaccncccctagacctcctagattactaataagtaccgttcttaactttacgacgtaggttccggggtaccctaataccgtaacggttcgaacggcgacgaggtggtacgtcggaggtacgtaggtacgttctaactccgtacacgtattacgccagtccncgactacgcctgattagttntttcgaacctttaacttacttacgtaccgaacctacgtaacgttaactaacgttttacgttttacggtaccggttaaccggtttacggaaacccggttaacggggaaccggttaaaagggtacggtaaaaccttaacgaaaccgttacggtacgggttaccggtgtacccgactaacccgtcgtttacgtcgtttaccttacttacccgttccttaccccgtnttaaccg

SEQ ID NO: 10407 - DNA, 764 bp, Homo sapiens
  misc_feature: GYAE6OF02IFZ7I.53.73.G07.1.454.CMB.1.raw
  modified_base (200)..(200): a, c, t, g, unknown or other
  misc_feature (200)..(200): n is a, c, g, or t
tcagcgcgtatacacacgaccggtgctcgatttagctctacgctcgagggggagtcagacccagtcaggacacagcatggacatgagggtccccgctcagctcctggggctcctgctgctctggcctcccgaggtgaccaaatgtagacatccagatcgacccagtcctcccttccaccctgtctgctatctggtcgganacgagagtaccacgtctacgttcggccggaccacgacctaaaggttacttaacgtccgtggttcggccgttaggtactcgacgacaaacggaaaccgaacggaaccgccccgtaacgtccgtacctagtactactaacgtaaacgtacgttacttaacgtttacgacgtacgggtacgggtaccctaatacgtaggtacgtacggcggacgtaggtcgagtcgtagggactagtacgtctacgtcctactacgtactacggctacgtacctcgtaccgacgttccgtagtagttacgtacgtttacgaactttaaacgtttacgttaacgtaccgtaaacctaacgtaaaccgttacttaaaacgttccgtttaacggtaaccggttaccgttaccgggaaccggttaaacgggaaccggttaaagggtaaacgtaaacgttaaacccggtaaacgttacgtaccgggttacggtaccgtaacggtaacccgtaccgttaacgttcgtttaccgtaccgtttaccttaccccggtttaccccgttcccccgtaagtttccccgg

SEQ ID NO: 10408 - DNA, 681 bp, Homo sapiens
  misc_feature: GYAE6OF02JH6H3.53.73.G07.1.454.CMB.1.raw
  modified_base (161)..(161): a, c, t, g, unknown or other
  misc_feature (161)..(161): n is a, c, g, or t
  modified_base (265)..(265): a, c, t, g, unknown or other
  misc_feature (265)..(265): n is a, c, g, or t
tcagcgcgtatacacacgaccggtgctcgatttagctctacgctcaggggatcatccaacaaccacatcccttctcgtacagaagcctctgagaggaaagttcttcaccatggactggacctgggagggtcttctgcttgctgtcagttagctaccaggtncctcgccttcccgaggtgcagtcgtaggtaacaggtcggggctgagataggaagaagccgtagggcctgaaggtgagtgtactttccgcgacacgactactcgnggtataccgtaccttcaccgtactaccttatactagttcggactacgacggtcccgtaggacgtacgggtcgtagaggtcggagtcgggtactaacgtaccgtaacgtggtggtaggtacttactaagtaacttactacgaacgtagaacgtagtcgacggtaacgggtacctaaacgttacctagtaccggaaccgtaagaacggtaccctaaccggtacccgaagtaccgtaacgtactaccgtagaccgttaagggcggttaggaaccgcgtaacggtccctaagacgttacgtcgtaagtaccgacgtaccgtacgtatccgttaagttacgttgacgtagttacgttaggttcgttaggtaacttaaccgtattaacgttagttttacgttacgtacccgtaggtaaccgg

SEQ ID NO: 10409 - DNA, 709 bp, Homo sapiens
  misc_feature: GYAE6OF02GTING.53.73.G07.1.454.CMB.1.raw
  modified_base (95)..(95): a, c, t, g, unknown or other
  misc_feature (95)..(95): n is a, c, g, or t
  modified_base (198)..(198): a, c, t, g, unknown or other
  misc_feature (198)..(198): n is a, c, g, or t
tcagcgcgtatacacacgaccggtgctcgatttagctctacgctcagggggagtcagacccagtcaggacacagcatggacatgagggtccccgntcagctcctggggctcctgctgctctggcctcccaggtcgaccaaatgtgacatccagactcgacccagtcctccttaccacctgtctcgctatctgtcgganacagacgtccaccgtcacgtggccggcacgacctaaagtattaacgaccgtggttcggacctggtactacgagaccgaagaaaccgacgggaacgtcccgtagacctcctagactactataacgtacgtacttacgttacgacgtacgggtcgggtacctagttaacgaacggttcgacggtacgggtacgtaggtacggacttcgggtacggacgtaagtcgtactacctacgtccaaccgttagtacgacgtacgaccctcggacgacgtacgttacgtattacgttaacgtttcgaaacttaactttaacgttaccgtaccgttaacccaagttaacgttaaaccttaggtttaaccggttaggttaccggtaccgggttacgaaaccggttaacgggaaccttaaggggtaacaaaactaccggtaagttacggtcggtaggtaccgtcgtaacctacgtattaccggtcttaccgtaccgttacccgtcccttaccgaccttacgg

SEQ ID NO: 10410 - DNA, 751 bp, Homo sapiens
  misc_feature: GYAE6OF02F1RTK.53.73.G07.1.454.CMB.1.raw
  modified_base (744)..(744): a, c, t, g, unknown or other
  misc_feature (744)..(744): n is a, c, g, or t
tcagcgcgtatacacacgaccggtgctcgatttagctctacgctcagggggagtcagacccagtcaggacacagcatggacatgagggtcccccgctcagctcctggggctcctgctgctctggcctcccgagggtcgaccaaatggtagacatccagatcgaccctagtcctcccttcccaccctgtcctgctactctggtcggagacagtacgtccaccgtctaccttcggcccgggcaacgacctaaagtaattaacggaccttgggttcgccgtggtatcagacaacgaaaccgaacgggaaccgaccccgtagacctccgtagtactacgtaataacgaccgttaccttaacgttaggaccgtagggttcgggtacctagtacgtaacggttcgacggtacggcgacggtagtacgtcggtaggggactaggtacgtaccaccgttccacctaaccgtagttacgactacgtccgacgtacgtaagtcccgtagtagttacgtttaacgtttacgtaacttaacgtttaacttacgtaccgtaacctaaaccgtaacttaacgtaacttttacggtttaacgggtaacggggttacccggttaaacccggggtaaccggtaacggggtaaaccggtaaacgggttaaacgaaaccggttaaccgaaacggttacgtacgggtagtacggtaccgacctaccgtagtacgttcgttcccttatcccgttacccgttaccnttaaccg

SEQ ID NO: 10411 - DNA, 818 bp, Homo sapiens
  misc_feature: GYAE6OF02H89UW.53.73.G07.1.454.CMB.1.raw
  modified_base (162)..(162): a, c, t, g, unknown or other
  misc_feature (162)..(162): n is a, c, g, or t
  modified_base (195)..(195): a, c, t, g, unknown or other
  misc_feature (195)..(195): n is a, c, g, or t
  modified_base (207)..(207): a, c, t, g, unknown or other
  misc_feature (207)..(207): n is a, c, g, or t
tcagcgcgtatacacacgaccggtgctcgatttagctctacgctcagggggagtcagacccagtcaggacacagcatggacatgagggtccccgctcagctcctgggcctcctgctgctctgcctccagggtgccaaatgtagactactccagatcgaaccngtctcccttcccaccgttgtctacgcacgttcnggtacggacganacgcgtaccacctctacgttcggacccgggtaccaccggaccgtaaagttaacgttaacgaccggttgggttcggtaccgtaggtagtacgacggtaacaaccggaaaccggtaaacggggaaacccgtaccccgttacgtaacccgttaccgtacgtaaccgttaccttaacgtaaccggtacggtttaaccttaaaccgtttacgtaaccgggtaacgggtttccgggtacccgtaagtaacccggtaaacggtgggaaccccccccccggtggtaccgtaacggttacgggtaccgtacggttacgggaacgtaacggtaactttaccgtaccgttcccgtacccctaccgttaactaaccgggtcggtacccgtacgcgtaacctcgtaccgtacgttagttacgttagtttaccgtaacgttaactttacgttaccgtacgtaacgttaccgtaaacttattaaccggttgttagttaccgtcggtaccggacgtaacgtaacgggttaagtaagaaaccgttaacgtaacggtacgtacgtacggctacggaaccttaacgtgttaccgttaccttctaaccgttcttacccgtttcccgatccg

SEQ ID NO: 10412 - DNA, 648 bp, Homo sapiens
  misc_feature: GYAE6OF02HJ5X3.53.73.G07.1.454.CMB.1.raw
  modified_base (172)..(172): a, c, t, g, unknown or other
  misc_feature (172)..(172): n is a, c, g, or t
  modified_base (218)..(218): a, c, t, g, unknown or other
  misc_feature (218)..(218): n is a, c, g, or t
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccaggtcncagtcgtggtacaagtcggggctgagatagaagagccgtgggcctnagtgatgtactttcgngcacgcatcgtgactactacccttcaccgtacctccttatacgtacgttaggacgacaccggccccgtggacggngggtctaggaggtgggtagtcgggttactaactcccgtaacgttaggttggtacgtactacctaacgtaacgtacttaacctacgaagagaacgtagtcgacggtacgggtacctaacgttacgacgtacgaacgtaacggaacaccgtaccgtaccgaagtcgtaacacgtactaacggaggttgggtaggagtacgacgacgtacgtaggacgtacgtacgtaggacggaccgacggtactaagttacgttacgtaccgttggtacgttcccgtagttacggttaacgtacgtttaacgtacgtaacttaacttaagtttacgtttcgaccgtacgg

SEQ ID NO: 10413 - DNA, 824 bp, Homo sapiens
  misc_feature: GYAE6OF02IFNHP.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggcctcccaggtgccaaatgtgacatccagatcgacccagtcctccttccaccctgtctgcatctggtcggagacaggtacgtccaccgtctacgttcggcccgggaccacgacctaaaagttagttaacgaccgttggttcggcctggtactcacgcaacggaaacgaacggaacgccctaagacctcctagactactaataacggtaccgttacttaacgtttacgacggtacgggttaccgggtacccctaagttaccgttaaacgggtttccgacgggtaccgggacgtaagggttacggtaacgttccgggtaaggggtaaaccctagggttaaccgttacccgtaaccgttacccttaacccgtaacccgttaagtttaaccgacccgtaacggtcccgtacggtacccgtaacggtcccgttaaggtaccgtttaggtttacttttaaccggaaccttttaaacgtttaaccttaccgtacgaaacccttaaacgtaacgttaactaaacgtttcgtttacgggtaccggttacccggtttaccggaaccggaaacggggtaaccgtaaagggtaacggtaaaacgtaccgtaaaccgggtacgttacggtaccggtctaccgtaacccgtaacgttaccgttacggtttactttccggttaaccgtaccctttcccggttcccccgatttaccgg

SEQ ID NO: 10414 - DNA, 696 bp, Homo sapiens
  misc_feature: GYAE6OF02GDM2J.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagagtcacccgtcacgttcgccgggccagaccaaagtacttaacgaccttgggttcggcctggtatcagtcaagaaaccgagggaaacgcccctaagacctcctagatactaataacgtacgtcttacgtttagactaggtcggggtcccagttcgtaaggttcaggcggcaggtggatcgtaggacagacgttacactctacacctagttacgacacgtcctgacctagtcctagtattgttatttacggacttaactttaacttcgtacgtaaccctaaacgtaacgttaaacctaaacgttttaccggttttaggttaccgggttaaccgggtttcccgggtaaccggtaaacggggttaaacccggtaaacgggtaaacggttaaaactaacccgtaaaacggttacgtcgggttacggtcgttaccggaacctaaccgtagttacccgtttcggttccctttacccgtacctttccccgttaccccggactttaaccgg

SEQ ID NO: 10415 - DNA, 641 bp, Homo sapiens
  misc_feature: GYAE6OF02FVA0T.53.73.G07.1.454.CMB.1.raw
  modified_base (201)..(201): a, c, t, g, unknown or other
  misc_feature (201)..(201): n is a, c, g, or t
  modified_base (601)..(601): a, c, t, g, unknown or other
  misc_feature (601)..(601): n is a, c, g, or t
tcagcgcgtatacacacgaccggtgctcgatttagctctacgctcagggggagtcagacccagtcaggacacagcatggacatgagggtccccgctcagctcctggggctcctgctgctctggctcccaggtgaccaaatgtgactactccagatgacccagtcctccttccaccctgtctgctatcgtgtcggagacagngtcaccgtcacttcggccggacacgacctaaagtacttaagccgtggttcgctggtatcagtacagaaaccgagggaacaccccgtagacctactaggactactagtaacgtaccgttactaacttaggacgtacggttcgggggaccctagttccgtaaaggttcgagaccgggctaggtacggtacgtacgttggggaactacggtagttacctacctctaccacgtactacgacgacgtcctacgcaccgctacggtagtcgttagttctaactaccttattaacgtcaccgtaaactacgtacttaactcgtttagacggtaccgtacgacgaacggtaccgtaaggtacgtaaatacgtaaacgtcgttcggtaggtctagaccctataccgttntaccgtttacttcctaccggtttccctaccgttcctaacg

SEQ ID NO: 10416 - DNA, 730 bp, Homo sapiens
  misc_feature: GYAE6OF02FZY6J.53.73.G07.1.454.CMB.1.raw
  modified_base (372)..(372): a, c, t, g, unknown or other
  misc_feature (372)..(372): n is a, c, g, or t
tcagcgcgtatacacacgaccggtgctcgatttagctctacgctcaggggggagtcagacccagtcaggacacagcatggacatgagggtccccgctcagctcctggggctcctgctgctctggctcccaggtgccaaatgtgacatccagatgacccagtctccttccaccctgtctgcatctgtcggagacagacgtcacccggtcacgttcggccgggaccaacgacctaaagtaattaacgaccgtggttcggccttggtatcagacgggaagaaaccgaagggaacgccccgtagactcctgatactataacgtacgtactaactttagacgaggtcggggtacccatacgaaggttcaggccgganaggtggtatccgtagggacaggtacgttaccacttcctacctaaccgtagttacgacctacggtcccgttagaccgacggtcccgttaggtactggtttaacgttttcggtacccttaaacttttaacgttacgtaccgtaacccgtaaactaacggttaaacctaaagtttaccggtttaacggtacgggttacccgggttaccgggaacccgggtaaacggggtaacccgtaaaggtaacggaaaaccgttaaccgaaaacggtacgttgggttaccgggtactacggaccctaacgtacgttaccgttcggtttacccttaccgtaaccttccccggttacccgaccgttaaccg

SEQ ID NO: 10417 - DNA, 756 bp, Homo sapiens
  misc_feature: GYAE6OF02FSMOG.53.73.G07.1.454.CMB.1.raw
tcagcgcgtatacacacgaccggtgctcgatttagctctacgctcagggggagtcagacccagtcaggacacagcatggacatgagggtccccgctcagctcctggggctcctgctgctctggcctcccgaggtgaccaaatgtgacatccagatcgacccagtctccttccaccctgtctgcatctgtcggagacagagtcaccgttcacgttcggccggccaagacctaaagttattaacgacccgttgggtcggaccgttaggtatcgagactaaggaaaccgtaagggaaaccgccccgtaagaccttcctagtactactacgtaacgtacgtacgttacgtttacgacgtacggttcggggtacccaagttccgaacggttaccaggtcggtacgtaggtacgggtactcggtacgggactacggtattaccgtacctaccgtactacccgtaactttacggaccgtacgtaccccgtggaccgtcgtaccggttagtacgtttacggttacgttttacgaaccttaaacgttttacttaccgtaccgtaaccttaacgtacgttaacctactttacggttttacggtacgggttaccggtttaccgaacgggttaaccgggaaccgttaaacgggtaggtaaaaccgttaccgaaacgttaccggtcggttaccggccgtaggtaccctaaccgttcgttacgtcggtttaccttaccttaccgggttaccccttacccggtacttaccg

SEQ ID NO: 10418 - DNA, 770 bp, Homo sapiens
  misc_feature: GYAE6OF02I7QFO.53.73.G07.1.454.CMB.1.raw
tcagcgcgtatacacacgaccggtgctcgatttagctctacgctcaggggatcatccaacaaccacatcccttctctacagaagcctctgagaggaaagttcttcaccatggactggacctggagggtcttctgcttgctgtcagtagctccaggtgctcgctcccgaggtgcagctggtacaagtcggggctagagatagaagaagccgtggggcctacgagtgatacgtactttccgtgacgacgactagtcgtacggaacttacctacccttaccaaccgtaccttacccttaattacgtacgttacgggtaaccacgtaccggtccccgtagggaaccgtaggggtcttaggacggtaggacgttcggggtactaacgtaccgtaaacccgttaggttcggtagacttaccgtaacgtaaacgtttacctacgtaacgaagtaagacgtacgacggtaacgggacccgtaattaaccgacgttacgaaccgtaacggaacgaccgtaacgtaccgaacggtaacgtaacgtacggtaccgttaatagggtcggtaaaggtacggacgtaccggaactaccggtaggtaacgtaccgttcgtaacgggtaaccggtacgtaaccgggtacgttaggttaccttaagtttacccgagggtttaccgtaacggttcgtttaaccggttaagggtaacgttaaccgtttaacggtaaccgttaacgttaaggttttacgtttaccggttaaccggtaccgttaacccggg

SEQ ID NO: 10419 - DNA, 768 bp, Homo sapiens
  misc_feature: GYAE6OF02IW38P.53.73.G07.1.454.CMB.1.raw
  modified_base (175)..(176): a, c, t, g, unknown or other
  misc_feature (175)..(176): n is a, c, g, or t
  modified_base (242)..(242): a, c, t, g, unknown or other
  misc_feature (242)..(242): n is a, c, g, or t
tcagcgcgtatacacacgaccggtgctcgatttagctctacgctcaggggatcatccaacaaccacatcccttctctacagaagcctctgagaggaaagttcttcaccatggactggacctggaggtcttctgtcttgcttgtcagtagctccgaggtgctcgcctcccaggtgnngcttggtacaaggtcggggctggagatagaagaacggccgtcgggcctcgagtgtatgtactttcncgcaccgacattcgtggactaacctaccttccaccgaccttaccttactacgtagttacggtaacgaccgacggaccccgtagggacggaggggtcgttaggaggtggaggttcggtacttaacctaccgtaaccgtaggttacggttaggtaacgttcgttaacgttaaggtttactacctaacaaggtaagtaagtacggacggtacgggtaacccgtaaacgtttaaccgtaacgtaccgtaaaccgaacggtaacgaaaccgtaacccgtaacccgtaacggtaacgtaacgtaacgttacccgtaacgttacggtagggtaccgttaggaccgtacgaccgtacctaggtacgtataccgtaaggaaccggtaccggaaccgttacgtaacgttaggtttaacgttaccgttacggttacgtaacggttaacgtttaccggtttaaggtaccggttaacgtttaacggtaacctttaacgttaagttttacgttttaccggttactaacccggtaaccggg

SEQ ID NO: 10420 - DNA, 697 bp, Homo sapiens
  misc_feature: GYAE6OF02G023C.53.73.G07.1.454.CMB.1.raw
  modified_base (194)..(194): a, c, t, g, unknown or other
  misc_feature (194)..(194): n is a, c, g, or t
  modified_base (615)..(615): a, c, t, g, unknown or other
  misc_feature (615)..(615): n is a, c, g, or t
tcagcgcgtatacacacgaccggtgctcgatttagctctacgctcgagggggatcgatccaacaaccacatcccttctctacagaagcctctgagaggaaagttcttcaccatggactggacctggagggtcttctgcttgctgtcagtagctcgaggtgctcgctccaggtgcagctggtacaagtcgggggntggagatagaaggacgccgtggggcctcgaggtgagttcgtacttttccgacgacgtacgtactacgtcgtacggtaactacctacccgttccgaaccccgttacccttaccctttaacgtacctacggtttaccgggtaaccgaccggtaccggtcccccggtagggaaccggtacgggggtacttacggtacggtagggtacgttcggggttaacttaacggaccgtaaacccggttggtacgggttaggtacttaccgtaacgtaagttcctacgtaacgtaagacgtaagtcgaccgtacggactaacgtaccagtacgactaagacgtacaaccgtaccgacgtaacgtagtaccgtacgtagagttagggacgagacgacgcgtcgtagacgtatcggtagacggtacgtaccgngtatagttaacttgtacgtgacgtagtacgttaggtgtattaccggtaactacggttaactagtttacgacgtaggtacccg

SEQ ID NO: 10421 - DNA, 724 bp, Homo sapiens
  misc_feature: GYAE6OF02FSH6Z.53.73.G07.1.454.CMB.1.raw
tcagcgcgtatacacacgaccggtgctcgatttagctctacgctcaggggggagtcagacccagtcaggacacagcatggacatgagggtccccgctcagctcctggggctcctgctgctctggctcccaggtgaccaaatgtgacatccagatgacccagtctccttccacctgtctgcatctgtcggagacagagtccaccgtctacgttcggcccgggaccagaccaaaagttagttaacgacccgttgggttacggccgttagggtactcaaggacaacggaaaacccgaaggggtaaaccgaccccctaggaaccttccgtagacgttactaagtaaacggtacgttacttaacgtttaacgaacgtaacggttacgggggtacccaagttaccgtaacggttcgaacggtcgggactacggtaggtaacgtcggtacgggaactaggtacgttacgacctttacgtacccgtaacctaagtttacgaccaacggtccctacgacgtacggtacctagtacgtagttactttacgacttaaactttacgttactcgacctaaacgtacgtaaactactttacgtttaggtcggtaaccggttcggaacgtaaccggggtaacgaaagggtacgaaacgtaccgaacgtacgtcggtacggtacggcgtacccaactacgttccgttcgttacttccgtacttcccgtacccgtactacg

SEQ ID NO: 10422 - DNA, 679 bp, Homo sapiens
  misc_feature: GYAE6OF02IY8Y2.53.73.G07.1.454.CMB.1.raw
  modified_base (516)..(516): a, c, t, g, unknown or other
  misc_feature (516)..(516): n is a, c, g, or t
tcagcgcgtatacacacgaccggtgctcgatttagctctacgctcaggggatcatccaacaaccacatcccttctctacagaagcctctgagaggaaagttcgttcaccatggactggacctggacgggtcttctgcttgctgtcagtagctccaggtgctcgctcccgagtgcagctggtacaagtcggggctgagactgaagacgtccgtgggcctcgagtcgatgatttcctagcaacgactagtcgtaggatacaccttaccacccggtaccttcccctttaaacgtaccgtacgtttcggggacaaccgacggtcccccgtagggaccgtaggggtcttggtaggtggtactggggtacctacgtaccgaaccttagtggtcggacttcgtacaaagtttccctacacgatacgtaatcgacggacgggtacctaaagtacccgtatacgtaccaaggaacgctaccgtaccgaacgacttacacgttactacagttgggagttacggacncgtaccgcgtaggtacgtacgtaccgtacgtacggaacccggtccgtacgtaactttacggacttaacgttcggtgtaccgtacgtttaacgttacggtaacgttaacgttaaccgtaaccgttaacgtaaggtttaacctttcgtacgtaccggtaacccgg

SEQ ID NO: 10423 - DNA, 738 bp, Homo sapiens
  misc_feature: GYAE6OF02F4TEU.53.73.G07.1.454.CMB.1.raw
  modified_base (252)..(252): a, c, t, g, unknown or other
  misc_feature (252)..(252): n is a, c, g, or t
  modified_base (324)..(324): a, c, t, g, unknown or other
  misc_feature (324)..(324): n is a, c, g, or t
tcagcgcgtatacacacgaccggtgctcgatttagctctacgctcaggggatcatccaacaaccacatcccttctctaacagaagcctctgagaggaaagttcttcaccagtggactggacctggaggtcttcgtgctgctgtcagtcgactccgaggtgcgtcgccttcccgaggtcgctacgctggtaacagtcggggctgagagtagaagacgcgtcgggcctgagtgactgtacttcgtgaccacgancgtcgcgactaccgtactccgacctacctccttatacgtagttacggacaccgaccggtccgtacggacggnggtccgttagtaggtacggtagtcgggtacttaaacgtaccgtaaccgttggtcggtacgtacgtaccttaaacgtaacgtttacgaaccgtagtaacggaaagtaacgtccgacgggtaacggttaccgtaagttaacccgacgtacgtaaccgacgtaacgacccgtacgtacggtaaacgtcgtaaacgtcgttaaccgtacgtaaggtacgggttaaggtcggaccgtaacgtaccgtaccggttacgagttaaccggttcgacggaaaccggtacgacgggtaccttaacggttcgttaacgttaccgttggtacccgtagtttaacgttcgttaaacgggttggtaaccctttaacggtaaccttacggtaactttttaaggtcccggtaacgtacccggttaaccgg

SEQ ID NO: 10424 - DNA, 774 bp, Homo sapiens
  misc_feature: GYAE6OF02F8RMV.53.73.G07.1.454.CMB.1.raw
tcagcgcgtatacacacgaccggtgctcgatttagctctacgctcagggggagtcagacccagtcaggacacagcatggacatgagggtccccgctcagctccgtggggctcctgctgctctcggcctccgaggtcgacctaaatggtacgacactccagactccgaccctacgtccttcccgtacccaccttgtctcgctacgtcgtcggtcggacgaactagacgtacctaccgtctacgttcggcccgggtaccaacgtaccgtaaaagttacgttaaaccggtaccggttgggttcggccggttacgttacgtacgaacgaacgaaaccggaaaaccggaaacgggtaaaccgccccgtaacgtaacctccgtacgtaacgttacgtaacgtaaacggtaccgttaaccgttaaccgttaaggaccggttacgggtaccggggtacccttaacgtaaccggttaaccggttacggacggtacggtacgtacggttacgtcggttcggtaggtaacgtacggtacgtacctactccgactacgtacgtacgactccgctcgctacggctagtgtcgttacgttactctaacttacgtacgtcaactaacgtaacgtactttacgttcgttacggtaccggtacgtaccgtacggaacgggtacgtaaacgtaacggaaccttaaggaaccgttacggcggttaacgacggtttaccgacgttaccgaccgttagttaccttcttaccggtcctttccggacttccgttacg

SEQ ID NO: 10425 - DNA, 476 bp, Homo sapiens
  misc_feature: GYAE6OF01AN8B2.38.6.A06.1.454.CMB.1.raw
  modified_base (471)..(471): a, c, t, g, unknown or other
  misc_feature (471)..(471): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtggggtcccatcaaggttcagcggcagtggatctgggacagatttcactctcaccatcagcagcctgcagcctgaagattttgcaacttatactgtcaacagcttaatagttatctcactttcggcgaggaccaaggtcgagatcaaacgaactgtggctgcacatctgtctcatcttccgcatctgacgtgatcgactgngcggg

SEQ ID NO: 10426 - DNA, 483 bp, Homo sapiens
  misc_feature: GYAE6OF01DAVJF.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtggggtcccatcaaggttcagcggcagtggatctgggacagatttcactctcaccatcagcagcctgcagcctgaagattttgctaacttattactgtcaacagctttaaatagttatcttcactttcggcggagggaccaaggtcgagatcaaacgactgtgctgcaccatctgtctcatcttcccgcatctgacgtg

SEQ ID NO: 10427 - DNA, 503 bp, Homo sapiens
  misc_feature: GYAE6OF01BJ8VL.38.6.A06.1.454.CMB.1.raw
  modified_base (239)..(239): a, c, t, g, unknown or other
  misc_feature (239)..(239): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccngggaaagcccctaaagctcctgatctatgctgcctcactttgcaaagtggggtcccatcaaggttcagcggcagtggatctgggacagatttcactctcaccatcagcagcctgcagcctgaagattttgctaacttattactgtcaacagtacttaatagtttaatcttactacgtttcggacggagggaccaagggtcgaagatacaaacgaactgtcggctagcacctatctgtcttcactcttcccgctactctgtaacg

SEQ ID NO: 10428 - DNA, 570 bp, Homo sapiens
  misc_feature: GYAE6OF01BM9X1.38.6.A06.1.454.CMB.1.raw
  modified_base (367)..(367): a, c, t, g, unknown or other
  misc_feature (367)..(367): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaaaccagggaaacgcccctaagctcctgatctatgctgcctcactttgcaaagtcgggtccatcaaggttcagcggcagtggatcgtgggacagtatttcactctcaccatcagcagcctgcacgcctgaagtnttttgactaactttatactgtacaacagtacttaatagttatctactacgtttccgggacggtacgggaaccgtaaggtacgaagtaactacgaaacgtacgtaggtcggtactcggacctaccgtattcgttacggttccttacctaacgtttcccctttaccccggtacccttaacgttaccgttacggtaaccgttacgg

SEQ ID NO: 10429 - DNA, 499 bp, Homo sapiens
  misc_feature: GYAE6OF01CH8NA.38.6.A06.1.454.CMB.1.raw
  modified_base (238)..(238): a, c, t, g, unknown or other
  misc_feature (238)..(238): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctcactttgcaaagtgggtcccatcaaggttcagcggcagtggatctggggacagatttcactctcaccatcagcagccctgcagcctgaagattttgctaacttattactgtacaacagtcttaatagttatctctacgtttcggcggaggaccaaggtcgagatacaacgaacgtgtcggctgacacctatctgttcttcacttccttcccgcctacttctgtaacg

SEQ ID NO: 10430 - DNA, 495 bp, Homo sapiens
  misc_feature: GYAE6OF01EADRC.38.6.A06.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (321)..(321): a, c, t, g, unknown or other
  misc_feature (321)..(321): n is a, c, g, or t
  modified_base (472)..(472): a, c, t, g, unknown or other
  misc_feature (472)..(472): n is a, c, g, or t
  modified_base (481)..(481): a, c, t, g, unknown or other
  misc_feature (481)..(481): n is a, c, g, or t
  modified_base (490)..(490): a, c, t, g, unknown or other
  misc_feature (490)..(490): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttatttagcctggtatcagcaaaaaccngggaaancccctaagctcctgatctatgctgcctccactttgcaaagtggggtcccatcaaggttcagcggcagtggatctgggacagatttcactcncaccatcagcagcctgcagcctgaatattttgactaacttattactgtacaactagtacttaatagtttatctctactttcgggcggtagggaccaaggtcgagatacaaacgtactgtcggctgcaccatctgtcttcatccttcccgcntctgacgtnactgactgngtcgg

SEQ ID NO: 10431 - DNA, 859 bp, Homo sapiens
  misc_feature: GYAE6OF01CJ3V9.38.6.A06.1.454.CMB.1.raw
tcagtcgatcacgtcacgaccggtgctcgatttagatctactgacagggaggggatggagacgtgggtcccgctcagcgtcctgggctcctgctgcgtctggctcccaggtgccagatgtcgccatccagttgacccaggtctccgactcctccctgtcctgcatctgtaggacgacagagtcgaccatcacttgccggcagtcaggcattagcagttattaagcctggtatcagtcaaaaacgaggtaaactccccttaagcctactagaatacctaactggactacgacccctactactttgacctaaaagttcggggtaccccaagtccaaagggtttccaacggccgggccaaggttcggggtaacttccggtaggggacctaaggtactttttaccgaacttccgtccaaccctaagttccgaacgggccaaacggccccttacgggaccctacgggtacccgttaaggtaaaacggtttctttttcggaccgttaaaccttttaacgtttaaccgttcgggttaaaccggaaaccgtaagggttacccgttttaaaatttaacggtttttaaactttcccgttttaccggttaaccggtttttttaccggggggaaccgggttaaacgggggtaaaccccgttaaacgggggttacccgggttaaagggtaaacgtttaacccggtaaaaacccggggtaaaccgggttttggggtacggggttaccggttacgggaaccggtaaacccgttaaacggttccgtttacgggtttaccctttaccggtaaaccgttccccgtttacccccggaccgttacccgttacgggtaaacccccggttgggttaacccg

SEQ ID NO: 10432 - DNA, 557 bp, Homo sapiens
  misc_feature: GYAE6OF01BR3ZS.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttatttagcctggtatcaagacaaaaaaccgagggaaacgcccctaaagctcctgatctatgctgcctcactttgacaaagtcgggtccatcaaggttcagcggcagtggatcgtgggacagtacttcactctcacatcagcagcctgcagtcctagaagtatttgactaacttattactagtacaactagtactttaagtagtttatcctcttacgttcgggacggtaagggaccgtaagggtcgaagtactaacgaaacgtacgtggtacggtactacggtacaccgtacttcgttggttccttactacttcccgttcccgacctacttcgtacggtaacgtacg

SEQ ID NO: 10433 - DNA, 506 bp, Homo sapiens
  misc_feature: GYAE6OF01C2DE3.38.6.A06.1.454.CMB.1.raw
  modified_base (203)..(203): a, c, t, g, unknown or other
  misc_feature (203)..(203): n is a, c, g, or t
  modified_base (331)..(331): a, c, t, g, unknown or other
  misc_feature (331)..(331): n is a, c, g, or t
  modified_base (471)..(471): a, c, t, g, unknown or other
  misc_feature (471)..(471): n is a, c, g, or t
  modified_base (500)..(500): a, c, t, g, unknown or other
  misc_feature (500)..(500): n is a, c, g, or t
tcagtcgatcacgtcacgaccggtgctcgatttagatctactgacagggaggatggagactggctcccaggtgccagatgtgccatccagttgacccagtctccatcctccctgtctgcatctgtaggagacagagtcaccatcacttgccgggccagtcagggcattagcagttatttagcctggtatcagacaaaaaaccngggaaacgcccctaagctcctgatctatgctgcctccactttgcaaagtggggtcccatcaaggttcagcggcagtggatctgggacagatttcactctcaccatcagcagcctgcagcctagaagtnttttgctaaactttattactgtacaaatgtactttaatagttatcttctacgtttcgggacggtagggaccaagggtcgaagatacgaaacgaactgtggctgcacatctgtcttcattccttcccgctatctgaacgtnacgtcgatggacgcgggctgggcaaggcncagtcg

SEQ ID NO: 10434 - DNA, 623 bp, Homo sapiens
  misc_feature: GYAE6OF01C8AB2.38.6.A06.1.454.CMB.1.raw
  modified_base (256)..(256): a, c, t, g, unknown or other
  misc_feature (256)..(256): n is a, c, g, or t
tcagtcgatcacgtcacgaccggtgctcgatttagatctactgacaggggaggatggacatgagggtccccgctcgagctcctggggctcctgcgtgctctggcttcccaggtcgcccagatgtgccatccgagttgaccccagtctccactcctccctgtctgcatcctgtaggagacagagtcaccatcacttgccgggccagtcagggcagttacgctagttattagcctggtatcaagacaaaacaggaacnccctaagcctacctagactctatacgcctagccctcctacttttgactaaaggtgggtacccatacgtaaaggttccaagtcggacgtagtaggacttcgtagggactaggtactttcaacgttctacaccatccgacgtccagccctgcctagccgtagaacgtatttcgactaacttattacgtagtacaactagtacttaatacgttatctactacgtttacggacggtaacgggaccgtaagggtcgaagtactaaccgtaacgtaacgttcggtacggacgtacgaccgtaaccgtagttaccgttcgttaccgttacctacttcccgttaccccgacctaccgttccgttacggtaaccgg

SEQ ID NO: 10435 - DNA, 494 bp, Homo sapiens
  misc_feature: GYAE6OF01B4P2H.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtggggtcccatcaaggttcagcggcagtggatctgggacagatttcactctcaccatcagcagcctgcagcctgaagtattttgctaacttattactgtacaacagtcttaatagttatctctactttcggcggaggaccgaaggtcgagatacaacgaactggtgctgcaccatctgttcttcactccttcccgcctatcgtgtaacg

SEQ ID NO: 10436 - DNA, 499 bp, Homo sapiens
  misc_feature: GYAE6OF01BW4QT.38.6.A06.1.454.CMB.1.raw
  modified_base (472)..(472): a, c, t, g, unknown or other
  misc_feature (472)..(472): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaacgcccctaagctcctgatctatgctgcctcactttgcaaagtgggtcccatcaaggtcagcggcagtggatcgtagggacagtatttcactctcacatcagcagcctgcagcctgaagtatttgactaacttattactagtacaactagtacttaaattagttaatctactacgtttcggacggagggtaccgaaggtcgagatacaacgactgtgctgcacatctntctcacttctcccgctatcgtgtaacg

SEQ ID NO: 10437 - DNA, 557 bp, Homo sapiens
  misc_feature: GYAE6OF01BAM1D.38.6.A06.1.454.CMB.1.raw
  modified_base (318)..(318): a, c, t, g, unknown or other
  misc_feature (318)..(318): n is a, c, g, or t
  modified_base (361)..(361): a, c, t, g, unknown or other
  misc_feature (361)..(361): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccgagggaaacgcccctaagctcctgatctatgctgcctcactttgacaagtcgggcccatcgaaggtcagcgcagtggatcgngggacagtatttcactctcacatcagcagctgcagcctgaatntttgactaacttattactgtacaactagtactttaatacgttatctacgtacgtttcgggacggtaacggaccgtaaggtacgtaacgtaactacgaaacgtacgttgtacggactcgacctaccgtacttcgttacgttcctttaccgtacttcccgttaccccgaccttaattccgttaaggtaaccgttacgg

SEQ ID NO: 10438 - DNA, 506 bp, Homo sapiens
  misc_feature: GYAE6OF01EVOZ8.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccaggaaacgcccctaagctcctgatctatgctgcctccactttgcaaaggtgggtcccatcaaggttcagcggcagtggatcgtgggacagtatttcactctcaccatcagcagcctgcagcctgaagtatttgactaacttaattactgtacaactagtacttaatagttatctactacgtttcggcggaaggaccaagggtacagtactacaaacgtactgtcgctagactacctatctgtcttcacttctacccactatctgtaacg

SEQ ID NO: 10439 - DNA, 571 bp, Homo sapiens
  misc_feature: GYAE6OF01DMYN7.38.6.A06.1.454.CMB.1.raw
  modified_base (223)..(223): a, c, t, g, unknown or other
  misc_feature (223)..(223): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctccactttgcaaagtgggtcccatcaaggttcagcggcagtggatctgggacagatttcactctcaccatcagcaagcctgcagcctagaagtatttttgactaactttattactagtcaaacgtagttacttaattagttactcttactacgtttccggacgggaacgggtaaccgaagggtaccgaagtactaaccgtaaacggtaacgttggtacggtctacgacctaacctacttcgtcgttaccttctaacttcccttacccgtacctacgttcgtacggtaacgtagacgttaccggagttggaccggg

SEQ ID NO: 10440 - DNA, 497 bp, Homo sapiens
  misc_feature: GYAE6OF01A0KIV.38.6.A06.1.454.CMB.1.raw
  modified_base (223)..(223): a, c, t, g, unknown or other
  misc_feature (223)..(223): n is a, c, g, or t
  modified_base (357)..(357): a, c, t, g, unknown or other
  misc_feature (357)..(357): n is a, c, g, or t
  modified_base (455)..(455): a, c, t, g, unknown or other
  misc_feature (455)..(455): n is a, c, g, or t
  modified_base (464)..(464): a, c, t, g, unknown or other
  misc_feature (464)..(464): n is a, c, g, or t
  modified_base (490)..(490): a, c, t, g, unknown or other
  misc_feature (490)..(490): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctccactttgcaaaggtggggtcccatcaaggttcagcggcagtggatcgtgggacagtactttcactctacaccatcagcacgcctgcagcctaggaactntttgactaactttattactgtacaactagtacttaatagttatcttactacgtttcggacggaggaccaggtcgagactacaaacgatgtgctgcacntctgtctcnctctcccgctagtcagtactgatcgntggacgg

SEQ ID NO: 10441 - DNA, 498 bp, Homo sapiens
  misc_feature: GYAE6OF01BZ8RX.38.6.A06.1.454.CMB.1.raw
  modified_base (486)..(486): a, c, t, g, unknown or other
  misc_feature (486)..(486): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctcactttgcaagtgggtccatcaaggttcagcggcagtggatctgggacagatttcactctcaccatcagcagcctgcagcctgaagtattttgactaacttattactgtacaactagtactttaatagttactcttactacgtttcggacggtagggaacctaaggtcgagtatacgaacgtactgtggctgcacatctgtcttcatccttcccnctatctgacgtg

SEQ ID NO: 10442 - DNA, 491 bp, Homo sapiens
  misc_feature: GYAE6OF01BB7HW.38.6.A06.1.454.CMB.1.raw
  modified_base (238)..(238): a, c, t, g, unknown or other
  misc_feature (238)..(238): n is a, c, g, or t
  modified_base (462)..(462): a, c, t, g, unknown or other
  misc_feature (462)..(462): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaaccngggaaagcccctaagctcctgatctatgctgcctccactttgcaaagtgggtcccatcaaggttcagcgcagtggatctgggacagatttcactctcaccatcagcagcctgcagcctgaagtattttgactaacttattactgtacaacagtacttaaatagttaatctctactttcgggacggagggaccaaggtcgagatacaaacgactgtgctgcaccntctgtcttcattcctcccgcatctgagtg

SEQ ID NO: 10443 - DNA, 527 bp, Homo sapiens
  misc_feature: GYAE6OF01EX0S9.38.6.A06.1.454.CMB.1.raw
tcagtcgatcacgtcacgaccggtgctcgatttagatctactgacaagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagtttatttagcctggtatcagacaaaaaccagggaaagcccctaagctcctgatctatgctgcctccactttgacaagtcgggtccatcaaggtcagcgcagtggatcgtgggacagtatttcactctcacatcagcagcctgcagcctagaagttatttgactaaactttattactagtacaactagtactttaatagttatctactacgtttcgggacggaagggtacctaaggtacgtagtactacgaaacgtactggtggctgactacgtatctacgttcttactacttccctacccgcctattctgtaagtcg

SEQ ID NO: 10444 - DNA, 557 bp, Homo sapiens
  misc_feature: GYAE6OF01CW4XH.38.6.A06.1.454.CMB.1.raw
  modified_base (223)..(223): a, c, t, g, unknown or other
  misc_feature (223)..(223): n is a, c, g, or t
  modified_base (242)..(242): a, c, t, g, unknown or other
  misc_feature (242)..(242): n is a, c, g, or t
  modified_base (522)..(522): a, c, t, g, unknown or other
  misc_feature (522)..(522): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcactgccggcagtcagggcattagctagttattagcctggtancagacaaaaacgaggaacnccctaagctcctgatctatgctcgcctacctactttgacgaaacggtcggggtacccagtacgtaaggttcagcggcaggtggatcgtagggactagtactttcgactctacacatcagcacgtcctgcagacctagtaagttattttacgacttaactttattaactacgtacaactagttaacttaaagtagttactctactacgtttcgggaacggaacgggaccgtaaggtcgaagtactaacgaacgtacgtggtagctagaccgtactattctnttacctctacttccttaccacctatcgtagtaacg

SEQ ID NO: 10445 - DNA, 524 bp, Homo sapiens
  misc_feature: GYAE6OF01DN91G.38.6.A06.1.454.CMB.1.raw
  modified_base (246)..(246): a, c, t, g, unknown or other
  misc_feature (246)..(246): n is a, c, g, or t
  modified_base (393)..(393): a, c, t, g, unknown or other
  misc_feature (393)..(393): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaacagggaaacncccctaagctcctgatctatgctgcctccactttgcaaagtgggtcccatcaaggttcagcggcagtggatcgtgggacagtatttcactctcaccatcagcagcctgcagcctagaagtatttgactaactttattactgtacaanagtcttaatagtttatcttctacgtttcgggacggtacgggacctaagggttcgaagtactaacgaaacgtacgtgtggctagacctacctattctgtccttcacttcccttacccgctactcgtgtaacg

SEQ ID NO: 10446 - DNA, 556 bp, Homo sapiens
  misc_feature: GYAE6OF01BOT9P.38.6.A06.1.454.CMB.1.raw
  modified_base (237)..(237): a, c, t, g, unknown or other
  misc_feature (237)..(237): n is a, c, g, or t
  modified_base (245)..(245): a, c, t, g, unknown or other
  misc_feature (245)..(245): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggcagtcagggcattagcagttatttagcctggtatcagacaaaaaccngggaaacncccctaaagcctcctgatctatcgctgcctccactttgactaaacggtcgggtcccatcgaaggtcagcggcagtgatcgtggactagtatttcactcctacaccatcacgcagcctgcacgctagaagtatttgactaacttattactgtacaacagtacttaaatagttactctactacgtttcggcggaaggtaccgtaaggtccgaagtactacgaaacgtagtcggagtctcgacctaccgtacttcgttcggttcttacgtactttcccgttacccgtacctaggttcctagggtaacgttacgg

SEQ ID NO: 10447 - DNA, 486 bp, Homo sapiens
  misc_feature: GYAE6OF01E09TB.38.6.A06.1.454.CMB.1.raw
  modified_base (224)..(224): a, c, t, g, unknown or other
  misc_feature (224)..(224): n is a, c, g, or t
  modified_base (349)..(349): a, c, t, g, unknown or other
  misc_feature (349)..(349): n is a, c, g, or t
  modified_base (479)..(479): a, c, t, g, unknown or other
  misc_feature (479)..(479): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttatttagcctggtatcagcaaaaaaccngggaaagcccctaagctcctgatctatgctgcctccactttgcaaagtggggtcccatcaaggttcagcggcagtggatctgggacagatttcactctcaccatcagcagcctgcagcctgaagnttttgctaacttatactgtacaacagacttaaatagttatctcactttcggcggagggaccaaggtcgagatcaaacgactgtgctgcacatctgtctcatcctccgctactctgaacgtgactgactgnggtcggg

SEQ ID NO: 10448 - DNA, 518 bp, Homo sapiens
  misc_feature: GYAE6OF01A6AR0.38.6.A06.1.454.CMB.1.raw
  modified_base (236)..(236): a, c, t, g, unknown or other
  misc_feature (236)..(236): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctcctgtctgcatctgtaggagacagagtcaccatcacttggccggccagtcagggcattagcagttattagcctggtatcagacaaaaaccngggaaacgccctaagctcctgatctatgctgcctccactttgcaagtcgggtcccatcgaaggttcagcggcagtgatcgtgggacagtatttcactctacacatcagcagcctgcagcctagaagtatttgactaacttacttactagtacaacagtactttaatagtttactctactacgtttacgggacggtagggtaaccgaaggtcgaagtactacaaacgtacgtaggtgctgactacgtatctcgtcttcactcttcccgactatctagtagtcg

SEQ ID NO: 10449 - DNA, 604 bp, Homo sapiens
  misc_feature: GYAE6OF01EGADD.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttatttagcctggtatcaagacaaaaaccgagggaaacgcccctaagcctcctgatctatgctgcctccatttgacaaggtcgggtaccatacaaggttcagcggcagtgatcgtgggacagtatttcactctacaccatcagcacgcctgcagtcctagaaagttattttacgacttaaacgtttattaaccgtgttaaccaacgtacgtactttaaagtagtttactccgttacttaccgtttcgggaaccggggtaacgggtaaccgtaagggtacgtaagtaactaacgtaaacgtacgttggtacggtacctaggaccctaaccgtagttctttcggtacctttacgtaccgttcccttaccccgactaacgttcgtacggtaaacgg

SEQ ID NO: 10450 - DNA, 583 bp, Homo sapiens
  misc_feature: GYAE6OF01C9QZL.38.6.A06.1.454.CMB.1.raw
  modified_base (272)..(272): a, c, t, g, unknown or other
  misc_feature (272)..(272): n is a, c, g, or t
tcagtcgatcacgtcacgaccggtgctcgatttagatctactgacagggagggatggagactgggtccccgctcagctcctggggctcctgctgctctggctcccaggtgccagatgtgccatccagttgacccagtctccatcctccctgtctgcatctgtaggagacagagtcaccatcacttgccgggcagtcagggcattagctagttatttagcctaggtatcaagacaaaaaaccgagggaaacgacccctaagctcctgatctangctcgcctcactttgcaaagtgggtcccatcaaggttcagcggcagtgatcgtgggacagactttcactctcaccatcagcagtcctgacacgtcctagaagtacttttgactaacgtttatttaacctagtacaaactagtactttaaatacgtttactacctacttacgttttccgggacggtaacgggacctaaagggtcgaaacgtaagtaccgaaaacgaacgttagggtacggtcgtacgacaacccgtagttctgttcccttacgtaccttacccttacccggcttaacgtctacgaacgtacg

SEQ ID NO: 10451 - DNA, 485 bp, Homo sapiens
  misc_feature: GYAE6OF01BMJ8Y.38.6.A06.1.454.CMB.1.raw
  modified_base (420)..(420): a, c, t, g, unknown or other
  misc_feature (420)..(420): n is a, c, g, or t
  modified_base (469)..(469): a, c, t, g, unknown or other
  misc_feature (469)..(469): n is a, c, g, or t
  modified_base (481)..(481): a, c, t, g, unknown or other
  misc_feature (481)..(481): n is a, c, g, or t
  modified_base (485)..(485): a, c, t, g, unknown or other
  misc_feature (485)..(485): n is a, c, g, or t
tcagtcgatcacgtcacgaccggtgctcgatttagatctactgacagggaggatggagactggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaagcccctaagctcctgatctatgctgcctccactttgcaagtgggtcccatcaaggttcagcggcagtgatctgggacagatttcactctcaccatcagcagcctgcagcctagaagtattttgactaacttattactgtacaactagtacttaatagttatctctacttcggcggaggacaaggtcgagatacaaacgactgtggctgcacntctgtcttcattcctccgcctatctgacgtgacgtcgactggcgcgggntcggcaggcgcngtgn

SEQ ID NO: 10452 - DNA, 587 bp, Homo sapiens
  misc_feature: GYAE6OF01AR106.38.6.A06.1.454.CMB.1.raw
  modified_base (245)..(245): a, c, t, g, unknown or other
  misc_feature (245)..(245): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccggccagtcagggcattagctagttattagcctggtatcagacaaaaacgagggaaacnccctaagctcctgatctatgctcgcctcacttgactaagtcgggtaccagtacgaaggtcagcggcagtgatcgtaggacagtattcactctacacctatcagcacgctgcagtctagtaatagtttgactaacttatactgtacatagtactttaatacgttactcttacgtacgtttcgggacggtaacggtaaccgtaaggtacgaagtaacttaacgaaacggtaacgttggtacggtaccgtacgtaccctaaccgttacgttacgttacggtttccttaccgttacctttaccccgttcccgaccttaccgttaccgttaacggtaaccgttacgg

SEQ ID NO: 10453 - DNA, 515 bp, Homo sapiens
  misc_feature: GYAE6OF01AJBGJ.38.6.A06.1.454.CMB.1.raw
  modified_base (224)..(224): a, c, t, g, unknown or other
  misc_feature (224)..(224): n is a, c, g, or t
  modified_base (500)..(500): a, c, t, g, unknown or other
  misc_feature (500)..(500): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagccaaaaaccngggaaacgcccctaagctcctgatctatgctgcctccactttgcaaagtggggtcccatcaaggttcagcggcagtggatctgggacagatttcactctcaccatcagcagcctgcagcctagagattttgactacttatactgtacaacagtacttaatagttatcttactacgtttcggacggagggtaccgaaggtcgaagtaataccgaaacgaacgtgtggctcgcacctatctgtcttactactcttcccgccacttcctagtaacggtnactcgtcgtggacgg

SEQ ID NO: 10454 - DNA, 551 bp, Homo sapiens
  misc_feature: GYAE6OF01AF89N.38.6.A06.1.454.CMB.1.raw
  modified_base (368)..(368): a, c, t, g, unknown or other
  misc_feature (368)..(368): n is a, c, g, or t
tcagtcgatcacgtcacgaccggtgctcgatttagatctactgacagggaggatggacatgagggtcccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgagggaaacgcccctaaagctcctgatctatgctgcctccactttgcaaagtgggtcccatcaaggttcagcggcagtggatctggggacagtatttcacttctcaccatcagcagcctgcagcctgaagtntttagctaacttattactgtacaactagtactttaaatagttatcttctaccgtttcgggcggtaacgggtactaagggtcgaagtactacgaaacgacgtggtaggcctaggacctaccgtattccgtcgtttaccgttactaccttcccttaccccggacctacgttccgttggtaaaccg

SEQ ID NO: 10455 - DNA, 550 bp, Homo sapiens
  misc_feature: GYAE6OF01A4RL1.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaaacgagggaaacgccctaagctcctgatctatgctgcctccactttgacgtaaaggtcgggtacccagtcgaaggttcagcgacaggtgatcgtgggacagtactttcactctcacatcagcagcctgcagcctagaagtatttgactaacttattactgtacaactagtacttaatagttactctactacgtttacgggacggtacggaaccgtaagggtacgtaagtaactacgaaacgtacgtggtcggactcgaccgtactacgttctacgttccttctacttcccgttcccgactattcgtagtacgtacg

SEQ ID NO: 10456 - DNA, 529 bp, Homo sapiens
  misc_feature: GYAE6OF01AW1T9.38.6.A06.1.454.CMB.1.raw
  modified_base (306)..(306): a, c, t, g, unknown or other
  misc_feature (306)..(306): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccggccagtcagggcattagctagttatttagcctggtatcagacaaaaaccgaggaaagccctaagctcctgatctatgctgcctccactttgcaagtgggtcccagtcaaggtcagcgnagtgatcgtggacagattcactctcacatcagcagcctgcagcctgaatatttgactaattatactgtacaacagtattaacttagttactcttacgtacgtttcgggacggtacgggaacctaggtacgaagtacttaacgaaacggtactggtacgactggaccacctacttcgtggttccttacgtactccgttacccgactaagtcctagtacgttacg

SEQ ID NO: 10457 - DNA, 593 bp, Homo sapiens
  misc_feature: GYAE6OF01BOLCB.38.6.A06.1.454.CMB.1.raw
  modified_base (188)..(188): a, c, t, g, unknown or other
  misc_feature (188)..(188): n is a, c, g, or t
  modified_base (223)..(223): a, c, t, g, unknown or other
  misc_feature (223)..(223): n is a, c, g, or t
  modified_base (375)..(375): a, c, t, g, unknown or other
  misc_feature (375)..(375): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctcctgtctgcatctgtaggagacagagtcaccatcacttgccggcagtcaggcattancagttattagcctggtatcaagaccaaaaaaccgngggaaacgcccctaaagcctcctgaactctatcgctcgccttcctatttgaccgtaaaggtcggggtacccagtcgaaaggttcaggcgctaggtcggatcgtagggactagtactttcactctcacatcagcagcctgcagctagtaactntttcgaactaacttattactgtacaactagtactttaatacgttatacctcgttaccgttcgggacggaacggaccgtaaggtcgaacgtataaccgaacgtaacgtcggaggtacctacgacctacgtacttcctcggtaccttaccgtaccttccgttaccccgtcttaacttcgttacggtaaccgtacgtacgtaccgggtagtcgggaacggg

SEQ ID NO: 10458 - DNA, 495 bp, Homo sapiens
  misc_feature: GYAE6OF01AXF40.38.6.A06.1.454.CMB.1.raw
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtgggtcccatcaaggttcagcgcagtggatctgggacagatttcactctcaccatcagcagcctgcagcctgaagtattttgctaactttattactgtacaactagtcttaatagttatctctacgtttcggcggagggaccaaggtcgagatacaaacgactgtgcttgcaccatctgtcttcacttccttcccgcactctgaacgtgatcgactgcggtcggg

SEQ ID NO: 10459 - DNA, 564 bp, Homo sapiens
  misc_feature: GYAE6OF01EJIU3.38.6.A06.1.454.CMB.1.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgagggaaacnccctaagctcctgatctatgctcgcctcctactttgacgaaaggtcggggtcccagtcgaaggttcaggcggctaggtggatcgtgggactagactttcactctcacatcagcacgcctgcagtcctagtaagtattttagactaactttattactcgtacaactagtacttaatacgtttactctactacgtttcgggacggtaacgggacctaggtacgtagtactacgaaacgacgtgtcgtactcgacctacgtacttcgtacgttccttacgtaccttcccgttacccacctattccgttaggaacgttacgg

SEQ ID NO: 10460 - DNA, 742 bp, Homo sapiens
  misc_feature: GYAE6OF01EGO4P.38.6.A06.1.454.CMB.1.raw
  modified_base (283)..(283): a, c, t, g, unknown or other
  misc_feature (283)..(283): n is a, c, g, or t
tcagtcgatcacgtcacgaccggtgctcgatttagatctactgacagggaggatggacatgagggtcccgtctcagctcctggggcgtaccgtgtctgctctggctccgaggttcgccagatgtcgaccaattccaagttcgaccctagttctcctactccctcctgtctgcatctgtaggagacagacgtcaccatcacttcggccgggccaggtcgaggggcctaagttagctagtttacttacggcctaggtactcgaacgacaaaaaccgtgggaaacnccctaagcctcctgactctatcgctgcctcactttgactaaaggttcggggtaccagtacgaacggttcacggtccggaccgtaaggtcggtacgttcggtaggggaacgtaggttacgtttacgaacgttcctaccgaaccgtagttacgacgtccgtaacgtcccgtacggaccgtaacgtaccgtaggtaaacgttacttttacggaactttaaccgtttaacgttacgtacgtaacctaaaccgtaaggttaacctttaaagtttaccgtttaccttcgttaaccgttacgtttaccgggacgggtacggtaaacccgtacgggtaccgtaacggtaccgtaacgaaaccgtacgttcggtacggtacgtaccgtaccgtaaccgttaagttccgttacgttcccgttacgtaccgttccccgttaccgtacctcggtttccgtaggttaaccgg

SEQ ID NO: 10461 - DNA, 627 bp, Homo sapiens
  misc_feature: GYAE6OF01ELEDC.38.6.A06.1.454.CMB.1.raw
  modified_base (237)..(237): a, c, t, g, unknown or other
  misc_feature (237)..(237): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccnggaaagcccctaagctcctgatctatgctgcctcacttgcaaagtggggtcccatcaaggttcagcggcagtggatcgtgggacagattcactctcacatcagcagcctgcagcctagaagtatttgactaacttattaactgtacaaactagtactttaaatacgtttaattccttacgtaccgttttcgggacgggtaagggtaacccgtaaagggttccgaaaggtaacttaaccgaaaaaccggtaacttacgggtacgggtaccttacgggacctaacccgaagtttacccgttacggtttccctttaacctacgtttacccccgttttaccccccggaacccttaaagtttcccggttaacggtaaaacccgggtttaaccggg

SEQ ID NO: 10462 - DNA, 578 bp, Homo sapiens
  misc_feature: GYAE6OF01CS9BX.38.6.A06.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (365)..(365): a, c, t, g, unknown or other
  misc_feature (365)..(365): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaaccngggaaancccctaagctctgatctatgctgacctccactttgcaaagtcgggtccatcaaggttcagcgcaggtgatcgtaggacagatttcactctcaccagtcagcagcctgcagcctagaagtnttttacgactaaactttattaactacgtactaaacgtagtactttaaagttacgtttaactccttactaacgttttccgggagggtaacgggaacgtaaggttacggaagtacgtaacgaaacgacgtgtagggtacctacggacctaaccgtactacttacgttctttaccacgtttcccttaccccggactaacgtctcggtaacgttacg

SEQ ID NO: 10463 - DNA, 567 bp, Homo sapiens
  misc_feature: GYAE6OF01DXOPN.38.6.A06.1.454.CMB.1.raw
  modified_base (250)..(250): a, c, t, g, unknown or other
  misc_feature (250)..(250): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttggccgggccagtcagggcattagctagttatttagcctggtatcaagacaaaaacgagggaaacnccctaagctcctgatctatgctgcctctactttgacgtaaaggtcgggtacccagtcgtaaggttcaggcggcagtggatcgtgggacagtacttcactctcaccatcagcacgcctgacctagtcctagtaagttattttcgacttaaactttattacgtagtacaactagtacttaatagtttactctactacgtttcgggacggtagggaccgtaaggtcgaagacgtacgaaacggacttacggtggtcctagacctaactacgttctcgttacttcctactttcccgttcccgtactactcgtggtaaacgg

SEQ ID NO: 10464 - DNA, 651 bp, Homo sapiens
  misc_feature: GYAE6OF01D49YX.38.6.A06.1.454.CMB.1.raw
  modified_base (168)..(168): a, c, t, g, unknown or other
  misc_feature (168)..(168): n is a, c, g, or t
  modified_base (429)..(429): a, c, t, g, unknown or other
  misc_feature (429)..(429): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtcctccatcctccctgtctgcatctgtagganacagatccacatcacttcggccggccagtcgagggctaattacgctaaggtttatttacgccgttaggtactacgaacgaaaccgaaaaaacccggaaggggtaaaaccgaccccctaaaggcccttacctagtaacttcctaagtcgctcgtccctacctacgtttcgacgtaaagggtccgggtacctagtacgtaaggttcaaggcggactaggtaggactcggtagggactagtactttacaccgttcacaccgtancgtacgctcggcctgacacgtactagaattatttcgaacttaattactactagtaccaagtacttattaattagttactcgttacgtaaccggtttcgggaaccggaagggacccgtaagggtacgaaagtctaaacgaaacgtacgtaggtcggtactaccgacgtccgttatcgttcgtaccttacacctttcccgtaccaccttactcgtacggtaacg

SEQ ID NO: 10465 - DNA, 561 bp, Homo sapiens
  misc_feature: GYAE6OF01CT8IY.38.6.A06.1.454.CMB.1.raw
  modified_base (249)..(249): a, c, t, g, unknown or other
  misc_feature (249)..(249): n is a, c, g, or t
  modified_base (333)..(333): a, c, t, g, unknown or other
  misc_feature (333)..(333): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttattagcctggtatcaagacaaaaaaccgagggaaacncccctaaagcctcctagatctatgctgcctcactttgactaaaggtcgggtcccagtcaaggttcagcgcagtgatcgtggacngtatttcactctacacatcagcagcctgacagtccgtagaagtatttcgactaacttattactgtacaactagtacttaatagttatcttacgtacgtttcgggacggtaacggaacctaaggtacgtagacttaacgaaacgtacgtggtacggactacggactaaccgtatacttcggttacttacctacttcccgttaccccgactattcgtagtaacgttacgg

SEQ ID NO: 10466 - DNA, 516 bp, Homo sapiens
  misc_feature: GYAE6OF01EL256.38.6.A06.1.454.CMB.1.raw
  modified_base (372)..(372): a, c, t, g, unknown or other
  misc_feature (372)..(372): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaaaccgagggaaacgcccctaagctcctgatctatgctgcctccactttgacaaaggtcggggtcccatcaaggttcagcggcagtggatcgtgggacagtattcactctcaccatcagcagcctgcacgctagaatntttcgacttaacttatactgtacaactagtacttaatagttactctactacgtttcgggacggtagggaccgaaggtcgaagactacgaaacgatgtgctgctactatcgtcgtcttcacttcctacccgatattcgtagtacg

SEQ ID NO: 10467 - DNA, 521 bp, Homo sapiens
  misc_feature: GYAE6OF01BEQXB.38.6.A06.1.454.CMB.1.raw
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccngggaaancccctaagctcctgatctatgctgcctccactttgcaaaggtgggtcccatcaaggttcagcggcagtggatcgtgggacagtatttcactctcaccatcagcagcctgccagcctagaagtattttgactaaacttattactgtacaacagtacttaatagttatctctactttcgggcgagggaccgaaggttcgaagtacttacaaacgtactggtcggctacgcaccgattcgtgtacttctatcccttcccgacctatcctaggtaaccg

SEQ ID NO: 10468 - DNA, 540 bp, Homo sapiens
  misc_feature: GYAE6OF01CPHQ1.38.6.A06.1.454.CMB.1.raw
  modified_base (474)..(474): a, c, t, g, unknown or other
  misc_feature (474)..(474): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccggcagtcaggcattagcagttattagcctggtatcagacaaaaacagggaacgcccctaagctcctgatctatgctgcctcctactttgacaaaggtcgggtcccagtcaaggttcagcgcagtggatgtgggactagtacttcactctacacatcagcagcctgcagctagatatttgacttaactttattactacgtacaacgtatacttaatagttactcttactacgtttcggacggaacggtaaccgaaggttcgaagtactaacgaacgaacgtgtacgntacgacaaccgtattccgtattcgttactaccttccttaccccgactacgttcgtaggttaaaccg

SEQ ID NO: 10469 - DNA, 604 bp, Homo sapiens
  misc_feature: GYAE6OF01BBNEX.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccgagggaaacgcccctaagctcctgactctatgctcgcctccactttgacaaaggtcggggtcccatcaaggttcagcggcaggtggatcgtagggacagtactttcactctcaccatcagcagcctgcagcctagtaagtatttgaactaactttactactgtactaactacgtacttaaattagtttatccttacgtacgtttaccgggacgggtaacgggtaaccgtaagggtacggaagtaacgtaccgaaacgtacgtaggtacggcctacggacctaaccgtattaccgtttacggttcctttaccgtacctttacccgttccccgtacccttaagttacccgttaacggtaaacggttacgg

SEQ ID NO: 10470 - DNA, 640 bp, Homo sapiens
  misc_feature: GYAE6OF01BZPP1.38.6.A06.1.454.CMB.1.raw
  modified_base (244)..(244): a, c, t, g, unknown or other
  misc_feature (244)..(244): n is a, c, g, or t
  modified_base (312)..(312): a, c, t, g, unknown or other
  misc_feature (312)..(312): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaccagggaacnccctaagctcctgatctatgcctgccctcctactttgactaaggtcgggtcccatcaaggttcagcgnagtgatcgtagggactagtatttcacttcctacacctatcagcacgccctgccacgtcctaggaagttacttttacgaccttaaactttacttaccgttacgtaccaacgtagttactttaaattacgtttactcttacgtacggttttcgggacgggtaacggggtaaccgtaacggggttacgaacggtaactaacccggtaaacggtaacgttcgggttacggtaccgtacggtacccgtacccgttagtttaccgttcgtttaccctttaccttacccgtttacccgttcccccgtaccttacccttccggttacggtaaccgg

SEQ ID NO: 10471 - DNA, 503 bp, Homo sapiens
  misc_feature: GYAE6OF01CQ3PL.38.6.A06.1.454.CMB.1.raw
  modified_base (431)..(431): a, c, t, g, unknown or other
  misc_feature (431)..(431): n is a, c, g, or t
  modified_base (490)..(490): a, c, t, g, unknown or other
  misc_feature (490)..(490): n is a, c, g, or t
  modified_base (496)..(496): a, c, t, g, unknown or other
  misc_feature (496)..(496): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtggggtcccatcaaggttcagcggcaggtggatcgtgggacagatttcactctcaccatcagcagcctgcagccctgaaagtattttgactaacttattactgtacaacagacttaatagttctctctacgtttcgggcggagggtaccaaggtcgagtanacaaacgaagtgtggctgcacctatctcgtctctattcctcccgcctatctagaccgtnatacgntgtacgg

SEQ ID NO: 10472 - DNA, 576 bp, Homo sapiens
  misc_feature: GYAE6OF01A3Y7E.38.6.A06.1.454.CMB.1.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctcctgtctgcatctgtaggagacagagtcaccatcacttgccgggccagtcagggcattagctagttattagcctggtatcagacaaaaaccgagggaaacnccctaagctcctgatctatgctcgcctcctactttgactaaaggtcgggtcccagtcgaaggttcagcggcaggtgatcgtgggacagtatttcactctacaccatcagcagcctgcagcctagtaagttatttacgactaactttattacgtacgtactaaactagtactttaaagtacgtttactacctttacgtacgtttacgggaacgggtaacggaaccgtaacgggtcgaagtaacttaacgaaacgtacgtggtacgcgtacgacctactacgttcgtacgttcttactacgttccttacccgactagttctaggtacgtacg

SEQ ID NO: 10473 - DNA, 683 bp, Homo sapiens
  misc_feature: GYAE6OF01BSWUQ.38.6.A06.1.454.CMB.1.raw
  modified_base (261)..(261): a, c, t, g, unknown or other
  misc_feature (261)..(261): n is a, c, g, or t
  modified_base (334)..(334): a, c, t, g, unknown or other
  misc_feature (334)..(334): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttcgacccagtcctccatccctccctgtctgcatctgtaggagacagagtcaccatcacttcggcccgggccagtcgagggctattagctagtttattacgcctaggtatcgaagaacaaaaacgagggaaacncccctaagcctcctgatctatcgctcgcctctactttgacgtaaggtcgggtcccagtcgaaggtcaggcggntaggtggactcggagggactagtactttcactctaccactatccgagcctacgtcctagccgtaacgtccgttaggtaaacgttagtttttacggaacctttaaacttttacgttaaccgttacgttaaacctaaacgtaacgtttaacctttaaagtttaacgtttaccttacccgttacgttaaccgggttttacgggaccggggtaacgggaacccgtaagggtaccaaggtaactaacggaaacgtacgttggtacggtaccttacggacctaaccgttagttccgttcgttaccgtttacctaccgtttcccgtaccccgtctaacgttgtaaccggttaacgg

SEQ ID NO: 10474 - DNA, 659 bp, Homo sapiens
  misc_feature: GYAE6OF01DHD0T.38.6.A06.1.454.CMB.1.raw
  modified_base (248)..(248): a, c, t, g, unknown or other
  misc_feature (248)..(248): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatatgtaggagacagagtcaccatcacttcgccgggccagtcagggcattagctagttattagctaggtatcagacaaaaaccgagggaaacnccctaagcctctgatctatcgctcgcctccgtactttgacgaaacggtcgggtcccatacgtaaggttcacgcggacaggtacggatccggtagggacctagtactttacgactcgtacacctatcgagccgtagtcctgacctacgtaccgtagtaagtttactttacgacctttaacgtttattaccgttagtaacctaagtaccgttaatttaaacgttactttactaccgttaacgttacggtttaccggggacggtaacgggtaaccgtaagggtaaccgtaacgtaaacgtaccgaaacgtacgtacggtacgtaccgtacggtacctaacgtgtttacgttacggtttacctttaccgttccccgttacccgaccttagtaccttacggtaaacgttcgtaacg

SEQ ID NO: 10475 - DNA, 720 bp, Homo sapiens
  misc_feature: GYAE6OF01DIVLZ.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctggtaggagacagagtcaccatcacttgccggccagtcgagggcattagctagttattagcctggtatcaagacaaaaaccgagggaacgccctaagcctcctgatctatgctcgcctacctcttacgacgtaaacggtcggggttacccagtaccgaacgggttcgacggtccggataggttggaacgttcgaggggtaactacggtattttacccaacttccgtaccacctaacgttacgacggactacggtccctacggacctaaggtcccgttaaggtaaacgttactttttacggaaccttaaacgttactttaacgttacgtaacgaacctaagtttaacctttaaagtacgtttaaccgttcttaccgttaacggtttaccccggggaagggtaaaccgggtaaccgttaaagggtaaccgaagtacccgttaaacggaaaccgtaaccgttgtacggacgttcgaccctaaactacgttcgttaccgttcttacccgtactttcccggttacccctacgttaccttacggtacgaaccgtttacgacggtaccgtagtgggtaccggg

SEQ ID NO: 10476 - DNA, 578 bp, Homo sapiens
  misc_feature: GYAE6OF01BQUDO.38.6.A06.1.454.CMB.1.raw
  modified_base (248)..(248): a, c, t, g, unknown or other
  misc_feature (248)..(248): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaaaccgagggaaacncccctaagcctcctagattctatgctcgcctccactttgacgaaaggtcggggtacctatcaaggttcaggcggcaggtggatcgtagggacagtacttcactctcaccatcagcagcctgcacgacctagtaagttacttttcgacttaactttacttaacgtagtacaaactagtactttaaatagtttactcttctacgtttcggacgggaacggtaccgtaaggtcgaagtaactacgaacgtacgtcggtgtcgtagacctaacctcttcttacgttccttacctacttcccgttacccgaccttattccgttagaacggttacg

SEQ ID NO: 10477 - DNA, 604 bp, Homo sapiens
  misc_feature: GYAE6OF01CM8I9.38.6.A06.1.454.CMB.1.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaanccctaagctcctgatctatgctgcctccactttgacaagtgggtcccatcaaggttcagcgcagtggatcgtagggacagtatttcactctcacatcagcagcctgcagcctagaagttatttgactaactttattactgtaccaactacgtaccttttaaagtagttttactccgttaccgtaaccgttttaccgggacgggtaacgggtaaccgtaaaggggttaccgaaggtaacttaaccgaaaaccgtacgttaggtaccggtcgtacgacctaacccgtacgttccttcggtttacctttacctaccgtttcccgttaccccggtacccttatttcccgtaggtaacggttaccg

SEQ ID NO: 10478 - DNA, 499 bp, Homo sapiens
  misc_feature: GYAE6OF01A4KDR.38.6.A06.1.454.CMB.1.raw
  modified_base (236)..(236): a, c, t, g, unknown or other
  misc_feature (236)..(236): n is a, c, g, or t
  modified_base (469)..(469): a, c, t, g, unknown or other
  misc_feature (469)..(469): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccngggaaagcccctaagctcctgatctatgctgcctccactttgcaagtgggtccatcaaggttcagcggcagtggatcgtgggacagtatttcactctcaccatcagcagcctgcagcctagaagtattttgctaactttattactgtacaacagtactttaatagtttactctactacgtttcgggacggtacgggaccaagggtacgagtatacaaacgactgtgctgcacntctgtcttcatcctcccgctatctgacgtg

SEQ ID NO: 10479 - DNA, 490 bp, Homo sapiens
  misc_feature: GYAE6OF01E1JU2.38.6.A06.1.454.CMB.1.raw
  modified_base (236)..(236): a, c, t, g, unknown or other
  misc_feature (236)..(236): n is a, c, g, or t
  modified_base (242)..(242): a, c, t, g, unknown or other
  misc_feature (242)..(242): n is a, c, g, or t
  modified_base (459)..(459): a, c, t, g, unknown or other
  misc_feature (459)..(459): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaccngggaancccctaagctcctgatctatgctgcctccactttgcaaagtggggtcccatcaaggttcagcggcagtggatctgggacagatttcactctcacatcagcagcctgcagcctgaagtatttgctaacttattactgtcaacagtcttaaatagttactctctacttcgggacggagggaccaaggtcgaagtactacgaaacgatgtggctgcaccntctgtcttcattcctacccgcatctgacgtg

SEQ ID NO: 10480 - DNA, 602 bp, Homo sapiens
  misc_feature: GYAE6OF01DDCDJ.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctcctgtctgcatctgtaggagacagagtcaccatcacttgccggcagtcagggcattagcagttattagctggtatcagacaaaaaccaggaaacgccctaagctcctgatctatgctcgcctcctactttgacgtaaaggtcgggtaccccagtacgtaaggttcaggcggcaaggttgggaattcgaggggaactagtaactttcaactctacaccatcagcagcctgcacgtcctagaagttacttttagactaaacttattactgttacaactagtactttaatagtttatacttactacgtttacgggacgggtaacgggtaaccgaagggttacgaacggtaataaccgtaaaaccggtaacgttggtacggaccgtaggtacctaaccgtattaccgtcgtttacttaccacttcccgttaccccgctaacgttcccgtagtaaacccgg

SEQ ID NO: 10481 - DNA, 745 bp, Homo sapiens
  misc_feature: GYAE6OF01C4MGB.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcaggggcattagctagttatttagcctggtatcagaccaaaaaccagggaaacgcccctaagcctcctgatctatcgctcgccctctactttgacgtaaggtcggggtacccagtacgtaaggttcacggcgggacaggtgatcggtacggggatagtactttaccacttcctaccaactatacgagtccaacggtcctcgacgtaccgcgttaacggaagtttaacttttacgaacctttaaaacttttaccgttaacgttacgtaacctaaacgtacgttaacctttaaaacgttacgttttaacttacccgttaccgtttaaccgggttttcggggaaacccgggtaaccggggtaaaccggtaaacggggtacggtaaacggttaacgtaaaccggtaaaccgtaacggtttacgggtacgggtaccttaacggaccctaaaccggtacttttacggttcccctttaaccgtttacccgttacgttttaccccccgttaccccggttaaccgttaaccgttccggtttaaccgggttaaaccggg

SEQ ID NO: 10482 - DNA, 610 bp, Homo sapiens
  misc_feature: GYAE6OF01AS7Q6.38.6.A06.1.454.CMB.1.raw
  modified_base (244)..(244): a, c, t, g, unknown or other
  misc_feature (244)..(244): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggcagtcagggcattagctagttatttacgccttggtatcaagaccaaaaaaccgngggaaacgcccctaagctcctagatctatcgctcgcctcctactttgactaaaggtcgggtcccagtcgaaggttcagcgcagtggatcgtgggacagtactttcactctacacctatcagcacgcctgcacgtccgtagtaacgtattttacgacttaactttattacctagtactaactagttacttaaattacgtttacttcctacgttaacgttaccgggacgggtaacggtaaccgtaaggtacgtacgtaactaccgaaacgtacgtacggtcggaccgtcgtaccctacgtacttacgttcgttccttactaccgtttacccttccccgtactaccgttaccgtaggtaaccggtacgg

SEQ ID NO: 10483 - DNA, 509 bp, Homo sapiens
  misc_feature: GYAE6OF01B66NV.38.6.A06.1.454.CMB.1.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
  modified_base (372)..(372): a, c, t, g, unknown or other
  misc_feature (372)..(372): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccngggaaacncccctaagctcctgatctatgctgcctcactttgacaaaggtcgggtcccatcgaaggttcagcggcagtggatcgtgggacagtatttcactctcaccatcagcagcctgcacgcctagaagtntttagactaacttattactagtacaacagtactttaatagttatctactacgtttcggacggtaggaccaaggtcgagatacaacgactgtgctgcactatctcgttctctacttccttacccgactatcgtgtacg

SEQ ID NO: 10484 - DNA, 556 bp, Homo sapiens
  misc_feature: GYAE6OF01DYNK3.38.6.A06.1.454.CMB.1.raw
  modified_base (223)..(223): a, c, t, g, unknown or other
  misc_feature (223)..(223): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggcagtcagggcattagcagttatttagcctggtatcagacaaaaaccngggaaacgcccctaagcctcctgatctatgctcgccctccactttgactaaaggtcggggtccccatcgaaggttcaggcggcaggtggatcgtgggacagtatttcactctacaccatcagcacgcctgcagcctagaagtattttgacttaacttattactgtacaacagtactttaatagttatcttactacgtttcggacggtacgggacgtaaggtcgaagataaccgaaacgtacgtggtcggtctacgcctacctattccgttgtccttacaccgtttccttccccgactactacgtacgtaacgtgactcgaactggacggcggg

SEQ ID NO: 10485 - DNA, 655 bp, Homo sapiens
  misc_feature: GYAE6OF01B79LE.38.6.A06.1.454.CMB.1.raw
  modified_base (248)..(248): a, c, t, g, unknown or other
  misc_feature (248)..(248): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggcagtcaggcattagctagttattagcctggtactcgaagacaaaaaccgagggaaacnccctaagctctagatctatgctcgcctctactttgacgtaaaggtcgggtacccagtacgaaggttcaggcgcgtagtcggatcgtgggaactagtacttcacgtctacacctatcagtcacgctgacgacgtcctagaattatttcgaacttaactttattacgtacgtaactaacgtacgtaactttaaagtacgtttacttaccgttaccgttacggtttaccggggacgggtaacgggtaaccgtaaacgggtacgtaacgtaaccgttaaacgaaaccggttaacgtcgggtacggtacctaccgtacctaacccgtacgtttccgttacgttacccttacgtaccctttacccgttacccccggtacttaacgtttaccgtaaacgggtaccggttaacgg

SEQ ID NO: 10486 - DNA, 647 bp, Homo sapiens
  misc_feature: GYAE6OF01C1H3B.38.6.A06.1.454.CMB.1.raw
  modified_base (250)..(250): a, c, t, g, unknown or other
  misc_feature (250)..(250): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatccctccctgtctgcatctgtaggagacagagtcaccatcacttggccggcagtcagggctattagctagttattagcctggtatcagaacaaaaaccgagggaaacnccctaagcctactagtatcgtatgcctgcctcctacgtttgaccgtaaggtcgggtacccagtacgtaaggttcgaggccggactaggtggtacgtcggtacggggaactagtactttccaacttctacaccatccgagccgacgtccgtgaccgtacgtaccgtaagtaacgttactttacgacttaaactttattacgtacgtaactaactaagttactttaaagtacgttacttctacgttaccggtttcgggaacgggtaacggtaaccgtaacgggtacgaaacgtaacgtaaccgaaacggtaacgtggtacggtacctacgaccgtaccttagtaccttcggttaccttacgtaccttcccgtacccgaccttacgtgtaacggtaacgg

SEQ ID NO: 10487 - DNA, 898 bp, Homo sapiens
  misc_feature: GYAE6OF01ADP6W.38.6.A06.1.454.CMB.1.raw
tcagtcgatcacgtcacgaccggtgctcgatttagatctactgacagggaggatggagactgggtcccgctcagctcctgggctcctgctgctctggctcccaggtagccagatgtgccatccagttgacccagtctccatcctccctgtctgcatctgtagagacagagtcaccatcacttgccggcagtcagggcattagctagttattagccttggtatcgagacaaaaaaccgtggggaaacgcccctaaaggtctacccgtagtaattcctaagttcgctacggtccccttacctaccgttttaggaccaaaacgggtttcggggtaccccaagtttccggtaaaaggggttttccaaggtccggggactaacggttgggaaccttttccggagggggtaaacctaacgggtttaactttttacccgaaccgttcccgtttacgaaacccccgtatttacggaaaccgggtccctttaaaaccgggggccccctttagggtaaacccaacgggtcccccggtttaacggtaaagggtttaaaccttttttttcggggaaacccctttaaaccggttttttaaaatttaacccggttcggtaaaccctttaaaaaccgacgttttaaacccggtttttaaaattaaacgggttttaacctttcccgttttaaaccgttaacccggtttttccgggggaaacggtaaccggggtaaacccgttaaacggggttactaaaccggggtaccttttaaaccgggaaaaccgggtaaccctttggggttaccggaaccggtttacgacccgtaaaacccttggttaacccttgggttcccctacgttaaccttcccgtttaccccgtacgtaaaccttggtttacccgaagtttccggg

SEQ ID NO: 10488 - DNA, 686 bp, Homo sapiens
  misc_feature: GYAE6OF01EIV45.38.6.A06.1.454.CMB.1.raw
  modified_base (258)..(258): a, c, t, g, unknown or other
  misc_feature (258)..(258): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacgttcggcccggcagtcgagggctagttagctagtttattacgccgttaggtatacgagaacaaaaaccgaggaacnccctaagcctacgtgtactctatcgctcgcctcctacgtttacgacgtaacggtcggggtacccagtaccgtaaggttcgacggcggcgtaggtggtacgtcggtaggaactaggtactttaccgacttaccgtacaacctagttaccgaacgtccgtaaccgtccgtacgaccgtaacggtaccgttaaggtaacgtttacgtttacgaaccttaaactttacgttaacgtacgttacctaaacgttattaacttttaattacgtttacttaccttaccgttaccggttaccgggaacgggtaacggaaccgtaacggtacgtaacgtaactaacgaaacgtagttacggtcgacgtacgacctacgttcgtacttacgttaccttcgtaccttcccgtccgaccttagtaccgtagtaccggtacg

SEQ ID NO: 10489 - DNA, 603 bp, Homo sapiens
  misc_feature: GYAE6OF01BIRVU.38.6.A06.1.454.CMB.1.raw
  modified_base (239)..(239): a, c, t, g, unknown or other
  misc_feature (239)..(239): n is a, c, g, or t
  modified_base (322)..(322): a, c, t, g, unknown or other
  misc_feature (322)..(322): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaacgngggaaacgccctaagctcctgatctatgctgccctctactttgctaaggtgggtccatcgaaggttcagcggcaggtgatcgngggacagtactttcgactctacaccatcagcagcctggcacgtcctgtaacgtattttcgacttaaactttattactagtaccaagtacgttactttaaagttacgtttatccgttacgtaccgtttcgggaccgggtaacgggtaacccgtaagggtaccgaagtaacgtaacgtaaacgtacgtagggtggtacctcgaccgtaactattccgttcgttacccttaccgtaacgtttccccttcccggtaccctaacgttccggtaagttaaacccggg

SEQ ID NO: 10490 - DNA, 755 bp, Homo sapiens
  misc_feature: GYAE6OF01DEUSR.38.6.A06.1.454.CMB.1.raw
tcagtcgatcacgtcacgaccggtgctcgatttagatctactgacagggaggatggagactgggtcaactggatggcacatctggctcccaggtgccagatgtgccgtccagttcgacccagtctccatccctccctgtctgctatctggtaggagacagagtcaccatcacgttcgccgggcagtcgaggctattagctagttattacgccttggtatacaacgaaccgaaaaaccgagggaaaccgtacccctaagtcctaccgttagtacttcgtaagtcgccttcgtcccttacctacgtttaggaaccgtaaacgggttccgggtacccaagttaccggtaaacggttccgaacgggtccggtaccgtagggtacggtaacgttaccgggtagggaacctaggttacctttaccgaccgttacctaccaacccgtagtaccgacgtaccgaccgtacccgtgaccgtacggtaccgttaaggttaaacgtttacgttttacgaacctttaaacgtttaacttaccgttaagtaaccctaagttacgttaacttttaaagttacgttacttaccgttaccgttacggttaccgggacgggtaaccggtaaccgtaagggtactaacgtaaccgtaacgaaacggttacgtggtacgtacgtcgaaccttcgtagttccgtcttaccttactccgttacccgttcccatcgttaccgtacgaacgttgacgttaggactgggccggtccggg

SEQ ID NO: 10491 - DNA, 526 bp, Homo sapiens
  misc_feature: GYAE6OF01DTDZM.38.6.A06.1.454.CMB.1.raw
  modified_base (455)..(455): a, c, t, g, unknown or other
  misc_feature (455)..(455): n is a, c, g, or t
  modified_base (497)..(497): a, c, t, g, unknown or other
  misc_feature (497)..(497): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaacaggaacgccctaagctcctgatctatgctgccctccacttttgactaaaggtcggggtacccagtcaaggttcagcggcagtggatcgtgggactagtatttcactctcaccatcagcagcctgcagcctagaatattttgactaactttatactgtacaactagtactttaatagttactctctacgtttcggacggtacgggaacctaaggtcganactacaacgaacgtgtgctcgacaccattcctcgttaccttntacttccttacccgactactcgtagtacg

SEQ ID NO: 10492 - DNA, 636 bp, Homo sapiens
  misc_feature: GYAE6OF01A9J8A.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatccctccctgtctgcatctgtaggagacagagtcaccatcacttgccgggccagtcagggcattagctagtttattagcctggtactcgaaggacaaaaaaccgaggaaacgccctaagcctctgatctatgctcgcctccacgtttgacgtaaaggtcgggtcccagtccgtaaggtcgagcggcgtaggtggactcggtaggactaggtactttaccgactctaccacctactcaggcacgtcctgaccgacgtacctagtaagtacttttacgacttaaacttacgttacgtacggtaactaacgtacgttacgtttaaacttacgtttactacttacgttaccggtttacgggaccggtaaacgggtaaccgtaaggtacgtaacgtacgtaacgaaacggtacgttacggtcgtacgtacgaccgtaccgtagtccttacgtccttacgtacccgtccgttacccgtacgtactcgttacgtacgtaacg

SEQ ID NO: 10493 - DNA, 673 bp, Homo sapiens
  misc_feature: GYAE6OF01C3IXG.38.6.A06.1.454.CMB.1.raw
  modified_base (233)..(233): a, c, t, g, unknown or other
  misc_feature (233)..(233): n is a, c, g, or t
  modified_base (252)..(252): a, c, t, g, unknown or other
  misc_feature (252)..(252): n is a, c, g, or t
  modified_base (328)..(328): a, c, t, g, unknown or other
  misc_feature (328)..(328): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttcgacccagtcctccatcctccctgtctgcatctggtaggagacagagtcaccatcacttcggccgggccagtcagggctagttagctagttattcgcctggtancagaacaaaacgaggaacnccctaagcctctgatctatgactcgctcctatttcgacgtaacgtcgggtacccagtacgtacggttcaggccggngtacggtggtacgtacggtaggaaccgtaggttaactttaccgacttaccgtacccgtaacctacgtacgacgacgtaaccgtcccgttaggaccgtaccgtaccggtaagtaacgttacgttttaccgtaaccttaaacttttaacgtaccgttacttaactaacgtacgttaaccgtttaaagttacgtttactaccgtttacgtaccgtttacggggacggtaacgggtaccgtaacgggttcgaacgtaactaacgaacggtagtcgtagtaccgtacaccgtacctagttctcgttacctacgtaccttacccgtccgtacttacgtcgtaccgtaacgg

SEQ ID NO: 10494 - DNA, 757 bp, Homo sapiens
  misc_feature: GYAE6OF01CGIVI.38.6.A06.1.454.CMB.1.raw
  modified_base (252)..(252): a, c, t, g, unknown or other
  misc_feature (252)..(252): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcacatcacttcggccgggcagtcagggcagttagctagtttatttagccttggtatcaagacaaaaaccgagggaaacncccctaagcctcctagactctatcgctcgacctctactttacgacgtaaacggtcgggtacccaagtacgtaacggttcacggcggtacgtaggtcggtatacggtagggtaactaggttactttccgaaccttcctaccgtaaccctagtaccgtaacgggacctaaccggtcccgttacggacctacgggtaccccttaagggttaaacgttaacggttttttaccgaaccttttaaaactttacgtttaaaccgttacgttaaaccgtaaacgttaaccgttaaactttttaaacgttaacgttttacttacccgtttaccggttaacgggttttacccggggaacggggtaaaccgggtaaccgttaacggggtaaccgtaagttaaaccgtaacgtaaacccggtgttacggtacggtccacgtactaccgtaacgttcgtaccgttcttaccgtacgtttcccctaccggtactaagttaccgtaggtaacgttaccgg

SEQ ID NO: 10495 - DNA, 572 bp, Homo sapiens
  misc_feature: GYAE6OF01BUV5R.38.6.A06.1.454.CMB.1.raw
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttatttagcctggtatcagacaaaaaccgngggaaacncccctaagcctcctgatctatgctgcctccactttgacaaaggtcgggtacccatcaaggttccaggcggcagtggatcgtgggacagtatttcactctcaccatcagaccagctgcagcctagaagtatttgacttaacttattactgtacaactagtacttaatagttatactcgtacgttcgggacggtaacgggactaacgggtacgaagtactaacgtaacggtacgtaggtacggacttacgacctacgtacttcgttcttaccttctacgttcccttaccccgcctactaccgtacgaacgttcgacgtacgtacgttcggcggtaccgggg

SEQ ID NO: 10496 - DNA, 643 bp, Homo sapiens
  misc_feature: GYAE6OF01C2WSW.38.6.A06.1.454.CMB.1.raw
  modified_base (225)..(225): a, c, t, g, unknown or other
  misc_feature (225)..(225): n is a, c, g, or t
  modified_base (232)..(232): a, c, t, g, unknown or other
  misc_feature (232)..(232): n is a, c, g, or t
  modified_base (320)..(320): a, c, t, g, unknown or other
  misc_feature (320)..(320): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttcggccggcagtcagggcattagctagttattagcctggtatcaagacaaaaacgnggaaacnccctaagctacctgatctagtgctgcctcacgtttgacgtaagtcgggtcccagtcgaaggttccaggtcgctagtgatcgtgggacngtacttcactctacacagtcacgacacgcctgaccgtacgtaccgttaggtaaacgtttacgtttttcgaacccgttaaacgtttacgtttaacgtacggttaacctaaacgttaacggttaaccttttaaacgttaacggttttactaccgtttaacgtaccgggttttaccgggacggttaaccgggtacgaacgggttaccgaacgtaacgtaaccgaacgtacgtgtacgtctaccgactactattcgtcgtacttacgtctcccgttacccgtcctacgttacgtacgtacgtacgtgttacccgtagtcggaacggg

SEQ ID NO: 10497 - DNA, 721 bp, Homo sapiens
  misc_feature: GYAE6OF01BAP13.38.6.A06.1.454.CMB.1.raw
  modified_base (359)..(359): a, c, t, g, unknown or other
  misc_feature (359)..(359): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctcctgtctgcatctgtaggagacagagtcaccatcacttggccggcagtcgaggcagttagctagttattagctggtatcaagacaaaaaccgagggaaacgtcccctaaggccttaccgtagactactatcgcgtcgcctcctactttgacgaaggtcgggtacctagtacgaaggttcagtcggcgtaggtggactcgtaggactagtacttcacgtcctcaacctntcacgcacgctagtcagtcgtacgtaagttacgtttacgacgttaacttacgttacgtacgttaactaaacgtaagttaacctttaaaggttaacgtttaaccttacctttacggttaacccggtttacggggtaacccggggtaacgggttaaccggtaaacggggtttacgaaaccggttaacgtaaccggtaaaccgggttaacgttacggggttaccgaccgtttacgaacccgttaccgtaaccggttccgtttacggttaccttaaccggttccttacccgtttaccccggaaccttcgtaccggttaaaccggtacgttacgtaccggttacgtacggtagggtcggtaccgggg

SEQ ID NO: 10498 - DNA, 772 bp, Homo sapiens
  misc_feature: GYAE6OF01C2QAS.38.6.A06.1.454.CMB.1.raw
  modified_base (354)..(354): a, c, t, g, unknown or other
  misc_feature (354)..(354): n is a, c, g, or t
  modified_base (455)..(455): a, c, t, g, unknown or other
  misc_feature (455)..(455): n is a, c, g, or t
tcagtcgatcacgtcacgaccggtgctcgatttagatctactgacagggaggatggagactgggtcaactggatggcacatctggctcccaggtgccagatgtcgccgtccagttgacccagtctccatcctccctgtctgcatctggtagagacagtagtcaccatcacgttcggcccgggcaggtcagggctagttgctagttattacgccttggtactacgaagaaccaaaaaaccgagggaaacctccccaaagtcctaccgtagtacttcgtaagtcgactaccgtaccttacctactttcgaacgtaacgggtccgggtaccctaagtacgtaggttcgacgccggtnaaggtgacgttcgagggactaacgtcttaccgaccttactaccgaaccgtataccgagtaccgacgtcccgtagacgtaccgtacgtagtaaaccggtttntttaaccacgtttaaatttaaccgtcgttaacgtaacctaaacttaacgttaacgttttaaacgtacgtttaacctacggtttacccgtttaacgggtttacccgggaaacgggtaccggtaaccgtaaacgggtccgtaaacgtacgtaaacccggaaaaggtccggttacggtacggtaacctacggtaaccctaccgttaagttccgttaccgtaccttaccttacccgggttccctttcccggaaacttccgtacggttacccgttaaacggacgtttaccccagggtacccggaacgggtcgggtaaccggg

SEQ ID NO: 10499 - DNA, 600 bp, Homo sapiens
  misc_feature: GYAE6OF01DRNIZ.38.6.A06.1.454.CMB.1.raw
  modified_base (166)..(166): a, c, t, g, unknown or other
  misc_feature (166)..(166): n is a, c, g, or t
  modified_base (239)..(239): a, c, t, g, unknown or other
  misc_feature (239)..(239): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtagganacagagtcaccatcacttgccggcagtcagggcattagctaagtttattagcctggtatcagacaaaaaccgngggaacnccctaagctcngatctatgctcgcctctacttgactaaaggtcgggtccatcaaggttcagcggcagtggatcgtagggacagtattcacttcacacatcagcacgctgcgagcctagaagttagtttgaccttaattacttactagtaaccaacagttacttaaattacgtttactactacgttaacgtttcgggacggtaacgggaaccgtaagggtacgaaagtaactaacgaaaaccggtaacgtcgggtagtacctaggaccctaacctacttcgttacggtttacctacttaaaccgttcccctttaccccggaacttaagttccgttaaacggtaaccggttaacgg

SEQ ID NO: 10500 - DNA, 576 bp, Homo sapiens
  misc_feature: GYAE6OF01AG9AU.38.6.A06.1.454.CMB.1.raw
  modified_base (247)..(247): a, c, t, g, unknown or other
  misc_feature (247)..(247): n is a, c, g, or t
  modified_base (322)..(322): a, c, t, g, unknown or other
  misc_feature (322)..(322): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaaccgagggaaacncccctaagcctcctgatctatgctcgccctcctactttgacgtaaaggtcgggtacccatcgaaggttcagcggnaggtagatcgtaggacagtatttcactctcactatcagcagcctgctacgccgtagtaagttactttgaccttaactttacttactacgtacctaaatacgtacctttaaagtacgtttactccttacgttaccgtttcgggacggtacggtaaccgtaggtcgaagtactacgaaacgtagtcgtacggctacgactaccgtcttacgtcgttcttctacgttcccttcccgactaacttcgtagtacgtacg

SEQ ID NO: 10501 - DNA, 577 bp, Homo sapiens
  misc_feature: GYAE6OF01BGTLX.38.6.A06.1.454.CMB.1.raw
  modified_base (322)..(322): a, c, t, g, unknown or other
  misc_feature (322)..(322): n is a, c, g, or t
  modified_base (372)..(372): a, c, t, g, unknown or other
  misc_feature (372)..(372): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctcctgtctgcatctgtaggagacagagtcaccatcacttgccgggccagtcagggcattagctagttattagcctggtatcagacaaaaaccgaggaaagcccctaagctcctgatctatgctgcctccactttgacaaagtcggggtcccagtcaaggttcagcggcagtggatcgnggacagatttcactctcaccatcagtcagcctgacagcccgtagaacgtnttttacgactaaactttattacgtgtactaaacagtactttaaatagttaacttcctacgttaccgtttcgggacgggaacgggtacctaagggtacgtaagtaacttaccgaaaacggtactcggtaggctacgaccaccgtaattcgtacggttccttacgactttacccgttcccgaccttaatccgttaggaacgttacgg

SEQ ID NO: 10502 - DNA, 583 bp, Homo sapiens
  misc_feature: GYAE6OF01CN7B9.38.6.A06.1.454.CMB.1.raw
  modified_base (238)..(238): a, c, t, g, unknown or other
  misc_feature (238)..(238): n is a, c, g, or t
  modified_base (379)..(379): a, c, t, g, unknown or other
  misc_feature (379)..(379): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcactgccgggccagtcagggcattagctagttattagcctggtatcagacaaaaaccgnggaaacgcccctaagcctacctgactctaatgctgcctaccatttgactaaaggtcgggtacccatcgaaggttcaggcggcaggtggatcgtgggacagtactttcactctcacatcagcagcctgaccagctagaagtntttgactaacttattacgtgtacaactagtacttaaattacgttactaccgttactacgtttcgggacggtacggtaaccgtaaggtacgtagacgtacaaacggtacgtaggtcggtactacgaccgtaaccgtacgttaccgttacggttcccttacgtacgtttacccgttacccctactacttccgtagtaaccgtacgg

SEQ ID NO: 10503 - DNA, 715 bp, Homo sapiens
  misc_feature: GYAE6OF01BYKX0.38.6.A06.1.454.CMB.1.raw
  modified_base (241)..(241): a, c, t, g, unknown or other
  misc_feature (241)..(241): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccggccagtcagggcattagctagttattagcctggtatcgagaccaaaaaccgngggaaacgcccgtaagcctacctgatctatgactcgccctctactttggacgtaaaggtcgggtacccagtactaaggttcaggcggctaggtcggaatcgtaggacagtactttccgacctctaccctacctatccgagaccgtacgcccgttcggacacggtcccgttaagtaacggttacttttacggaccttaaactttaagtttacctacgtaactaaccgtacggttaactttaaacgttaacgttacttaccgttccgtaacgtttcggggaccggtaacgggtaaccgtaaggggtaccgtaacggtaaccgtaacgtaaaaccggtacgttacgggtacggtaccttaccggtaacctaaccggttacgttaccggtttcccggttacccgtttacgttaacccggtttcccgtttacccccccggtaaacttaaccggtttacccggtaacgggttaaacccgg

SEQ ID NO: 10504 - DNA, 721 bp, Homo sapiens
  misc_feature: GYAE6OF01BRIDD.38.6.A06.1.454.CMB.1.raw
  modified_base (243)..(243): a, c, t, g, unknown or other
  misc_feature (243)..(243): n is a, c, g, or t
  modified_base (264)..(264): a, c, t, g, unknown or other
  misc_feature (264)..(264): n is a, c, g, or t
  modified_base (658)..(658): a, c, t, g, unknown or other
  misc_feature (658)..(658): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcacatcacttgccgggcagtcagggcattagctagttatttagcctggtatcagacaaaacgaggaacnccctaagctacctgatctatnctcgcctcctacgtttcgacgtaacggtcgggtaccctagtaccgtaagggttcgacggtacggacgtacggttaggacgttacggtacggggaactacggttactttcgtaaccttcctaccgaaccctaagttacccgacggaccgaacggtccccgttacggacccgtaacggtacccgttaaggttaacgtttacgtttttacggaactttaaaccgtttatttaacgttaacgtactaacgttaacgttaccttttaaagttacgtttaacttccgttaccgttaccggtttacggggaccgggtaacgggtaaccgtaagggtacggtaacggttaaacgtaaccgtaaacgtacggttcggtacggtacctacggtacctaaccgtnttccgttacgttcctttacaccgttccccttacccggtacttacgttccgtaaaggttaccgg

SEQ ID NO: 10505 - DNA, 787 bp, Homo sapiens
  misc_feature: GYAE6OF01AX4FT.38.6.A06.1.454.CMB.1.raw
  modified_base (252)..(252): a, c, t, g, unknown or other
  misc_feature (252)..(252): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttggccggccagtcgagggctagttagctagtttattagcctggtatcaagacaaaaaccgagggaaacncccctaagcctccgtagactctatcgctcgtcctactactttgacgtaagggtcgggtaccctagtacgtaaggttccgaggtcggcgaggtggtaacttcggtaggggaactaacggttaacttttaccgacctttccgacctaaccctacgtaccgaacgtacccgagtccccgttaggaccctaacggtacccgttagggtaaacgtttactttttacggaaaccttttaaaaccttttaacgttaaccgttacgggtaaacctaaaacgttaacggttaacctttttaaaacgtttacggttttaacttaccccgtttaccggtttaacggttttacccggggaaacgggtaaccggggtaaaccgtaacggggttaccgtaaacggtaacgtttaaaccggaaaccggttaacggtttagggttacgggttacacccgtaaaccgttacgtttccgttacgtttacctttaccgtaccgtttacccgttccccgaacgttacgttaccggtacggtaacgtgtaacccgg

SEQ ID NO: 10506 - DNA, 592 bp, Homo sapiens
  misc_feature: GYAE6OF01CNPE1.38.6.A06.1.454.CMB.1.raw
  modified_base (227)..(227): a, c, t, g, unknown or other
  misc_feature (227)..(227): n is a, c, g, or t
  modified_base (350)..(350): a, c, t, g, unknown or other
  misc_feature (350)..(350): n is a, c, g, or t
  modified_base (364)..(364): a, c, t, g, unknown or other
  misc_feature (364)..(364): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctggtaggagacagagtcaccatcacttgccgggccagtcagggcattagcagttatttagcctggtatcaagacaaaaaccgngggaaaccccctaagcctctagatctatgctgcctcctacttgacaaggtcgggtccagtcaaggttcagcggcaggtgatcgtgggacagtatttcgactctacaccatcagcagcctgacngccgttagaagttntttacgacctaacgtttattacgtgtacaacgtacgttactttaaagtagtttacctcgttaccgttacggtttccgggacgggaacggtaaccgtaagggtaccgaagtaactaacgaaacgtacgtggtacgctacgacctaacctgttccgtgttcctacgtaccgttcccttaccccgctaccgtctacggtaaacgtgtacgtccggtaacgtgggtaccggg

SEQ ID NO: 10507 - DNA, 612 bp, Homo sapiens
  misc_feature: GYAE6OF01A95XT.38.6.A06.1.454.CMB.1.raw
  modified_base (238)..(238): a, c, t, g, unknown or other
  misc_feature (238)..(238): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctcctgtctgcatctgtaggagacagagtcaccatcacttgccgggccagtcagggcattagctagttattagcctggtatcagacaaaaaccgngggaaacgcccctaagctcctgacttctatgactcgtcctacctactttgacgtaaacggtcggggtacccagtacgaaggttccaaggcggtacaaggtggactcgtgggacagtattcactctacacgtatcagcagcctgctagccgtagtaatacgtttacgacttaacgtttattacgtagtacaactagtactttaagtagttactctacttacgtttacgggacgggtaacggaacctaagggtaccgaagtactaacgaaacgtacgtcgggtacggtaccgtacgtactaccgtacgttaccgttcgtttccgttaccgtaacttcccgttacccgaccttaagttccgtacgtaaccggttacg

SEQ ID NO: 10508 - DNA, 766 bp, Homo sapiens
  misc_feature: GYAE6OF01BEODK.38.6.A06.1.454.CMB.1.raw
  modified_base (152)..(152): a, c, t, g, unknown or other
  misc_feature (152)..(152): n is a, c, g, or t
  modified_base (242)..(242): a, c, t, g, unknown or other
  misc_feature (242)..(242): n is a, c, g, or t
tcagtcgatcacgtcacgaccggtgctcgatttagatctactgacagggaggatggagactgggtcaactggatggcacatctggctccaggtgccagatgtgccatccagttgacccagtctccatcctccctgtctgcatctggtagganacagagtccaccatctacgttcggccgggccagtcgagggctagttagctagtttattagcctggtactcaagaacaaaacgagggaacncccctaagcctctagactctagtcgtctcgtaccctccgtacgttacgacgtaaaggtccgggtaccctagtaccgtaaggttcaaggtccggcgtaggtcggtacgtacgtacgggtactacggttactttcaccgttctacctaccgtatacgaagtccgtaacgtccgtacgaccgtacgtaccgttaaggtaaccgtttagtttacggtaacctttaacctttatttaaccgttaggttaaccgtaaacggttaatttaacgttttaaacgtacggtttaccttaccgttaccggttacccggtttacggggaaccggggttaacggtaaaccgtaagggtaccgtaacggtaagaaccggttaaacggtacggttacggtaccggtactaccgacctaacgtacgttccgttacgtttaccttaccgtaccgtttaccccgttacccggtaccttacggttacccggttaacggttaaccgttacggtaaccgttccggtaggttacgggacccggggg

SEQ ID NO: 10509 - DNA, 791 bp, Homo sapiens
  misc_feature: GYAE6OF01EQVAK.38.6.A06.1.454.CMB.1.raw
  modified_base (305)..(305): a, c, t, g, unknown or other
  misc_feature (305)..(305): n is a, c, g, or t
  modified_base (441)..(441): a, c, t, g, unknown or other
  misc_feature (441)..(441): n is a, c, g, or t
  modified_base (738)..(738): a, c, t, g, unknown or other
  misc_feature (738)..(738): n is a, c, g, or t
tcagtcgatcacgtcacgaccggtgctcgatttagatctactgacagggaggatggacatggagggtccccgctcagctccgtggggctcctgctgctctggctcccgaggtgccagatggtcgccatccagttcgacccagtctccactccctcctgtctgcattcgtagtaggacacagacgtaccacctatcctaccgttcgggcccgggtcctaggtaccgaggggtacctagttacgcgttaagtttactttacgccgttaggttactacgaacgaaaccgaaaaaccggacggaaaccncccgttaaagcccgttacgtagaacttctagtcgccttactcccgtaccgttacgttggaaccgtaacggggttcccggaccttagtaccggtaaggttacgacgggtccggtacgtaggtcggtacgttaccggngggaactaagttccgtttaccaccgttccactaaccgtcgtaacccagggtaccctaacggccgttacgaccgtacgggtaccttaaggtaacgttttacgttttacgaaaccctttaagtttttaaccgttacgtaacggttaaccctaagtttaacggtttaaaccttttaaagggtttactttacttaccggtttaccttacggggttaaccgggtacgggtaacccggttacgaacggttacgtaacgtaaactaacgaacgttggcgttccgacttacgccgttattacgtnttacccgttacctcgaccccttttccgtacccgagttacgttccaaggttacg

SEQ ID NO: 10510 - DNA, 597 bp, Homo sapiens
  misc_feature: GYAE6OF01EAXN8.38.6.A06.1.454.CMB.1.raw
  modified_base (238)..(238): a, c, t, g, unknown or other
  misc_feature (238)..(238): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttatttagcctggtatcagacaaaaacngggaagccctaagctcctgatctatgctgcctcctactttgactaaaggtcggggtaccctagtcgaaaggttcaaggcggcaggtggatcgtgggacagtatttcactctacacatcagcagcctgcagtcctagaagttattttacgacttaactttattactacgtacaacgtagtactttaaattagttactccttacgtacgtttccggacgggaacgggtaacctaaggtccggtaagtaactaacgaaacgtaacgttcggtggtaccgtcgacctaacccgtagttaccgttacggttccttactactttccccgttaccccgtaccttactcgttacgtaaacggttcgg

SEQ ID NO: 10511 - DNA, 604 bp, Homo sapiens
  misc_feature: GYAE6OF01EMRNC.38.6.A06.1.454.CMB.1.raw
  modified_base (462)..(462): a, c, t, g, unknown or other
  misc_feature (462)..(462): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttcggccgggccagtcgagggctattagctagtttattacgccgtggtatcgaacgaaccaaaaaccgagggaaacgtacccctaagcctccgtagatctagtcgtcctcgcccttcctacgtttacgacgtaaacgggtccggggtacccagtacgtaaggttcgaggtcggtacgtaggtcggtacgtcggtagggaactagtactttcacctcctaccacctatcgacgcgacgcctgctacgtcgtagtaagtctttacgacttaacttatactntaacaatagtacttaatatctcgtctacggttcggaggtaacgacgaaggtcgagtaactacgaacgtgtggcgtaccgagtacctacgtattcgttcgtaccgttactaccttcccgtacccgatacgtcgtacggtaacg

SEQ ID NO: 10512 - DNA, 718 bp, Homo sapiens
  misc_feature: GYAE6OF01CBLP4.38.6.A06.1.454.CMB.1.raw
  modified_base (113)..(113): a, c, t, g, unknown or other
  misc_feature (113)..(113): n is a, c, g, or t
tcagtcgatcacgtcacgaccggtgctcgatttagatctactgacagggaggatggagactgggtccccgctcagctcctgggctcctgctgctctggctcccaggtgccagntgtgccatccagttcgacccagtcctccactcctccctgtctgcatctgtaggagacagacgtcaccatcctacttcggccgggcctagtcgacgggtctaagttagactagtttattacggccgtaggtactacgaacgaaccaaaaaccggaagggaaacctacccgtaaagtccttacgagtactacgtatcgctcgcctcgtacgttgacgtaacggtccggtaccaagtcgtaacggtcacgggacgtacgtaggtcggtagttccggacgggtaactacggttacttcccgtaacttccgtacctacgtaataccggtaacgtcgaccgtcgacgaccgtacgtccgtaagtaattacggtttacactttaacttacgttacttacgtaactaacgtacgtaacgtttaacgtacgtttaacttccgtaccggttacgtttacggggaccggtaaggtaaccctaagggtacgtaaccgttaacgtaacgtaaccggtagttacgacggttccgaccggttaactacccggttacttacggttacgtacctttcggaacctttccgtaacccgcgttacttacggtacgtcgttaacgg

SEQ ID NO: 10513 - DNA, 744 bp, Homo sapiens
  misc_feature: GYAE6OF01CUQDU.38.6.A06.1.454.CMB.1.raw
  modified_base (153)..(153): a, c, t, g, unknown or other
  misc_feature (153)..(153): n is a, c, g, or t
  modified_base (393)..(393): a, c, t, g, unknown or other
  misc_feature (393)..(393): n is a, c, g, or t
tcagtcgatcacgtcacgaccggtgctcgatttagatctactgacagggaggatggagactgggtcaactggatggcacatctggctcccaggtgccagatgtgccgtccagttcgacccagtctccatcctccctgtctgcatctgtagganacagactcacatcacgtgccggcagtcgaggcattagctagttattagctggtactcgaagacaaaaaccgagggaaacctcccctaagctcctagacttacgtatgctcgcccttctaccgtttaggaccgtaacggttccggggaccctaagttaccgaaggttccgaggtccggtagtaggtcggaacgttccggtagggaacctaggtaacttttccaacttcctaccaaccttanaccgacgccaaggtcctacggactaacggtaccctaaggtaaagttttaccttagaaccctttaagtttaacttacgttctaacgaaacttgttaaactttaaagttatttaaccttaccggtaaccgttacgggtttacggaaccggggttaacggaaacccgtaaggttacgaaacgtaactaaacggaaaacgttcgtacgttacgggacctcgaacctaccgttacggtttctaccggttccttaccgttaaccccgtttcccgttacccccgaacggttactttccggaacgttaaacgggtccgtaaccgtttaaccggaggtttccgggaacggggtcccgggg

SEQ ID NO: 10514 - DNA, 802 bp, Homo sapiens
  misc_feature: GYAE6OF01CJJGV.38.6.A06.1.454.CMB.1.raw
  modified_base (238)..(238): a, c, t, g, unknown or other
  misc_feature (238)..(238): n is a, c, g, or t
tcagtcgatcacgtcacgaccggtgctcgatttagatctactgacagggaggatggagactgggtcaactggatggcacatctggctcccaggtgccagatgtgccgtccagttcgacccagtctccatccctccctgtctgcatctgtaggagacagagtcaccatcacgttcggccgggccagtcagggctatagctagttattagcctggtatcaagaacaaaaccgaggaaacnccctaagctcctagatctatcgctcgtcctactacgtttcgaacgtaaacgggtcgggtacccagttacggtaacggttccgacggtcggacgtaagggtcggtacgtcggtacgggaactacggttactttcgactctacaacctataccgaagtccgacgtccgtaggtacgacgtaccgtagttaaaggtttacttttaacgaaccttaactttaacgttaacgttacgttaaccgaaagttaccgttaaacttttaaacggttaactttactaccccgtttacggttaccggttttaaccgggggaccgggtaaaccggggtaaccggttaaggtacccgggtaaaacgtaacgtttaaacccgaaaacgggtttccggtaacgggttaccggtaccgtaaccgggtaacctacgtacccgttttcggtacccgtttaccgttaccgttaaccccgttccccggttaccccgttaaccgttaccgttaacccggttaagggttaaccccgtgttaaacccgtaccgggtaacggttccggggaacggggtttaacccggg

SEQ ID NO: 10515 - DNA, 654 bp, Homo sapiens
  misc_feature: GYAE6OF01CU4VT.38.6.A06.1.454.CMB.1.raw
  modified_base (250)..(250): a, c, t, g, unknown or other
  misc_feature (250)..(250): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatccctccctgtctgcatctgtaggagacagagtcaccatcacttgccgggccagtcagggcattagctagttattagcctggtatcaagaccaaaaaccgagggaaacncccctaagcctcctagatctatgctcgcctcctactttgacgtaaaggtcgggtacccagtacgaacggttcaggcggctaaggtgaacgttcggtacgggaactaggttactttaccacgttacctaccaaccctagtaccgaacggaccgtacggtcccgttaggaccgtaacggtacccgtaaggttaacgttacttttaacgaccttaaacgtttatttacgtacgtaacacgtagtacttaaattacgttatccttacgtacggtttcggacgggtaacggtacgtaagggtcgaagtacttaacgaaacgtacgtgtacggtctacgacctaccgtattccgttacttccttacctaccgttcccgttacccacttacttaccgtaggtaacgtacgg

SEQ ID NO: 10516 - DNA, 540 bp, Homo sapiens
  misc_feature: GYAE6OF01A19KZ.38.6.A06.1.454.CMB.1.raw
  modified_base (222)..(222): a, c, t, g, unknown or other
  misc_feature (222)..(222): n is a, c, g, or t
  modified_base (325)..(325): a, c, t, g, unknown or other
  misc_feature (325)..(325): n is a, c, g, or t
  modified_base (356)..(356): a, c, t, g, unknown or other
  misc_feature (356)..(356): n is a, c, g, or t
  modified_base (525)..(525): a, c, t, g, unknown or other
  misc_feature (525)..(525): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttattagcctggtatcagcaaaaaccngggaaacgcccctaagctcctgatctatgctgcctccatttgacaaagtcgggcccatcgaaggttcagcggcagtggatcgtgggacagtactttcacgtcncaccgatcagccagcctgcagcctagaagtntttgactacttattacgtgtacaacgtgtattaatattatctacgtcgtttacggacggacggacgtaaggtacgagaatacaacgtaagtggtaggctacgctacctagttcctagttccttacgtacttcccgttcccgtcctaactcgtacggtaaccgtgtaccncgtagtcggtacggg

SEQ ID NO: 10517 - DNA, 584 bp, Homo sapiens
  misc_feature: GYAE6OF01AZO1Z.38.6.A06.1.454.CMB.1.raw
  modified_base (230)..(230): a, c, t, g, unknown or other
  misc_feature (230)..(230): n is a, c, g, or t
  modified_base (248)..(248): a, c, t, g, unknown or other
  misc_feature (248)..(248): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
  modified_base (326)..(326): a, c, t, g, unknown or other
  misc_feature (326)..(326): n is a, c, g, or t
  modified_base (338)..(338): a, c, t, g, unknown or other
  misc_feature (338)..(338): n is a, c, g, or t
  modified_base (367)..(367): a, c, t, g, unknown or other
  misc_feature (367)..(367): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctcctgtctgcatctgtaggagacagagtcaccatcacttggccgggccagtcaggcattgcagttattagcctggtatcagacaaaaaccgagggaaacnccctaagctctgatctancgctcgcctacctactttcgactaacggtcgggtccccatacgaaggttcaggcggcgtagtggatcgnggganagtnttcactcacacntcagcacgctagcagtccgtagtaacgtntttacgacttaattacttacgtacgtacaacgtacgttaacttagttagttacttcgtaccgtacggtttacgggacggtacggaaccgtacgggtacgtagtacgtaacgtaaacgtacgtacgggtcgtacgtacgtacctaccgtattccgtattccgttactaccgttccgtcccactctacgtacgtacgtctacgtacgcgtggcggtcgg

SEQ ID NO: 10518 - DNA, 626 bp, Homo sapiens
  misc_feature: GYAE6OF01EVTRM.38.6.A06.1.454.CMB.1.raw
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcaggggcattagctagttattagcctggtatcagacaaaaaccgagggaaacgcccctaagctcctagatctatgctcgcctcactttgacaaaggtcgggtacccagtcaaggttcagcggcaggtggatcgtgggactagtatttcactctccacatcagcagccctagctacgtacctgaagttactttagaccttaacgttattaccttagtacaacctagtactttaaattacgttaactccttacgttacgtttaccggggacggtaacgggtaaccaagggtaccgaagtacgtaaccgaaacgtaccgtggtaccggcttacgaccctactacgttccgttacttccgttcctaacgtttccctaccccggtacctactttccgggtaactaaccggttagtaaccttacccggtacgttcgggacggtacccgggg

SEQ ID NO: 10519 - DNA, 631 bp, Homo sapiens
  misc_feature: GYAE6OF01EWWYO.38.6.A06.1.454.CMB.1.raw
  modified_base (110)..(110): a, c, t, g, unknown or other
  misc_feature (110)..(110): n is a, c, g, or t
  modified_base (172)..(172): a, c, t, g, unknown or other
  misc_feature (172)..(172): n is a, c, g, or t
  modified_base (249)..(249): a, c, t, g, unknown or other
  misc_feature (249)..(249): n is a, c, g, or t
tcagtcgatcacgtcacgaccggtgctcgatttagatctactgacagggaggatggagactgggtcccccgctcagctcctggggctcctgctgctctggctcccaggtnccagatgtgccatccagttcgacccagtctccatccctccctgtctgcatctgtagagcagngtcaccatcacttgccgggccagtcgagggcattagctagtttattacgccttggtatccaagaccaaaaaaaccgngggaaacgacccctaagtcctcctacgtacgtactacgtccgtccgtcccgtccctacctttacgttacggtaaccggtggggggtaccgtactacgtacgggttcgaacggcggacaccgggttggggaactcgtgggtaccagttatttccactctccaccatcgagcagcctgcagccttagacttatttgactaactttacttaactagtactaagtagtacttaataacgtttactccgtacgtaacgtttaccggacgggtaacgggaaccgtaagggtacgaaggtaactacgaaacgtacgtaggtcgtacgtgaccgactactctcttaccttccactcccttcccgactacttacgcggttaacgtagtacg

SEQ ID NO: 10520 - DNA, 803 bp, Homo sapiens
  misc_feature: GYAE6OF01EI7D4.38.6.A06.1.454.CMB.1.raw
tcagtcgatcacgtcacgaccggtgctcgatttagatctactgacagggaggatggacatgagggtccccgctcagctcctgggggctcctgctgctctggctcccaggtgccagatgtgccatccagttgacccagtctccatcctccctgtctgcatctgtaggagacagagtcaccatcacgttcgccgggccagtcgagggcagttagctagtttatttacgcctggtatacaagaacaaaaccgaggaaaccgcccctaagtcctactgtactctactcgacctcgtccccttacctacgtttacggaaccgttaaacggggttccgggtacctagttaccggtaacgggttaccgacggccgggtacgtaggtacgggtacgtcggttacggggaactaggttacttttacccaccttcctaaccctaacctacgtaccgacggaccgtaccggtccctacggaccgtaaccggtcccgttaaggttaaacgttacgtttttacggaaacccttttaaacgttttacttaaccggttaccggtaaacctaaacgtttacgtttaactttaaacgtttacgtttaccttccgttaccggtttaccgggtttacggggaaccggggttaaccggtaacggttaacggggtacgtaacgtaaacgtaaccgaaaaccggttggttacgggtacccgtcgtaccgacccgttaccttaggttacctttccgttacccttacgtacccgttttcccccgtaacccccggtaacttacccggtttaggtaccgttaaaacggg

SEQ ID NO: 10521 - DNA, 684 bp, Homo sapiens
  misc_feature: GYAE6OF01BH587.38.6.A06.1.454.CMB.1.raw
  modified_base (165)..(165): a, c, t, g, unknown or other
  misc_feature (165)..(165): n is a, c, g, or t
  modified_base (255)..(255): a, c, t, g, unknown or other
  misc_feature (255)..(255): n is a, c, g, or t
  modified_base (344)..(344): a, c, t, g, unknown or other
  misc_feature (344)..(344): n is a, c, g, or t
  modified_base (515)..(515): a, c, t, g, unknown or other
  misc_feature (515)..(515): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctcctgtctgcatctgtaggngacagagtcaccatcacttgccgggcagtcagggctattagctagttattacgcctggtactacgagaaccgaaaaaccgagggaaaccnccccgtaagcctaccgtgacttctagtcgctccgtcctcgtactttgacgtaaacggtcgggtaccctagtcgtaaggttcgagtcggngtagtaggatcgtagggactacgtattacctacgtacctacgtaactacgactacggtactaccggtacctcggacctacggtaccgttaagtaaacggtttacttttacggtaaccttaaacgtttacttacgttaacgtaacctaactaaggtttaccctttaaagttntttaacctcctttaggtaaccgtttcggggaacgggttaacgacgtaacgggtcgtaagttaccgaagtaaaccgtcgtggtacgtctaacggtcctacgttacgttcgttcccttacgttaccttaccgttacccctaccgtaacctcgttaccgtaacgggtaacgg

SEQ ID NO: 10522 - DNA, 574 bp, Homo sapiens
  misc_feature: GYAE6OF01BYW37.38.6.A06.1.454.CMB.1.raw
  modified_base (225)..(225): a, c, t, g, unknown or other
  misc_feature (225)..(225): n is a, c, g, or t
  modified_base (233)..(233): a, c, t, g, unknown or other
  misc_feature (233)..(233): n is a, c, g, or t
  modified_base (368)..(368): a, c, t, g, unknown or other
  misc_feature (368)..(368): n is a, c, g, or t
  modified_base (388)..(388): a, c, t, g, unknown or other
  misc_feature (388)..(388): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagctagttatttagcctggtatcagacaaaaaccngggaaacncccctaagcctcctgatctatgctgcctcctactttgacgtaaaggtcggggtcccagtacaacgggttcaggcggcagtggatcgtgggactagtatttcactctcaccatcagcacgcctgcagcctgaagtnttttgacttaattattactntacaactagtaacttaattagtttactcttacgtaccgtttcgggacgggtacggtaacgtaaggtacgagtaacgtaacgtaaacgagtacgtcggtctacgacctactcgttcttcgtacgttctacttccctacccgtccttacttccgtagtaacgttgaacgtccgttaggtcgtacgggg

SEQ ID NO: 10523 - DNA, 741 bp, Homo sapiens
  misc_feature: GYAE6OF01CMXB6.38.6.A06.1.454.CMB.1.raw
tcagtcgatcacgtcacgaccggtgctcgatttagatctactgacagggaggatggagactgggtcaactggatggcacatctggctccaggtgccagatgtgccgtcagttcgacccagtctccatccctccctgtctgcatcgtgtaggagacagacgtccaccagtctacgtcggccggcagtcgacgggtcattagctagtttacttacgcgtgtatacgaagaaccgaaaacgacgggaaccacccgtaagtcctaccgtagtactactagtcgctcgtcccttactacgttgtaacgtaacggtcggtacctacgtacgacggttcgacggcggacgtaggtgtacgtacggacggtactaacgtctttaccgtacctaccttaccaaccgtacgtacgacgaccgtacgaaccgtcggacctacggtacgtagttaacgttttagttacgaacctttaactttacgtaacgttacggtaactaacgttaagttaacgtttaaacgttacgtttaccgttacgtacccgtttaacgggttacgggacgggttaaacggtaaccggtaacgggtaacgaacgtaacgtaaccgaaacggtaccgtaggtccgtaccgtacgtaaccgactacgttcgttaccgttaccgttaattccccgtttacccgtaccctacttaccgttacgtaacggttacttaccgggtactaccggtacggtcgggtcgggtaccggg

SEQ ID NO: 10524 - DNA, 591 bp, Homo sapiens
  misc_feature: GYAE6OF01DTF8Z.38.6.A06.1.454.CMB.1.raw
  modified_base (250)..(250): a, c, t, g, unknown or other
  misc_feature (250)..(250): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttcgacccagtctccatccctccctgtctgcatctgtaggagacagagtcaccatcacttgccgggccagtcagggcattagctagttattagcctggtatcaagacaaaaaccgagggaaacnccctaagctcctgatctatgctcgcctacctacgtttgacgtaaaggtcggggtacccagtcgaacggttcaggcggacgtagtggatcgtagggactagtacttcgactctacacatacagcacgctgacagcctagtaagtactttgacttaacttattactagtacaactagtaactttaatacgttactcttacgtacggttccgggacggaacgggtaacctaagggtacgaagtaactaacgaaagtacgttaggacgtacgtcgaccgtacctacgttcgttacgtttccttactaccgttcccgttacccgactattccgtagtaacggtacg

SEQ ID NO: 10525 - DNA, 651 bp, Homo sapiens
  misc_feature: GYAE6OF01DWOCX.38.6.A06.1.454.CMB.1.raw
  modified_base (167)..(167): a, c, t, g, unknown or other
  misc_feature (167)..(167): n is a, c, g, or t
  modified_base (242)..(242): a, c, t, g, unknown or other
  misc_feature (242)..(242): n is a, c, g, or t
  modified_base (398)..(398): a, c, t, g, unknown or other
  misc_feature (398)..(398): n is a, c, g, or t
  modified_base (634)..(634): a, c, t, g, unknown or other
  misc_feature (634)..(634): n is a, c, g, or t
tcagtcgatcacgtcacgaccggtgctcgatttagatctactgacaggggaggatggagactgggtccccgctcagctccgtgggctcctgctgctctggcctcccaggtcgccagatgtcgccatcctagttcgacccagtcctccactccctccctgtctgcatntggagagacagactaccaccatctacgttcggccggaccagcgaggatagttacatagtttatttagcctagtanacaacgaaccaaaacggaggaaccaccctaagctacctagtaactctatcgctcacctactacttaggacgtaacggttcggacctaagtacgaacggtcgacggtacgagtaagtcgacgtcggtaggaactagtctttacactctacaacgtanacacggactacgcgcacgtacgtagtaaggtaatttacggtttacaacttaattaacttaccgtacgtaacaaagttacgttaaatttaacgttacgttaattcccgttaacggttaacggtaccgggtaacgaaccggggtaaactaaccgggtactaacgtaacgttaacgtaaaccgtgtacgtacgacctacgtacaaccgtcttaagcttccgtacaccgtttccaccgtntacctacgtagaggtac

SEQ ID NO: 10526 - DNA, 735 bp, Homo sapiens
  misc_feature: GYAE6OF01D5EAT.38.6.A06.1.454.CMB.1.raw
  modified_base (439)..(439): a, c, t, g, unknown or other
  misc_feature (439)..(439): n is a, c, g, or t
tcagtcgatcacgtcacgaccggtgctcgatttagatctactgacagggaggatggacatgagggtccccgctcagctccgtggggctcctgctgctctggctcctaggtgccagatgtcgccatccagttgacccagtctccatcctccctgtctgcatctagtaggagacagagtcaccattcgacgttcggcccgggaccagtcgagggactagttacgacttagtttatttacgccgttaggtaataccgaacggaaaccaaaaaccggaagggaaacccaccccgtaagtcctcctagtacttctagtcgtcctccgacccttcctacgtttcggacgtaacgggtccggtacccagtacgtaaggtcgacggcgagtaggtcgtacgtcggaggactacgtacttcactcctacacatcgagtccacggtccngtctacgtcgtagtacgttattcgtaactttaaagtcttacgtacgtaacctaattacgtttaactttaagttacttcgtttaccgttaccggttaaccgggttacgggggaaaccgggttaaccggtaaccgggtaaagggttaccgaaacgttaacccgtaaacggtaacggtacgttacgggtactacccggtaccgtacccgtaccggttacctttcggtttaccgttaccttaccccgttaccccgtttaccggtaccccttacctttaaccggtggttaaccgggtaacg

SEQ ID NO: 10527 - DNA, 650 bp, Homo sapiens
  misc_feature: GYAE6OF01A42XX.38.6.A06.1.454.CMB.1.raw
  modified_base (230)..(230): a, c, t, g, unknown or other
  misc_feature (230)..(230): n is a, c, g, or t
  modified_base (253)..(253): a, c, t, g, unknown or other
  misc_feature (253)..(253): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcacttagctagttatttacgccttggtatcagactaaaaaccgngggaaacgcccctaagcctaccngatctatgctgcctactactttggactaaggtcgacgttcccatcgaaggttcaagcgctaagtcggatcgtagggacagtatttcactctcactatcagcacgtcctgactagcctagacgttatttacgactaactttcgttactgtaccaactacgatttaaattacgttacttcgttacctacgttttccgggaccgggtaaggtaacccgtaagggtacgtaacggtaaatttacccgaaaaacgggtacttagggtacgtacgtaccggtacctacccttaagttccgtttacggttacctttacccgttaacgtttccccttcccccgggtaaccttacgttaccgtaccggtttaacccgggtatacggttaaccgtcgggtaacgggg

SEQ ID NO: 10528 - DNA, 688 bp, Homo sapiens
  misc_feature: GYAE6OF01AO6BN.38.6.A06.1.454.CMB.1.raw
  modified_base (234)..(234): a, c, t, g, unknown or other
  misc_feature (234)..(234): n is a, c, g, or t
  modified_base (242)..(242): a, c, t, g, unknown or other
  misc_feature (242)..(242): n is a, c, g, or t
tcagtcgatcacgtcacgaccggtgctcgatttagatctactgacagggaggatggagactgggtccccgctcagctcctggggctccgtgctgctctggctcccaggtgccagatgtgccatccagttgacccagtctcatcctcctgtctgcatctgtaggagacagagtcaccatcacttgccggcagtcaggcattagctagttattagcctggtatcagacaaaaaccngggaaacnccctaagctcctgatctatgactgcctctactttgacctaaaggtcgggtacccagttacgaaaggtttccaggtccgggactaggtacgggtacgtaccgttaggggaacctaaggttaacttttcccgaacgttcccgtacaaacccgtacttaccgacggtacctaaacgtccccgttagggacctaacgggtacccttaacgggtaaagttacgtttttaaccgaccttaaacgttttaacttaacgtaccgttaaccaaacggtatacctttaaagtacgtttactacgtttaccgtacgtttaccgggaggaaccgggtaactaacgggtaccgtagaactaacgaaacgtacgtcgtagaccgtcgaacctaccgtagttcgttacggttctacctagtttcccgtccccgtactaagtccgttacgtaacggttcccg

SEQ ID NO: 10529 - DNA, 587 bp, Homo sapiens
  misc_feature: GYAE6OF01CMQDP.38.6.A06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagctagttattagcctaggtatacaaacaaaaaccgagggaaacnccctaagctcctgatctatcgctcgcctcctactttgacgtaaaggtcggggtacccatcgaacggttcaggcggcagtggatcgtgggactagtacttcactctccacatcgagcacgcctgcacgcctagaagttacttttgaacttaacttacttactgttaaccaatacgtactttaaagtacgttactccttacgtaccgtttcgggacgggacggaaccgagtacgaagataaccgaaacgtacgtggtcgactcgaccactactcgttcgttaccttctaaccgttcccgttccccgactcttacgtacggtacgtacgacttacgaccggtggacgggtccggg

SEQ ID NO: 10530 - DNA, 768 bp, Homo sapiens
  misc_feature: GYAE6OF01ESETP.38.6.A06.1.454.CMB.1.raw
  modified_base (237)..(237): a, c, t, g, unknown or other
  misc_feature (237)..(237): n is a, c, g, or t
tcagtcgatcacgtcacgaccggtgctcgatttagatctactgacagggaggatggagactgggtcaactggatggcacatctggctcccgaggtgccagatgtgccgtccagttcgacccagtctccatcctccctgtctgcatctgtagagacagagtcacatcacgtgccggcagtcaggcattagctagttagttacgccgtaggtactcaagaccaaaaaccgagggaaacnccctaagcctacctgatctatgctcgcctctacttgacgtaaggtcgggtccagtacgtaacgggttcgaacggtccggagtacggtacggtacgtccggtagggtaactaggttaacttttacccgaaccgttcccgtaaccgtaaaccctaacgttaaccgaacgttacccgaaaccggtcccgttacggaccgaaccgtttacccgtaaaggggttaaatttacggtttttaacgaaacccgtttaaaacctttaacgttaacccgggtttacgtaaacctaaaaccgttaacggtttaaacctttaaaaacggtttaacgtttaaccgttacccgttaaccgttaaccgggtttacccggggaaacggggtaacggtaaccggtaacgggtacgtaacggtaactaacgtaaaacgacgttgggtacgtatacgacacgtacttcgtccgttatacccgttaacgtcccgttacccgactacgttacgtacggaaacgttcgtaacgttacgacggtggcggtacgg

SEQ ID NO: 10531 - DNA, 533 bp, Homo sapiens
  misc_feature: GYAE6OF01BHFRO.38.6.A06.1.454.CMB.1.raw
  modified_base (231)..(231): a, c, t, g, unknown or other
  misc_feature (231)..(231): n is a, c, g, or t
  modified_base (308)..(308): a, c, t, g, unknown or other
  misc_feature (308)..(308): n is a, c, g, or t
  modified_base (359)..(359): a, c, t, g, unknown or other
  misc_feature (359)..(359): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctcctgtctgcatctgtaggagacagagtcaccatcacttgccgggcagtcagggcatagctagttattagcctggtactcagacaaaaaccgagggaaacncccctaagcctctgatctatgctcgcctcacttgacaaggtcgggtcccagtacgaaggttcaggcgcagtgatcgnggactatacttcactcacacatcagcacgcctgcagtacctaggtaagttntttagaccttaatttacttactagtacaactagtacttaagtacgttatcgttactacgttcggacggacggtacgaggtcgaagactacgaaacgtagtgtacgcgtcgactactgtctcttacgttcacttcccgtccgcctatccgtagacgtcgaactcgagtgaccggg

SEQ ID NO: 10532 - DNA, 528 bp, Homo sapiens
  misc_feature: GYAE6OF01A5IHM.38.6.A06.1.454.CMB.1.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (457)..(457): a, c, t, g, unknown or other
  misc_feature (457)..(457): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaaccngggaaancccctaagctcctgatctatgctgcctcactttgacaaagtgggtccatcaaggttcagcggcagtggatctgggacagatttcactctcaccatcagcagctgcagcctgaatatttgactaacttattactagtacaacagtactttaatagttatctactactttacggacggaacgggaccaaggtacgaagtataccgaaagtaacgngtacggctcgactaacctatcttacggtcttaccgattaccgttccccgacaacttctagaaccggttacg

SEQ ID NO: 10533 - DNA, 671 bp, Homo sapiens
  misc_feature: GYAE6OF01BWP9V.38.6.A06.1.454.CMB.1.raw
  modified_base (248)..(248): a, c, t, g, unknown or other
  misc_feature (248)..(248): n is a, c, g, or t
  modified_base (377)..(377): a, c, t, g, unknown or other
  misc_feature (377)..(377): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttcggccgggccagtcagggcattagctagttattagcctggtatcagacaaaaaccgaggaaacncccctaagtctcctgactctatgctcgccctcactttgacgtaaaggtcgggtacccagtcgtaaacggttcgaaggccggtacgaggtcggtaacgtcgtagggactagtactttcactctacacctntacgagtccacggtcctaggacctacggtcctaaggtaacgttagttttacgacctttaaacgtttacgtttaacgtacgtaaccaaacgtagttaacctttaaagtactttacttaccttacgttacgtttacggggacggtaacgggtaaccgtaagggttaccgtaagtaacgtaaccgtaaacgttaacggttcgtcgggtactcggtaccctaaccgtagtttcccgttcgttaccttccgttaaccgttcccttacccgaccttaacgtccgttaacgtaacgtacgg

SEQ ID NO: 10534 - DNA, 809 bp, Homo sapiens
  misc_feature: GYAE6OF01CCVO7.38.6.A06.1.454.CMB.1.raw
  modified_base (166)..(166): a, c, t, g, unknown or other
  misc_feature (166)..(166): n is a, c, g, or t
tcagtcgatcacgtcacgaccggtgctcgatttagatctactgacagggaggatggacatgagggtcccgctcagctcctggggctcctgctgctctggctcccaggtgccagatgtgccatccagttcgacccagtctccatcctcctgtctgcatctgtagganacagacgtcacatcacgttcggccggcagtcgagggtcattagctagtttattacgccgttaggtactacgaacgtaaccgaaaaaccggaaggggaaaccgtaccccgttaaggtccttaccgttaggtacttaccgtaagtcgtcctcgtaccccttaccgttacgttttacgaacgtaaacgggttccgggtaccctagtacggtaacggttcgacggcggtacgtaggtggtacgtcggtacggactacgttacttacacctccgtacctacgtactacgacgtaccgacgtccgtacgacgaccgttacgttaaggttaaactttcgtttaaccgaaaccttttaaacgtttacgtttaaccgtgttaaaccctaagttaacgttttaactttaaccgttttaagtttaccttaccgtttaccggtttaaccgggggttacgggtacccgggtaaacgggtaacccgttaaagggggttagaaaccggttaaccgttaaacgaacccgggttacggtttacgggtacccggttacctacgggttaacccccttacgttacgtttccttaccggttccctttaaaccgtcccgtttaacccgtaccccgtacgttacctttaccgggtaaacgtaccgg

SEQ ID NO: 10535 - DNA, 831 bp, Homo sapiens
  misc_feature: GYAE6OF01A0QBQ.38.6.A06.1.454.CMB.1.raw
  modified_base (258)..(258): a, c, t, g, unknown or other
  misc_feature (258)..(258): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatccctccctgtctgcatcgtgtaggagacagagtcaccatcacttcggccgggcagtcgagggcattagctagtttattagccttaggtatcgaagaacaaaaaccgagggaaacncccctaagcctcctagactctatgctcgtccctactacgtttgaccgtaaaggttccgggtacccagtacgtaacggttacgaggtcggacgtaggtcggtaacgtcggtaggggacctagttactttaccgtaccttaccgtaccaacccgtacgtaccgtacggacctaccggtccgtacggtaccgtaccggtaccgttaacgggttaaacgtttacgtttttacggaaacccgtttaaacccttttaacgtttaaccgttaccggtaaacctaaaccgttacggtttaaaccgttttaaacgtttaacgtttaacctttacccgttaccgggtttaacccgggttttacgggggaacccggggttaacgggtaaacccggtaacggggttaccgtaaacggtaaccgttaaaccggtaaaccgttaacggttcgggttaccggtaccggttaacccgaaccgttaccgttaaccggttacccgttaccggtttaccccttaacgtttaaccccgtttccccttaccccggttaacccgttaagtttacccgggtaacggttaacccggg

SEQ ID NO: 10536 - DNA, 675 bp, Homo sapiens
  misc_feature: GYAE6OF01CZD6Y.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctggtagagacagactcacatcacttcggccggcagtcagggctattagctagttacttagcctaggtatacaagaaccgaaaaaccgaggggaaacctccccgtaagtcctacctagacttctatcgctcgacctctagttacgacgtaaggtcggtaccagtacgaaggttcaggcggataggtggatcggtaggactagtcttacactctaccgactaagcaagcctacggtcctagacctagccgtagtaaggttactttacgaacttaacttagttaacgtacgtaacctaacgtagttaacctttaaagtacgtttacctacgttaccgttacggttaccgggtagggtaaccggaaccggtaggttaaccgaagtaaccgtaaccgtaaaacggtcgtacggttacgacctacggtaacctaccgttacgttacttaccggttaccttacccgtaacccgttaccccgttacccgaccgttaagttcccgtaaacggtaccggttaaaccg

SEQ ID NO: 10537 - DNA, 799 bp, Homo sapiens
  misc_feature: GYAE6OF01CZJTL.38.6.A06.1.454.CMB.1.raw
  modified_base (240)..(240): a, c, t, g, unknown or other
  misc_feature (240)..(240): n is a, c, g, or t
  modified_base (268)..(268): a, c, t, g, unknown or other
  misc_feature (268)..(268): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttcgacccagtctccatccctcctgtctgcatcgtgtaggagacaggactccaccatcactcggcccgggccagtcgagggctagttagctagtttattcgccgttaggtacncaacgaaccaaaaaaccgagggaaaccnccctaagcctacctgtactctagtcgtctcgcccttacctacgtttcggaacgtaaacgggttccgggtacccaagttacggtaaacgggttcgaacgggtcggtacgtagggtacggtacgtcggtacgggtaacttaacggttaaccttttacccgaaccctttccctaacccgtaaacccgtaacttacccggaaccgtacccgtaaaccggttcccctacggtacccgtaaccgtaaccgttaacgggttaaacgttttaacgttttaccggtaaaccttttaaaccgttttaactttaacccggttaacggttaaccctaaccgttaaagtttaaccgttttaaaacgttacgttttaccttacccggtttacgttaccgggtttaccggggaaccgggtaacggtaaccggtacggtacgtaacgtactaaaccgtaacgtagtacggtcgacctacgaccctactacttcgttcgttccttacgtaccctttcccggtaccctactacgtacgtacggttaacg

SEQ ID NO: 10538 - DNA, 693 bp, Homo sapiens
  misc_feature: GYAE6OF01CP9X0.38.6.A06.1.454.CMB.1.raw
  modified_base (440)..(440): a, c, t, g, unknown or other
  misc_feature (440)..(440): n is a, c, g, or t
  modified_base (446)..(446): a, c, t, g, unknown or other
  misc_feature (446)..(446): n is a, c, g, or t
  modified_base (454)..(454): a, c, t, g, unknown or other
  misc_feature (454)..(454): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttcgacccagtcctccactcctccctgtctgcatctgtacggagacagacgtcaccatctaccgttcggccggccagtcgagggctagttagacttagtttagtttacgccttaggtaactacaaacggaaccaaaaaacccggagggtaaaccgaccccgttaagtcctcctaggtacttacgtatcgacctcgtacccttacctacgtttacgaaccgttaaacgggttccgggtaacctacgtacgtaaacggttcgacggtcggtacgtagtggtacgtcggtaggacctagtaccttcaacctcacacnctacgntaccgtanccgttagcctacggctagtagttattcgtaatttaacgttactacgttataaactacgtactaagttaatacgtttaactccttaacggtacgtttccggggaacgtaccggtaacgtagggtaacctaagtaactaacgaaccgtagttcggactacgtcaaccgtactacggttacgtccctttctacccgtactttccccggtaccctacgttaactccggtagtaacccggtacg

SEQ ID NO: 10539 - DNA, 640 bp, Homo sapiens
  misc_feature: GYAE6OF01BSWZK.38.6.A06.1.454.CMB.1.raw
  modified_base (415)..(415): a, c, t, g, unknown or other
  misc_feature (415)..(415): n is a, c, g, or t
  modified_base (498)..(498): a, c, t, g, unknown or other
  misc_feature (498)..(498): n is a, c, g, or t
tcagtcgatcacgtcacgaccggtgctcgatttagatctactgacaggggaggatgggagactgggtcaactggatggcacatctggcctcccaggtgccagatgtgccatccagttgacccagtctccatcctccctgtctgcatctgtaggagacagagtccaccatcctacgttcggccgggcagtcgagggcattacgctagtttattacgcctggtactacaagaaccaaaaaccgagggtaaccgaccctaagcctaccgtgaatcgtatacgctcgcctcctacttgactaaggtcgggtacccatacgtacggttcgacggcggcgaggtcgtacgtcgtgggtactagtacttactctcctacaccgtatcgtacgactacgccgtcgacacgtacgtagtaactnttttagacttattagtactgtactacgtatacttagtacttacttcgtacttaccggttggaccggtacggaacgtagggtanaacgtaagtaaccgtaaacggtacgtcggtacgtactaccggtacctacgtacgttacgttccgtacgtttaccgtaccgttaccctacccggtcctacgttacgtacgtaccgttacgcttacggacgtccgggtaacggg

SEQ ID NO: 10540 - DNA, 770 bp, Homo sapiens
  misc_feature: GYAE6OF01C43X3.38.6.A06.1.454.CMB.1.raw
  modified_base (253)..(253): a, c, t, g, unknown or other
  misc_feature (253)..(253): n is a, c, g, or t
  modified_base (281)..(281): a, c, t, g, unknown or other
  misc_feature (281)..(281): n is a, c, g, or t
  modified_base (760)..(760): a, c, t, g, unknown or other
  misc_feature (760)..(760): n is a, c, g, or t
tcagtcgatcacgtcacgaccggtgctcgatttagatctactgacagggaggatggagactgggtccccgctcagctcctggggctcctgctgctctggctcccaggtgcagatgtgaccatccagttcgaccctagtcctccacttccctccctgtctgactatcgtaggtaggacgacagacgtccacctagtccacgttcggccggccagtcgaggctattaggacttaagtttattacgccgtggtacncaaacgaaacgaaaaaccgagggaaccncccgtaagtcctacgtgtaacttctacgtcgtctccgtacctacgttcgtttaacggaacgtaaacgggttccgggtaaccctagttaaccggtaacggttccggagggtaccgtacggtagggtaccgtaagtcgggtaacgggtactaacgtttaccttactaacccgtcttaccacccgttagtacctaacggcctaggtccccggtagaaccgtacggtaccgttaagggtaacttttaacgtttacaacttttaaccttaacgtttacgaactaactaaccgttagttaacgtttaaagtttaccgttacttacccgggtttaccggttaccgggtttacgggaacccggggtaacgtaacccggtaaggtacccgtaataaaccggttaacgaacgttacggcggttaaccggtacctccgaacgtaacctcggttctaacgttcctacttactcccaccgtactaggtaccnggtacccttg

SEQ ID NO: 10541 - DNA, 703 bp, Homo sapiens
  misc_feature: GYAE6OF01DZ4NO.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttcgacccagtctccatccctccctgtctgcatctggtaggagacagagtaccaccatcacgttcggcccgggccagtcgaggggcagttagctagtttattacgcctggtatacgagaaccgaaaaaccgagggaaccacccctaagcctctagtactctatcgtactccgcccttccgtactttaggacggtaacgggtcggggtacctacgtacgtaacggtcgaggtccggacgtaggtcggatcggtaggacgtagtactttccacctcgaccaacacgtacacggtcacgtccgtagccgtaacgtaccgtagtaaggtttactttacgtaaccttaaatttacgtacgtactaactaacgtacgttaacttaagtttacgtttaccttacggttacccgttacgggttacggggaacgggtaacgggtacccgtaagggtccgtaaagtaccgaacttaaaccggtgtcggtcggtacctacgtacctaacccgttattacccgttcttaccgttaccgttaccttacccccgttacccgaccttaacgtttccggaacggttaaccgg

SEQ ID NO: 10542 - DNA, 734 bp, Homo sapiens
  misc_feature: GYAE6OF01AV0L6.38.6.A06.1.454.CMB.1.raw
  modified_base (256)..(256): a, c, t, g, unknown or other
  misc_feature (256)..(256): n is a, c, g, or t
  modified_base (270)..(270): a, c, t, g, unknown or other
  misc_feature (270)..(270): n is a, c, g, or t
  modified_base (391)..(391): a, c, t, g, unknown or other
  misc_feature (391)..(391): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacgtagacgtcaccatcacgttcgccgggccagtcagggcattagctagttattacgccttggtatcgaagaccgaaaaacagggaacnccctaagtcctctntatctatgctcgtacctctacgtttcgacgtaacggtcgggtaccctagtacgtaggttccagcggtacgaggtggtacgtcgtacgggtactagtatttaccaccgtctaccgtactacnccgtacgacgtacggcctcggactacggtaccgtacgtaagttacgtttaccgtacttaaacccgtttagttaaccgttacgtaaccgtaaccgttaacggtttaacctttaaacggtttacttaccgtttacgttacccggtttaacccgtttacgggggaacccgggtaacggggtaacccgtaacggggttaaccgtaaacggtaacgttaaccgaaaaccggttacggtaaccggttcggccgttaccgtaccggtaccctacgttaccgttcggttacccgtttcttaaccccgtttccccggtacctaccccgttagttcccgtaacggttacccgg

SEQ ID NO: 10543 - DNA, 798 bp, Homo sapiens
  misc_feature: GYAE6OF01DV685.38.6.A06.1.454.CMB.1.raw
  modified_base (112)..(112): a, c, t, g, unknown or other
  misc_feature (112)..(112): n is a, c, g, or t
  modified_base (173)..(173): a, c, t, g, unknown or other
  misc_feature (173)..(173): n is a, c, g, or t
  modified_base (547)..(547): a, c, t, g, unknown or other
  misc_feature (547)..(547): n is a, c, g, or t
tcagtcgatcacgtcacgaccggtgctcgatttagatctactgacagggagggatggacatgagggtccccgctcagctcctgggctcctgcctgctctggctcccaggtcnccagatgtcgccatccgaggttcgacccagtctccatccctcctgtctgcatctgtaggancagacgtcaccatccgacgttcggcccgggactagtcgacggggctaagttacggcttaagtttacgtttacgccgttaggttaacacaacggaaaccgtaaaaaaccgacggggaaaccctaccctaacggtccttacctacggtactacttaacgtcgcgttcgaccccttcgtacgtttacggaaccgtaagggtccgggtaccctaaggttcgtaaacggttccgacgggacggtacgtagggtagtaccgtacggtacgggtacttacgttacctttaccgacgttccaccgttaaccacgtccgacgtacgtaccggcctacgacgtacgtaccgtaagtacgtttatttacgaactttaaacgtttntaaccgttacgtaccgaaaggttcttaacgttaacgttcgtttaacccttcggttaactacccgggtttacgggaaccggtaaaggttaacccgtagggttaacgtaccgtaaacgtaaaccggttaacggaccggttaggtccggtaccttaagtcccgtaacgttaccgttaccgttcggtaaacccctttcgttaacccgttcccgttaaacccggccttttaacggccgtttaaacccggggtacgg

SEQ ID NO: 10544 - DNA, 675 bp, Homo sapiens
  misc_feature: GYAE6OF01BHM82.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccattccctccctgtctgcatctgtaggagacagatccaccatccacgttcggccgggccagtcgagggctattagctagtttatttagccgttggtatcaacgaaccaaaaacgagggaaacgcccctaagtctacctgtatctatcgctcgacctcctacgtttgacgtaaacggtcgggtacccacgtcgtaacggttacaggcggacgtaggtacgacgtaccggtagggactacgtactttccgacctactcccaacacgtcctaacgctaacgtccgtacgacgtacgtaccctaggttaagtttacttttcgaaccctttaacttttaactttaaccgtacgttaaccaacgtaacgtttaagtttaacttaacgttttctaccgttacttaccgggtttaccgggacggtaacgggtacccgaacgggtagtacgtaaccgtaacgaacgtacgcggtacgccgtacgacccgacgtactttcgtcgttacttcctaccttccacccggtctacggtctacgggtacg

SEQ ID NO: 10545 - DNA, 846 bp, Homo sapiens
  misc_feature: GYAE6OF01B6DPZ.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttcgacccagtctccactcccgtccctgtctgctatcgtggtaaggagacagagtccacctatcacgttcggcccgggccagtcgagggactagttagactagtttattacgcctgatcagaaccgaaaaccgagggaaccaccctaagcctacctagtactacgttactacgtccgtacgtaccccttaccctagttttaccggaaccgttaacggggtacccggggttacccctaagttaccggtaaacgggttccgaacggggtccgggtacgtaacggtttcgggtaacgttaccggtaacgggggtaactaacggtttaaccttttacccggaacctttcccgtaacccgtaacccgttaagttacccggaaacgttccccgacggttaccctaacgggtacccgtaacgttacccggttaacggttaaacggttttaaccgtttacgtaaacctttaaaccgttttaacgtttaccgttaacgttaaaccgtaaacccgttaaggtttaaccgttttaaacgttaacgtttaccgttaccggtttaacccgttaaccgggttaccgggtaacggggtaaccggttaaccgggtaacgggtaccgtaacgtaaccgtaaccgtaaacgtcggtacggtcgtactaccgtaccgtacttagtccgttcgttactcccgtaccttcccgtacccgtatacggttccctaggtaccg

SEQ ID NO: 10546 - DNA, 899 bp, Homo sapiens
  misc_feature: GYAE6OF01BLPKT.38.6.A06.1.454.CMB.1.raw
  modified_base (123)..(123): a, c, t, g, unknown or other
  misc_feature (123)..(123): n is a, c, g, or t
  modified_base (832)..(832): a, c, t, g, unknown or other
  misc_feature (832)..(832): n is a, c, g, or t
tcagtcgatcacgtcacgaccggtgctcgatttagatctactgacgaggggaggatggagacgtgggtccccgctcagctccgtggggctcctgctgcctctcggcctcccgaggtgccagtntcgtcgccatccgtagttccgacctagttcctacctacttccctccgtgtccgtagactacgtcgtaggtacggacgactacggtactacctactacttctaccggttcgggccgggtactacggtacggacgggtactaagttacgtacgttaacgttttacgttacggacccggttagttaacaccggaaacggtaaaacccgaaaaaccgggtaacgggtaaccctacccggtaaacgtccgtttacaggttacttaccgtacgtccgtaccgtacccgtaccgtaccttacggtaccggtaacggggttaaccggttcccggtaccgtaacgttaccggtaacgttcggacggtacggtccgtaaggttacggtagtccgggtaagtacgtaagttaccttaccgacttaccgacctacgtaacgcgtaaccgtacacccgttcgaagaccgttacggtacgttaacgttaagtttaccgtaacgtacctttaaacggtttccttaagtaccgttaaacgtaacgtttacgttaactttaacgtacgtttacccgtacgtttaaccggttacgggtaaacggggtaccgtaacgggttaaccggtaacgttacgtaacggtttaacgaaccccggttaaggtaaccgtggttaacccgcgttaaccgaaacccgtttagtaccgttacccggttacgtttacccncccggttaaaccttacccccgttaacggtacccgtttaatacccggtaaaggtttccctaaacgggg

SEQ ID NO: 10547 - DNA, 850 bp, Homo sapiens
  misc_feature: GYAE6OF01CB2VS.38.6.A06.1.454.CMB.1.raw
  modified_base (154)..(154): a, c, t, g, unknown or other
  misc_feature (154)..(154): n is a, c, g, or t
  modified_base (443)..(443): a, c, t, g, unknown or other
  misc_feature (443)..(443): n is a, c, g, or t
tcagtcgatcacgtcacgaccggtgctcgatttagatctactgacagggaggatggagactgggtcaactggatggcacatctggctcccaggtgccagatgtgccatccagttgacccagtcctccatcctccctgtcctgcatctgtagganacagagtcaccatcctacgttcggccgggccagtcgacgggactattacggactagtttatttacggccttggtacgtcaacgaaccaaaaaaccgacggggaaacgcccccgtaagccttaccgtagacttactagtcgacctcgtacccttacctaccgtttagaccgtaaacgggttccgggtaccctagttaccggtaaacggttcgaacgggtccggacggtaggttacgggacttcgggtagggaacctaggttactttaccgtacttccgtacaacccgtancgtaacgcctacgggtccctggaactaccgtaccgttaaggtaaacgtttcttttaacggtaacctttaacgttttaacgttaccgtacgttaacccggtaaattaccggtttaaaccgttttaagttaaccggttttacgtttacccgttaaccgtttaaccggggttttaccgggggaaccggggtaaacgggtaaccccgggttaaagggttaccggaagttaaacccgtaaaccggtaaaaccgttacgttacgggtaccggtaccgttaacggacccttaaccgttacgttccgttaaaccggttcccttaaccttacccgtttaccccgttacccggacgttaccgttacggttaaacggtccgtttacggaaggtcccgttaaagggtcggtaaacgggg

SEQ ID NO: 10548 - DNA, 778 bp, Homo sapiens
  misc_feature: GYAE6OF01AXVVZ.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttgacccagtcctccatccctccctgtctgcagtctggtaggagacagagtcaccatccattcggccgggcagtcgaggctattagcgtagtttatttacggcctaggtactacaaggtaaccaaaaaaccgacggggaaaccgtaccccgtaagcctacctaggacttcgtacttgccttcgcccttcctaacgtttggaaccgtaaacgggttccgggtaccctaagtttaccgaaggtttccgacggccggtaacgtaggtacggtacgtacggtaccggggaaacttaggttaacttttacccacgtacccttaccgaaccgtacttaccggacgtacgacccgtacccgtggaccgtaaccgggtccttaaaggtaacgtttacgtttttacggaacccttaaacgttttagttaacccgtttacgtaccgtaaactacggttaactttaaacggttactttacgttccttacggttaccgtttacgggacggtaacgggtacgtaacggtacgtaacgtacgtaacctaaacggttacgtcgggtaccgttacgaccgtaccgtaacctgttcctacgtttccttacggtcccttacccgtcccgtacgttaccgttcgttacgtaacggttccaagttccggtacgtaggtacccgggg

SEQ ID NO: 10549 - DNA, 780 bp, Homo sapiens
  misc_feature: GYAE6OF01AZ739.38.6.A06.1.454.CMB.1.raw
tcagtcgatcacgtcacgaccggtgctcgatttagatctactgacagggaggatggacatggagggtccccgctcagctccgtggggctcctgctgctctggctcccgaggtcgccagatgtgccatccagttcgacctagtcctcctactccctcctgtctgctatcgtaggtaggagacaggactacacctactctaccgttcggccgggaccagtcgagggactagttagacgttagtttacgttacgtccgttaggtactacgaacgaaaccgaaaaaccggacgggaaaccgacccgtaagtaccgtctagtactcgtatcgtaccgtccgtccttaccgtacgtttacggaacggtaaccgggttccggtacctacgtaaccggtacggttacgacggtcggtacggtaggtacggtacggtcggacggtacgtacgtacttccgactccgtactaccacgtctacgacgtaccgccgtagacccgtacgtacgtaacggttaagtttactttacgtaacctttaacgttaacttacggtaacttacctaacttaacgtttaaacgtttacgttaacgtttacctaccggtttaaccggttacccgggttacgggtaaccggggtaacggtaacccggtaaggttaaccgaacgttaaacctaacggaaccgttaaggtcggtacgtaccgtaaccgacgtacccgttagttcgtttaccgacctttaccctaccgttacccgttacccggaccttacggtcgtaacggtaccg

SEQ ID NO: 10550 - DNA, 738 bp, Homo sapiens
  misc_feature: GYAE6OF01AGSAI.38.6.A06.1.454.CMB.1.raw
  modified_base (292)..(292): a, c, t, g, unknown or other
  misc_feature (292)..(292): n is a, c, g, or t
  modified_base (434)..(434): a, c, t, g, unknown or other
  misc_feature (434)..(434): n is a, c, g, or t
tcagtcgatcacgtcacgaccggtgctcgatttagatctactgacagggaggatggacatgagggtccccgctcagctcctggggctcctgctgctctggctcccaggtgccagatgtcgccatccagttacgacccagtctccactcctccctgtctgcatcgtgaggagacagactcacctatctacttcggaccgggccagtccgaagggctaattagctaagtttattacgccgtggtactacgaacgaacaaaaaccgaggtaaaccgcctaacgctacctgaactntatcgtacgtccgtacctacctacgtttacgaacggtaaggtcccggggtaccctaagtacggtacggttacgaaggtccgagtaaggttcggtactcggtacggggaactagttaccttacaccgttctaactaccctaancggtacgaccgtacgccgtcgtacgtacgaaccgttagttaaacgttacgttttaacacctttaaacgtttaacctacttacgttaaaccaaacgtaccgtttaaagttaaccttagttaacctcgtttaaccggtaccgttaaccggggacgggttaaaccgggtacccgtaaagggtaccgtaacgttaacgtaaaccgtaaacggtacggttcggtaacggtacgtaacccgtactaaaccgtcgttcgtcggtttaaccttccaacgtttcccctaacgtactcgttagtagtaacccgg

SEQ ID NO: 10551 - DNA, 745 bp, Homo sapiens
  misc_feature: GYAE6OF01CVELD.38.6.A06.1.454.CMB.1.raw
  modified_base (163)..(163): a, c, t, g, unknown or other
  misc_feature (163)..(163): n is a, c, g, or t
  modified_base (373)..(373): a, c, t, g, unknown or other
  misc_feature (373)..(373): n is a, c, g, or t
tcagtcgatcacgtcacgaccggtgctcgatttagatctactgacagggaggatggagactgggtccccgctcagctcctggggctcctgctgctctggctcccgaggtgccagtatgtcgccatcccagttcgacccagtcctccatccctcctgtctgacntctgtaggagacagagtacaccagtcagtcgccggcagtcgaggctagtagcgtagtttactacgccgtaggtactacgaagtaccgaaaaaccgtacgggtaaaccgccccgtaaaggtccttaccgtagtacttaacgtatcgtaccctcgtcccttaccgtacgttacgacgtaacggtcgggtaccacgttacgtaaggtttacgnggacgtacgtaggtacggtacgtaccggtaggtaacctagttacctttaccgaccgtaccttaccgaaccgtacgtacgtaaccggcctaacgtcccgtagtacccgacgtaaccgtttaggttaaacgtttacgttttaccgtaacgtttaaaccgtttacgtttaccggtacgttaaaacgtaacgtaccggtttaactttaagtttaccgttacttcccttacggttaccggttacgggacggtaaccggaaccggtagtaacgtacgactaaccgaagttccgttaggtcggtactaccggcctacgttagtccttagtttacctacctacgttacccgtcgtacctagttaaccggtgtaacgtacg

SEQ ID NO: 10552 - DNA, 664 bp, Homo sapiens
  misc_feature: GYAE6OF01AJXH2.38.6.A06.1.454.CMB.1.raw
  modified_base (254)..(254): a, c, t, g, unknown or other
  misc_feature (254)..(254): n is a, c, g, or t
tcagtcgatcacgtcacgaccggtgctcgatttagatctactgacagggagggatggagactgggtccccgctcagctcctggggctcctgctgctctggctcccaggtgccagatgtgccatccagttgacccagtctccatcctccctgtctgcatctgtaggagacagagtcaccatccacttggcccgggccagtcgagggcattagctagtttattagccgtggtatcacgaacaaaaccagggaaacncccctaagtctccgtagattctatcgctcgtcctcctactttcgacgtaacggtcgggtaccactcgtaacggtccgaggcggtacgaggtggtacgtcggtagggtaccaggtactttactaccgttctaccacctactacgacgaccgacggccctcgtacgaccgacccgtaggtaacgtttactttcggaacttacggttttactaccgtcgttaacccaactagttaacgttttaacttaagtttctaccgtttacttcggtttaccggggacgggtaacgggtaacccgtagggtaccgtaacggtaacttaaccgaaccttagtcggtcgtacgtcgactaccgttcttacgtacgttccctacgtcttcccgtacccgtcaccgtttcgacgtaccgttcgg

SEQ ID NO: 10553 - DNA, 751 bp, Homo sapiens
  misc_feature: GYAE6OF01A4MYX.38.6.A06.1.454.CMB.1.raw
  modified_base (502)..(502): a, c, t, g, unknown or other
  misc_feature (502)..(502): n is a, c, g, or t
  modified_base (723)..(723): a, c, t, g, unknown or other
  misc_feature (723)..(723): n is a, c, g, or t
tcagtcgatcacgtcacgaccggtgctcgatttagatctactgacagggaggatggagactgggtccccgctcagctcctggggctcctgctgctctggctcccaggtgccagatgtcgccatccagttcgacccagtcctccactccctccctgtctgctatctgtaggagacagacgtcacctatcctacttcggcccgggccagtacgagggtactagtttagcgttaagtttattacggtcccgttaggtactaccgaagaaaccgaaaaaaccgaacggggaaacctacccccttaaggtcccttaccgtaggaaccttacttacgtcgtacttccgtcccttaccctaacgtttacggaaccgtaaacgggttccggggtaccctagttaacccggtaaacggttcgaacggaccgggtactacgggtacggtaactacccggttacggtaacgtacgttacgtttcccaacgttccctaccgacctaagtccganccgtacgtccgcgaccgtacgtaccgtagtaagtttactttcgaacttaactttactacgtactacgtaaactcgttaactttaagtacgtttctaccttacgtaccgttcgggaacgggaccgtacgtaggtactacgtaacgtaacgtaacgttacgtggtacgtctaccgactaaccgtgtttacccggttacttaccgtactttcccggtaaccccncgttaaacctcggtttaccgaagtccgg

SEQ ID NO: 10554 - DNA, 821 bp, Homo sapiens
  misc_feature: GYAE6OF01BO28K.38.6.A06.1.454.CMB.1.raw
  modified_base (112)..(112): a, c, t, g, unknown or other
  misc_feature (112)..(112): n is a, c, g, or t
tcagtcgatcacgtcacgaccggtgctcgatttagatctactgacagggaggatggagactgggtccccgcgtcagctccgtgggctcctgctgctctcggctcccaggtcnccagatgtgccatccagttcgacccagtcctccactccctccgtgtctcgactatcgtaggtaggacgacagtacgtccacctatacgtacgttcgggcccgggcctaggtaccgagggctaattacgacttagtttattacgccgttaggtactacgaacgaaacgaaaaaccggacgggaaacctaccccgtaagtccttacgtagtaacttacgtaacgtccggtccttaccgtaccccttacctttaacggtttacgaaaccgggttaacggggttcccgggtaccctaaacggttaccggtaacgggttccgaacgggtccggtacggtacggttacggtacgttaccgggtacggtaaactttacggttacctttaccctaccgttaccccaacgtaccgtacgtacgaccgtacgacccgttcgacgtcgtaaccgttcgttaaggtaacgtttcttaacggaacttaacgtttctaacgtacgtactaaacgttacgtttaacttaataccgtttaacgccgttacggtttaccggtaacgggcgggtaacgtaaccgtagggtaaccgtaagtaacccgttaaacggacggttcgaggttccggacgtacctaacccgtacggttcttaccggtttgtaaaccccttcgtacccgtttaccccgacgttaccctaaggttacgttaacgtaacggtaccg

SEQ ID NO: 10555 - DNA, 772 bp, Homo sapiens
  misc_feature: GYAE6OF01ECUZB.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatccacgttcggccggtccacttcgagggctagttagctagtttacttagcctggtactacgagaaccaaaaccgagggaactcccgtaagctcctgatctagtgctcgcctctacgttcgacgtaacgggtccggtacctagtacgtaacggttcgacggtcgggacgtaggtcggtacgttcggtacggggactaacgttacgtttaccacccttacctaccgaaccctacgtacaacggtaccgaacgtccccgttaggacccgtacggtacccgttaaagggtaaacgttttacgttttaaccgtaaccgtttaaaacttttaacgtttaacccgttaggtaaacctaaacgttagttaaccgtttaaatttacgtttacttacccgttacgttacccgggtttacggggaacgggaaccggtacggtaacgggtcggtaaacgtaaccttaaccggtaaaccggtagttcggtacggtacccttacgaacccgttcggttaacttccgtttacgttaccctttaccgtaccttccccgttaccctcgtaacgttccgttaaccgtacggtacggttaccgtacgggtacggttgggaccggggg

SEQ ID NO: 10556 - DNA, 879 bp, Homo sapiens
  misc_feature: GYAE6OF01BDURV.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttcgacccagtctccatcctccctgtctgcgatcgtaggtaggacgacagagtccacatctacgttcggccgggccagtcgagggtctagttagacttagtttattacgccgttggtatcaacgaaccaaaaaccgaacggggaaccgtacccctaaggtccttaccgttagtacttacttacgttcgtccgtccgtcccttaccttacggttttacgtaaccggtaaacggggttccgggggttaccccaaggtacccgttaaagggttaccggacgggtccggtaggtaacggtggtacgttacgggtagggtaaacgtacggttactttaccgtaaccttaccgtaaccgttaaccctaacggtaaccgtaccggaaccttacccgggacccgtttacggaccgggttacctaacccggttaaaggttaaacggttttcccgggtttttaaacgtaaacccggttttaacccttttaaacgttacccgtaacggttaaccgtaaaaccggtttaacgtttaaaccgtttaaccgtttaacgttttaccttaccgggttacccggtttacggggttaccggggtacgggaaccgggttaaccgggtaacgtaacggtaacgttaacctaaacgggtaacgtacggtgggttaccagtaccacgtaccgtacgttcgttctaccgttacgtttccgacccccgttacgtaccccgtagtaacgtacggtaacgttcgggtaacctcgggtagtccggggaaccggg

SEQ ID NO: 10557 - DNA, 628 bp, Homo sapiens
  misc_feature: GYAE6OF01A45PA.38.6.A06.1.454.CMB.1.raw
  modified_base (271)..(271): a, c, t, g, unknown or other
  misc_feature (271)..(271): n is a, c, g, or t
  modified_base (369)..(369): a, c, t, g, unknown or other
  misc_feature (369)..(369): n is a, c, g, or t
  modified_base (440)..(440): a, c, t, g, unknown or other
  misc_feature (440)..(440): n is a, c, g, or t
  modified_base (461)..(461): a, c, t, g, unknown or other
  misc_feature (461)..(461): n is a, c, g, or t
tcagtcgatcacgtcacgaccggtgctcgatttagatctactgacagggaggatggagactgggtcaactggatggcacatctcgctcccaggtgccagatgtgccatccagttcgacccagtctccactcctccctgtctgcagtctagtaggagacagagtccactactcacgttcgccgggccagtcgacgggactagttacgactagtttagtttacgccgttggtatacaacgaaccgaaaaaccgagggaaacgaccccgtaacnctcctagtatctatgctcgtcctacctacttgacgtaaggtcggtccagtacgtaagtcaggccggtcaaggtgtacgtgtcggaagtactagttccncctccacacctatcgacctcgcgtcgataccgacgcgttaagtattattcgtaaccttaacttatccgtanactaactgttaacttaagttnttactccgttaataccggttcgacgggtaacagacgtaacagtaccacgtaacgtcttaggactagtccacgtacctgtcttacgtacctttcccacgtttaccctacgaaccgtttaccgcgtttaaccgtcgtacttaaagcccggtaacggttggtaaaccggg

SEQ ID NO: 10558 - DNA, 741 bp, Homo sapiens
  misc_feature: GYAE6OF01A78MD.38.6.A06.1.454.CMB.1.raw
  modified_base (699)..(699): a, c, t, g, unknown or other
  misc_feature (699)..(699): n is a, c, g, or t
tcagtcgatcacgtcacgaccggtgctcgatttagatctactgacagggaggatggagactcgggtccccgctcagctccgtggggctcctgctgctctggcctccaggtgccagatgtgccatccagttcgacccagtcctccactccctcccgtgtctgctatcgtaggtaggagacagacgtccaccactctacgttcggccgggacctagtcgagggtctaagttacgacttagtttactttacgccgttaggttaataccgaacgaaaaccgaaaaaccggacgggaaacctacccctaagtccttacgtaggtaactccgtatcgtacctccgtccttcctaacgttcggaacgtaaccggggttccggtaaccctagtaccggtaacggttccgacggtacggcgtaggtagtacgtcggtacggtaactagttaccttacaccgttccgactaccgtacgtacgacgtcgtacggtactacggacctacggtacgtaagtaacgtttacttacgtaacctttactttacgtaacgttacgtaaactaaacgttcgttaacgtttaagtttcctacgtttaccgttacgttacgggttaaccggggaggtaaaccggtaaccgggttagtaacgacgttaaagtaccgtaaacgtcgtgttacggctaacccgtactacgttcttgttaccncttaccgtacttccccgtacgtcttaacgtcgtaagcgtacg

SEQ ID NO: 10559 - DNA, 829 bp, Homo sapiens
  misc_feature: GYAE6OF01EZ9P2.38.6.A06.1.454.CMB.1.raw
tcagtcgatcacgtcacgaccggtgctcgatttagatctactgacagggaggatggagactgggtcaactggatggcacatctcggctcccaggtgccagatgtcgccatccagttcgacccagtctccactccctcctgtctgctatcgtggtagagacagagtaccacatctacgttcggcccggcctagtacgaggctagttacgactaagtttattacgaccgttagtactacgaacgaaaccgaaaaaccgagggaaacctacccgtaaacgtccgtaccttagaacttcgtaacgtcggtacctaccgtacccttacctaacgttacgaaccgtaacgggtccgggttacctaaggtacgtacggttacgacggtcggtacgtaggtaggacgttcgacggttaacgtaacgttcttaccgtaccgtccgtaacctaccgtacgtaccgtacgaccttacggtacgtccggtaccgacgttaccgttaaagttaacgtttaacgtttaaccgtaactttaaccgtttaactttacggtaacctaaccgttaaacgtaacgtttaaactttaacggttactttaccgttacccgggtttaaccgttaccgggtttaaccggggaccggttaaggaaacccggttaacgggttaagaaaccggtttaacccaacggtaaacggttccgtacggttacggtaccttaacgtacctacgtaactttccgttaccgttaccttaaccgttacccgtcccgttaacccgtacgtaccggttacgttaaccgtaacggttccaagtttcccggaacggtggtaaccgggg

SEQ ID NO: 10560 - DNA, 952 bp, Homo sapiens
  misc_feature: GYAE6OF01A2UFT.38.6.A06.1.454.CMB.1.raw
tcagtcgatcacgtcacgaccggtgctcgatttagatctactgacagggaggatggagactgggtccccgctcagctcctggggctcctgctgctctggcctcccaggtgccagatgtgccatccagttcgacccagtctccatcctcctgtctgcatctgtaggacacagagtcacactctacgttcggccgggacctacggtacgacgggactaacgtttaacgaccgtaagttttacgtttaacggtacccgttagggttaaattaccggaaaacggtaaaaccccgaaaaaaaccggtaacggggtaaaaacccggtaaccccccttaaaggtcccgttaacccgtttacggtaaacctttaccgttaacgtttccggtaccgttacccgggttaaccccttacccttaacggttttcggaaaccggtaaaacgggtttacccggggggttaaccccctaaaggtttaaccggttaaacggggtttccgaaccgggtacgggtaaccggttaacgggtttacggaacgggtttacgggttaaacgggggtaaacctttaaacgggttaacctttttaacccgaaccgttacccgtaaacccttaaccccgtaaagttacccgttaaaccggccgttaaacgggacccctttaaggacccgtaacggttaccgttaaggttaaccgtttaacgtttacgtaacgtttaaacttttactaacgtagttaaacctaacggttaacgttaacgtttaaagtacgtttacgttacctttaccgttaaccggggttacgggaacgggttaaccgggaaccttaacggggtaaccggtaagtaaccttaaccgggtaaaccgttcgtaagggttacgacgttacgacccctaggtaccttgttaacccttctttaccgtacctcccgtacctacttatcgtaaacggtctaacgg

SEQ ID NO: 10561 - DNA, 738 bp, Homo sapiens
  misc_feature: GYAE6OF01DMVSA.38.6.A06.1.454.CMB.1.raw
  modified_base (235)..(235): a, c, t, g, unknown or other
  misc_feature (235)..(235): n is a, c, g, or t
  modified_base (727)..(727): a, c, t, g, unknown or other
  misc_feature (727)..(727): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatcgtgtaggagacagagtcaccatcacttgccgggccagtcagggcattagctagttattacgcctggtatcagaccaaaaacgagggaaacnccctaagctcctagactctatcgactcgtaccctccgtacttacgaacgtaacggttcggggtccccaactaccggtaaacggtttcgacggcggtaccgtaggtcggtagttacgtacgggaactacgtaacttttcctaccgttccacctaacctacgtacaacgtcgacccgtaccgtgaccgtacgtaccgtaaggtaagtttacttttaacgtacgttaaacttttacttaaccgttacgttaacgaaaccgttaggttaaaccctttaaagtttaactttaccttaccgtaccgtttaaccgggttacggggtaacgggtaacccgggtaaccgaacgggttaccgaaggtaaactaaccggtaaaaccgtaggtacggtcgtactacgtacccgtacctaagttccgttacgtttcttacctaccttcccggttaccctcgtaacgttaccgtaacggttaccgttagccgttaacggttccggngggtaccgggg

SEQ ID NO: 10562 - DNA, 656 bp, Homo sapiens
  misc_feature: GYAE6OF01BGU52.38.6.A06.1.454.CMB.1.raw
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (418)..(418): a, c, t, g, unknown or other
  misc_feature (418)..(418): n is a, c, g, or t
  modified_base (424)..(424): a, c, t, g, unknown or other
  misc_feature (424)..(424): n is a, c, g, or t
  modified_base (556)..(556): a, c, t, g, unknown or other
  misc_feature (556)..(556): n is a, c, g, or t
tcagtcgatcacgtcacgaccggtgctcgatttagatctactgacagggaggatggagactgggtcaactggatggcacatctgctcccaggtgccagatgtgcatccagttgacccagtctccatccctcctgtctgcatctggtaggagacagtagtccaccagtcacttcggccggccagtcgagggctaagttagaccttaagttttattacggcccgtttaggtactacgaaaccgaaaaccgaaaaaccggtaaggaaacccgtacccgtaagtccgtccagtacttactaggtcctcacgtcccttactaccgttagaacgtaacggtcggtaccctagtacgtaacggtcacggcgtactagtagtacgtcgtaaggacagttctacctcnctaacagtacntcggaacnctcganacgtcgtacgtagttaactagttacaactatactagtagtactaacttactattaagttactactacgtacgtacggtacggtaacggtacgaacggtagtacgaagtaacgtaacgtacgtacgtgtaccnctaacagaccttgttacctacgttacctcgttaccgtcccgtaaccgttcgttacgaacggttacgttaccgtacttaacggacggttgtacggaccggg

SEQ ID NO: 10563 - DNA, 772 bp, Homo sapiens
  misc_feature: GYAE6OF01BAZPC.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttcgacccagtctccatcctccctgtctgctatcgtgtaggagacagacgtcaccatctacgttcggccggcagtcgagggtccagttagaccttagtttagtttacgccgttaggtacttaccgaacgaaccaaaaaccggacgggtaaaccgtcccccgtaaaggtcctacccttagaccttacgtagtaccgtccgtccgtaccccttaccgttaccgtttagggaaccgtaaacgggttccgggtaaccctacgttacggtaacggttcgacggacccggtagaggttacggattccggtaggacctaggtacttaccgtaaccgcctaacgtaccagttcgacgttaccgaccgttcgtacgacgtacgtaccgttaggtacttagttactacgttaactttagtacgtacgtaacttaacggactttaacgttaagttacttaccttacgtaccggtttacggtaccgggtacggtaaacggtaacgtaacggtagtaaccggtaagttaaccgaaacggtcgttacgtaccggtcgtaacccgtacctaacggtcctttaccggttacgtttacccttaccgttaaccggtttcccctacccgttacggttaacttcccgaaaggtttacccgtacggg

SEQ ID NO: 10564 - DNA, 721 bp, Homo sapiens
  misc_feature: GYAE6OF01DG07N.38.6.A06.1.454.CMB.1.raw
  modified_base (297)..(297): a, c, t, g, unknown or other
  misc_feature (297)..(297): n is a, c, g, or t
  modified_base (314)..(314): a, c, t, g, unknown or other
  misc_feature (314)..(314): n is a, c, g, or t
  modified_base (432)..(432): a, c, t, g, unknown or other
  misc_feature (432)..(432): n is a, c, g, or t
  modified_base (652)..(652): a, c, t, g, unknown or other
  misc_feature (652)..(652): n is a, c, g, or t
tcagtcgatcacgtcacgaccggtgctcgatttagatctactgacagggaggatggagactgggtccccgctcagctccgtggggctcctgctgctcgtggcctcccgaggtcgccaggatgtcgccatcgagttcgacccagtcctccactccctcccgtgtcgtgctacgtcgtaggtagagactagactacaccatccgtacgttcggcccgggacacggtcgaggtctagttacgcttaagttagttacgcgttaggtaacacgaacgaaaccgtaaaacggtaggaaacccnccgtaagtcctcgtaanacttcctaggtctacgccgttcctccttagttaccgagttaaccgggcggtacccttaggaccgtaaggtccgaaggccgacgtaaggtggactcgtacggaactacgttacttaccnccgtaccttacgacacggtaccaggtacctacggtcgtcggaaccttcggaacgtaagtagttacgtttacgaaccttacgttactacgtacgtaaccgtaagtacgttaacgttaacgttacgttaccttacttacggtacggttaaccggacggtaaccgggtaaccgtaacgggacgtacgaaacgtaccgaaacggtcgtacgtacgcgtaaccgntaacccgtgttacgtacttcgtaaccgttcctacccggttaccacttaagtccgtaacggtgttaccgg

SEQ ID NO: 10565 - DNA, 820 bp, Homo sapiens
  misc_feature: GYAE6OF01D06MA.38.6.A06.1.454.CMB.1.raw
  modified_base (229)..(229): a, c, t, g, unknown or other
  misc_feature (229)..(229): n is a, c, g, or t
  modified_base (236)..(236): a, c, t, g, unknown or other
  misc_feature (236)..(236): n is a, c, g, or t
  modified_base (709)..(709): a, c, t, g, unknown or other
  misc_feature (709)..(709): n is a, c, g, or t
tcagtcgatcacgtcacgaccggtgctcgatttagatctactgacagggaggatggagactgggtcaactggatggcacatctggctcccaggtgccagatgtgccatccagttgacccagtcctccactcctcctgtctgcatctgtaggagacagagtcaccatcacttggccggcagtcagggctattagctagtttattagcctggtactcaagaacaaaaccgngggaacnccctagctctagatctatcgtactcgtcccttacctactttacggacgtaaacggttccggggtacccaagttacgtaacggtttccgaggtaccgggacgtacggtacgggtacgttccggtaggggtaacctaggttaaccttttccgtaaccttacccgtacctaacccgtaacgtcccgtaacggacccgtaacggtccccgtacggttaacccgaccggttacccggtttaaaggtaaaacggttttacgtttttaaccgaaccgttttaaaccttttaacggtttacccttaaccggtaaccgttaaacgttaacccgtttaacgttttaaacggtttaacgtttacctttacccggttaccggttttaaacccggttaccgggggaccgggtaaacgggttaccggtaacgggtaacgtaacgtaaccgtaaaccgtaacggttaacgttgggtaacgtcgtaacnccgtaacctagttccgtacgttaccttccgtaaccgtttaccccgttcccgacgttaccttacgggtaacgttaaccgggtcttaccggacgttcggtaacgggtacgggg

SEQ ID NO: 10566 - DNA, 500 bp, Homo sapiens
  misc_feature: GYAE6OF02HTTFR.38.6.A06.1.454.CMB.1.raw
  modified_base (321)..(321): a, c, t, g, unknown or other
  misc_feature (321)..(321): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatccctccctgtctgcatctgtaggagacagagtcaccatcacttgccgggccagtcagggcattagcagttatttagcctggtatcagacaaaaaaccagggaaagcccctaagctcctgatctatgctgcctccactttgcaaagtggggtcccatcaaggttcagcggcagtggatcngggacagatttcactctcaccatcagcagcctgcagcctgaagattttgctaacttattactgtacaacagtacttaaattagttatcttcactttcgggcggtagggaccaaggtcgaagatacaaacgaactgtgctgcacatctgtcttcattccttcccgcctatctgtacgtcg

SEQ ID NO: 10567 - DNA, 490 bp, Homo sapiens
  misc_feature: GYAE6OF02F67WV.38.6.A06.1.454.CMB.1.raw
  modified_base (243)..(243): a, c, t, g, unknown or other
  misc_feature (243)..(243): n is a, c, g, or t
  modified_base (456)..(456): a, c, t, g, unknown or other
  misc_feature (456)..(456): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccagggaaancccctaagctcctgatctatgctgcctcactttgcaaagtgggtcccatcaaggttcagcggcagtggatctgggacagattcactctcacatcagcagcctgcagcctgaagtattttgactaactttattactgtacaactagtactttaatagttatctactactttcggcggtaggaccaaggtcagatacaaacgatgtgctgacacntctgtcttcactcttcccgcctatctagacgtcg

SEQ ID NO: 10568 - DNA, 483 bp, Homo sapiens
  misc_feature: GYAE6OF02F4IPL.38.6.A06.1.454.CMB.1.raw
  modified_base (237)..(237): a, c, t, g, unknown or other
  misc_feature (237)..(237): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctccactttgcaaagtgggtcccatcaaggttcagcggcagtggatctgggacagatttcactctcaccatcagcagcctgcagcctgaagattttgctaacttattactgtcaacagcttaaatagttatctcactttcggcggtagggaccaaggtcgagatacaaacgaactgtggctgcaccatctgtcttcatctccgccatctgactg

SEQ ID NO: 10569 - DNA, 486 bp, Homo sapiens
  misc_feature: GYAE6OF02ITJTO.38.6.A06.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccngggaaancccctaagctcctgatctatgctgcctccactttgcaagtgggtccatcaaggttcagcggcagtggatcgtgggacagtattcactctcaccatcagcagcctgcagcctgagtatttgactaacttattactgtacaacagtacttaatagttatctctactttcggcggagggaccaggtcgagatacaaacgtactgtgctgacaccatctgtcttcattcctccgccatctcgactcg

SEQ ID NO: 10570 - DNA, 488 bp, Homo sapiens
  misc_feature: GYAE6OF02GH4EQ.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccagggaaagcccctaagctcctgatctatgctgcctcactttgcaaagtgggtcccatcaaggttcagcggcagtggatctgggacagatttcactctcaccatcagcagcctgcagcctgaagtattttgactaacttattactgtacaacagacttaaatagttatcttctactttcggcggagggaccaaggtcgagatacaaacgaactgtgctgcaccatctgtcttcatcttcccgccatctgacgtg

SEQ ID NO: 10571 - DNA, 505 bp, Homo sapiens
  misc_feature: GYAE6OF02G9BV5.38.6.A06.1.454.CMB.1.raw
  modified_base (459)..(459): a, c, t, g, unknown or other
  misc_feature (459)..(459): n is a, c, g, or t
tcagtcgatcacgtcacgaccggtgctcgatttagatctactgacagggaggatggagactgggtcaactggatggcacatctggctcccaggtgccagatgtgccatccagttgaacccagtctccatcctccctgtctgcatctgtaggagacagagtcaccatcacttgccggcagtcagggcattagcagttatttagcctggtatcagacaaaaaccagggaaacgcccctaagctcctgatctatgtctgcctccactttgcaaagtgggtcccatcaaggttcagcggcagtggatcgtgggacagtatttcactctcaccatcagcagcctgcagcctgaatattttcgactaacttattactgtacaacgagtacttaatagttatcttactactttcggcggacgggaccaaggtcgagatacaaacgactgtgctgacaccgatcgtntctctactccttcccgctactctagaacgtgactcgtactgtacgg

SEQ ID NO: 10572 - DNA, 545 bp, Homo sapiens
  misc_feature: GYAE6OF02FMQQ8.38.6.A06.1.454.CMB.1.raw
  modified_base (249)..(249): a, c, t, g, unknown or other
  misc_feature (249)..(249): n is a, c, g, or t
  modified_base (258)..(258): a, c, t, g, unknown or other
  misc_feature (258)..(258): n is a, c, g, or t
tcagtcgatcacgtcacgaccggtgctcgatttagatctactgacaggggaggatggacgactgggtccccgctcagctcctggggctcctgctgctctggctcccaggtgccagatgtgccattccgagttgacccagtcttccatcctccctgttctgcatctgtaggagacagagtcaccatcacggttgccgggccagtcaggggcattagcagtttattagcctggtatcgagacaaaaaccgnggggaaacncccctaagctacctggatctatgctgccctcactttgcaagtggggtcccatcaaggttcaggcgctagtggatctgggacagtattcactctcaccatccagcagccctgccagcctgaagattttgactaactttattaactgtacaacagtacttaatagtttactacttctacgtttcggcggtagggacctaaggtcgaagactcaaacgtacttagtggactagacgtacgtatctgtccttacgacttccttcccgtacctacttcctacgtacgtacgg

SEQ ID NO: 10573 - DNA, 501 bp, Homo sapiens
  misc_feature: GYAE6OF02JGK92.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtgggtcccatcaaggttcagcggcagtggatctgggacagattttcactctcaccatcagcagccctgcagcctagaagtattttgctaaactttattactgtacaactagactttaatagttatctctactttcgggcggtaggaccaaggtcgagatcaaacgaactgtggctgctaccatctgtcttacattccttcccgccattctgtaacg

SEQ ID NO: 10574 - DNA, 487 bp, Homo sapiens
  misc_feature: GYAE6OF02IS4KN.38.6.A06.1.454.CMB.1.raw
  modified_base (236)..(236): a, c, t, g, unknown or other
  misc_feature (236)..(236): n is a, c, g, or t
  modified_base (454)..(454): a, c, t, g, unknown or other
  misc_feature (454)..(454): n is a, c, g, or t
tcagtcgatcacgtcacgaccggtgctcgatttagatctactgacagggaggatggagactgggtcccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctccactttgcaaagtgggtccatcaaggttcagcggcagtgatctgggacagatttcactctacaccatcagcagcctgcagcctgaatattttgctaacttattaactgtacaactagcttaatagttatctctaactttcggcgtaggaccaaggtcgagatacaaacgatgtgctgcacctntactgtcttcgatccttccgctatctgaactcg

SEQ ID NO: 10575 - DNA, 502 bp, Homo sapiens
  misc_feature: GYAE6OF02IB5J4.38.6.A06.1.454.CMB.1.raw
  modified_base (470)..(470): a, c, t, g, unknown or other
  misc_feature (470)..(470): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtggggtcccatcaaggttcagcggcagtggatctgggacagattcactctcacatcagcagcctgcagcctagaagtattttgctaaactttattactgtacaactagactttaaatagtttatcttctacttttcggacgggtagggaccgaaggtcgaagatacaaacgactgtggctgccacntctgtcttcatccttccgcctatctagacgtg

SEQ ID NO: 10576 - DNA, 513 bp, Homo sapiens
  misc_feature: GYAE6OF02I1N6X.38.6.A06.1.454.CMB.1.raw
tcagtcgatcacgtcacgaccggtgctcgatttagatctactgacagggaggatggagactggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtggggtcccatcaaggttcagcggcagtggatcgtgggacagatttcactctcaccatcagcagcctgcagcctagaagtattttgctaactttattactgtacaacagtactttaatagttatctactacgtttcggcggagggaccaagggtcgaagtatacaaacgtactgtggctgacacatctgtcttcattccttccgcctatctagacgttgacgtcgactggacgtcgggcctggaccgaaggccgacgtacgtagc

SEQ ID NO: 10577 - DNA, 486 bp, Homo sapiens
  misc_feature: GYAE6OF02H2DXM.38.6.A06.1.454.CMB.1.raw
  modified_base (236)..(236): a, c, t, g, unknown or other
  misc_feature (236)..(236): n is a, c, g, or t
tcagtcgatcacgtcacgaccggtgctcgatttagatctactgacagggaggatggagactgggtcccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccnggaaagcccctaagctcctgatctatgctgcctcactttgcaaagtggggtccatcaaggttcagcgcagtggatctgggacagatttcactctcaccatcagcagcctgcagcctgaagtattttgcaacttattactgtcaacagcttaatagttatcttcactttcggcggaagggaccaaggtcgaagatacaaacgaactgtagctagcaccatcttgtcttcatcttcccgccatctgacgtcg

SEQ ID NO: 10578 - DNA, 500 bp, Homo sapiens
  misc_feature: GYAE6OF02ILYXH.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaaggtggggtcccatcaaggttcagcggcagtggatcgtgggacagatttcactctcaccatcagcagcctgcagcctgaagtattttgactaactttattactgtacaacagtactttaatagttatctctacgtttcggcggagggaccaaggtcgagatacaaacgaactgtggctgcacatctgtcttcacttccttcccgcctatctagtacg

SEQ ID NO: 10579 - DNA, 676 bp, Homo sapiens
  misc_feature: GYAE6OF02HUPTM.38.6.A06.1.454.CMB.1.raw
  modified_base (170)..(170): a, c, t, g, unknown or other
  misc_feature (170)..(170): n is a, c, g, or t
  modified_base (179)..(179): a, c, t, g, unknown or other
  misc_feature (179)..(179): n is a, c, g, or t
  modified_base (183)..(183): a, c, t, g, unknown or other
  misc_feature (183)..(183): n is a, c, g, or t
  modified_base (223)..(223): a, c, t, g, unknown or other
  misc_feature (223)..(223): n is a, c, g, or t
  modified_base (253)..(253): a, c, t, g, unknown or other
  misc_feature (253)..(253): n is a, c, g, or t
  modified_base (261)..(261): a, c, t, g, unknown or other
  misc_feature (261)..(261): n is a, c, g, or t
  modified_base (271)..(271): a, c, t, g, unknown or other
  misc_feature (271)..(271): n is a, c, g, or t
  modified_base (345)..(345): a, c, t, g, unknown or other
  misc_feature (345)..(345): n is a, c, g, or t
tcagtcgatcacgtcacgaccggtgctcgatttagatctactgacaggggaggatggacagtgacgggtcccgcctcgagtctccgtgggtctccttgctgctcgtggctccaggtgccagatgtcgccagtcctaggttgacccagtctccattcctcctgtctgtacntctgtaggngacngatcacgatcacttggccggctaggtcagggcaggttacngtagttattgcctggtatcagacaaaaacngggaaacnccctaagtcnctgtactctatggcttggccctccactttgacgtaaagggtcggggtccctagtactaagggttcaggaccgtntaaggtgtaatcgtacgggaaccagtaatttccgaactcctacaaccgtatcgaacggccagtcccagcctacgtcctagtaaacggtaacttttacgacctaaacgtttaactaacgtacgttacgtaactagtaacctttaaatacgttaactactacgtaccgtttacgggacggtaacgggacccgtaaagggtaccgaacgtaacttaacgtaaaacggtaaccgttgggtagtaccgttaaggtaccgtaacctagttaccgttaggtttaccttacttacgttacccgttacccggtaccgtacgttacggtaacggtaaccgg

SEQ ID NO: 10580 - DNA, 546 bp, Homo sapiens
  misc_feature: GYAE6OF02GX01C.38.6.A06.1.454.CMB.1.raw
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
tcagtcgatcacgtcacgaccggtgctcgatttagatctactgacagggaggatggaccatgagggtccccgctcagctcctggggctcctgcctgctctggctcccgaggtgccagatgtgccatccagttgacccagtctccatcctccctgtctgccatctgtaggagacagagtcaccatcacgttgccgggccagtcagggcattagcagttattagcctggtatcagacaaaaaccngggaaacncccctaagctacctagatactatgctgcctcctactttgactaaaggtcgggtcccagtcaaggttcagcggcaggtggatcgtgggacagtatttcactctcacctatcagcacgtcctgacagtcctagtaagtattttcgactaacttattactgtactaactagtacttaatacgttatctactacgtttacggacggtaacggtaccgtaaggtcgaagtactacgaaacgtactgtacgctgactactattctgttcttcacttccgtacccgctacttcgtagtaacg

SEQ ID NO: 10581 - DNA, 606 bp, Homo sapiens
  misc_feature: GYAE6OF02JFSSF.38.6.A06.1.454.CMB.1.raw
tcagtcgatcacgtcacgaccggtgctcgatttagatctactgacagggaggagtcggacatgagggtcccgctcagctcctgggctcctgcgtcgcgtctggcgtcccaggtgccagatgtgccgatccagttgacccagtctccgatcctcctgtctgcatcgtgtaggagacagagtcaccactcacttgccgggctagtcagggacattagcacgttattaggccttggtatcagtaccaaaaaccagggaaacgcccctaaggccttccgtgaacttccgtatcgtcctcggcccttacctacttttgacgtaaaacggttcggggtacccagtcgaaaggttcaaggcggcaaggttgatcgtggactagatttcactctcacatcagtcagtcctgcgagcctagaacgtacttttcgactaacttattactagtacaacgacgtacttaactagttactcttacctaccgtttcggcggtaacggaccgtaagggtcgaagtacgtaaccgaaacggtacgtgggtacgtacgttcgaccgtaacctattcgtgttccttacgtacttccgttccccgactacgttcgtacgtaacgg

SEQ ID NO: 10582 - DNA, 550 bp, Homo sapiens
  misc_feature: GYAE6OF02I6WXJ.38.6.A06.1.454.CMB.1.raw
  modified_base (305)..(305): a, c, t, g, unknown or other
  misc_feature (305)..(305): n is a, c, g, or t
tcagtcgatcacgtcacgaccggtgctcgatttagatctactgacagggaggatggacatgagggtcccgctcagctcctgggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaccaggaagcccctaagctcctgatctatgctgcctccactttgcaaagtcgggtcccatcgaagttcagcggangtggatcgtggacagatttcactctcacatcagcagcctgcagcctagaagtattttcgctaacgttattactgtacaacagtacttaaattagttaattctactaccgtttcggcggtaacgggtacaaaggtcgaagaacttaaccgaaacggtaactcggttagccttaggacctaaccgtacttcgttacgtcgttacctaacgttccgttaccccgtacctagtttcctagttaacccgg

SEQ ID NO: 10583 - DNA, 495 bp, Homo sapiens
  misc_feature: GYAE6OF02GW4Z5.38.6.A06.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
  modified_base (323)..(323): a, c, t, g, unknown or other
  misc_feature (323)..(323): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccngggaaancccctaagctcctgatctatgctgcctccactttgcaaagtcgggtcccatcaaggttcagcgcagtgatctgggacagnttcactctcaccatcagcagcctgcagcctgaagtattttgactaacttattactgtacaacagtacttaatagttatctctactttcggacggtacggacctaaggtcgagaatacgaaacgtactgtgactgacacatctgtcttcacttcttccgctatctagacgtcg

SEQ ID NO: 10584 - DNA, 519 bp, Homo sapiens
  misc_feature: GYAE6OF02G5LPO.38.6.A06.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
  modified_base (352)..(352): a, c, t, g, unknown or other
  misc_feature (352)..(352): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaancccctaagctcctgatctatgctgcctcactttgcaaagtggggtcccatcaaggttcagcggcagtggatcgtgggacagatttcactctacaccatcagccagcctgcagcctagaagtnttttgactaacttattactgttacaaactagtactttaaatagtttatctctacgtttcggcggtagggaccaaggtcgaagtactacgaaacgtaacgtggtcgctgaccacctatctcgttcttcaacttccttccgcctatctagacgtgtatcgtactgacgg

SEQ ID NO: 10585 - DNA, 504 bp, Homo sapiens
  misc_feature: GYAE6OF02F0YSM.38.6.A06.1.454.CMB.1.raw
  modified_base (238)..(238): a, c, t, g, unknown or other
  misc_feature (238)..(238): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgngggaaagcccctaagctcctgatctatgctgcctccactttgcaaagtggggtcccatcaaggttcagcggcagtggatctgggacagattcactctcaccatcagcagcctgcagcctgaagtattttgctaacttattactgtcaacagtacttaatagttatctctactttcgggacggtagggaccaaggtcgaagatacaaacgactgtgctgacactatctagtccttctacttccttcccgtcctatcctagacgtacg

SEQ ID NO: 10586 - DNA, 538 bp, Homo sapiens
  misc_feature: GYAE6OF02IWXYN.38.6.A06.1.454.CMB.1.raw
  modified_base (244)..(244): a, c, t, g, unknown or other
  misc_feature (244)..(244): n is a, c, g, or t
  modified_base (494)..(494): a, c, t, g, unknown or other
  misc_feature (494)..(494): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccagggaaancccctaagctcctgatctatgctgcctcctactttgactaaaggtcggggtcccagtcgaaggttcaggcggctaggtggatcgtagggactagtattcactctacacatcagcacgcctgcagcctagaagttatttacgactaactttattactagtactaacagtacttaatagttactctactacgtttcgggacggaggtacctaaggtacgagactacgaaacgacgtgtcgtctgaccacgtnttctgttcttactacttccttcccgacctagtctacgtacgtcg

SEQ ID NO: 10587 - DNA, 478 bp, Homo sapiens
  misc_feature: GYAE6OF02JCKO9.38.6.A06.1.454.CMB.1.raw
  modified_base (201)..(201): a, c, t, g, unknown or other
  misc_feature (201)..(201): n is a, c, g, or t
  modified_base (327)..(327): a, c, t, g, unknown or other
  misc_feature (327)..(327): n is a, c, g, or t
  modified_base (478)..(478): a, c, t, g, unknown or other
  misc_feature (478)..(478): n is a, c, g, or t
tcagtcgatcacgtcacgaccggtgctcgatttagatctactgacagggaggatggagactggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctccactttgcaaagtgggtcccatcaaggttcagcggcagtggatcgtgggacagatttcactctcaccatcagcagcctgcagcctgaagtnttttgctaactttatactgtacaacagtctttaatagttatctctactttcggcggaggaccaaggtcgagatacaaacgactgtgctgcacatctgtctcattcctccgcatctgactgatcgactgacgcggctggcgaaggcgcatgn

SEQ ID NO: 10588 - DNA, 484 bp, Homo sapiens
  misc_feature: GYAE6OF02GCCRV.38.6.A06.1.454.CMB.1.raw
  modified_base (478)..(478): a, c, t, g, unknown or other
  misc_feature (478)..(478): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgcctccactttgcaaagtggggtcccatcaaggttcagcggcagtggatctgggacagatttcactctcaccatcagcagcctgcagcctgaagattttgctaacttattactgtcaacagtcttaatagttatctcactttcggcggaggaccaaggtcgagatcaaacgaactgtggctgcaccatctgtcttcatcttcccgcatcngtaacg

SEQ ID NO: 10589 - DNA, 474 bp, Homo sapiens
  misc_feature: GYAE6OF02FHOYM.38.6.A06.1.454.CMB.1.raw
  modified_base (344)..(344): a, c, t, g, unknown or other
  misc_feature (344)..(344): n is a, c, g, or t
  modified_base (427)..(427): a, c, t, g, unknown or other
  misc_feature (427)..(427): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaagcccctaagctcctgatctatgctgcctccactttgcaaagtgggtcccatcaaggttcagcgcagtggatctgggacagatttcactctcacatcagcagcctgcagcctgaagnttttgcaacttatactgtcaacagcttaatagtatctctactttcggcggaggaccaggtcgagatacaaacgaactgtcggntgcaccatctgtcttcatctcccgcatctgacgtgatcgactgacgg

SEQ ID NO: 10590 - DNA, 500 bp, Homo sapiens
  misc_feature: GYAE6OF02I9BZ7.38.6.A06.1.454.CMB.1.raw
  modified_base (364)..(364): a, c, t, g, unknown or other
  misc_feature (364)..(364): n is a, c, g, or t
  modified_base (392)..(392): a, c, t, g, unknown or other
  misc_feature (392)..(392): n is a, c, g, or t
  modified_base (439)..(439): a, c, t, g, unknown or other
  misc_feature (439)..(439): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccagggaaagcccctaagcctcctgatctatgctgcctcactttgcaaagtgggtcccatcaaggttcagcgcagtggatcgtgggacagatttcactctacacatcagcagcctgcagcctagaagtnttttgactaactttattactgtacaacngtacttaatagtttatctctacttcggacggacggaccgaagtcganatacaaacgactgagctgacacattctgtctttacacttccttcccgctactcgtagtacg

SEQ ID NO: 10591 - DNA, 556 bp, Homo sapiens
  misc_feature: GYAE6OF02I6XYI.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccgagggaaacgcccctaaagctcctgatctatgctgcctccactttgcaaagtcgggtcccagtcaaggttcagcggcagtggatcgtgggacagacttcactctcacctatcagcagcctgcagtcctagaacgtattttgactaaactttacttactgtaccaacgtagtactttaaattagttacttccttactacgtttcgggacggtagggtaaccgtaggtacgagtataccgaaacgtacgtgtacgactcgacctaccgtattccttcgttcttacctacgttcctcccgtacctacttcgtacgtacgtcg

SEQ ID NO: 10592 - DNA, 522 bp, Homo sapiens
  misc_feature: GYAE6OF02IK6F5.38.6.A06.1.454.CMB.1.raw
tcagtcgatcacgtcacgaccggtgctcgatttagatctactgacaggggaggatggacatgaggggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccgagggaaagcccctaagcctcctgatctatgctgcctccactttgcaaaggtggggtcccatcaaggttcagcggcagtggatcgtgggacagatttcactctcacatcagcagcctgcagcctgaagtattttgactaactttattactgtacaactagtctttaaatacgtttatcctctacgtttcgggcggaacgggaccaagggtcgaagtactacgaaacgtaactgtggctgactacatcgtgtcttctacttccttcccgcctatctagtaacg

SEQ ID NO: 10593 - DNA, 520 bp, Homo sapiens
  misc_feature: GYAE6OF02FO8PP.38.6.A06.1.454.CMB.1.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccaggggaaacncccctaagctcctgatctatgctgcctccactttgcaaaggtgggtcccatcaaggttcagcggcagtgatcgtgggacagatttcactctcaccatcagcagcctgccagcctagaagtattttgctaacttattactgtacaacagtactttaatagttatctctacgtttcggacggtaggaccgaaggtcgaagtactacgaaacgactgtagtctgacaccgtatctcgtccttcgtacttccttcccgtacctatcgtagtacgtacg

SEQ ID NO: 10594 - DNA, 495 bp, Homo sapiens
  misc_feature: GYAE6OF02HH2LN.38.6.A06.1.454.CMB.1.raw
  modified_base (211)..(211): a, c, t, g, unknown or other
  misc_feature (211)..(211): n is a, c, g, or t
  modified_base (325)..(325): a, c, t, g, unknown or other
  misc_feature (325)..(325): n is a, c, g, or t
  modified_base (494)..(495): a, c, t, g, unknown or other
  misc_feature (494)..(495): n is a, c, g, or t
tcagtcgatcacgtcacgaccggtgctcgatttagatctactgacagggaggatggagactggctcccaggtgccagatgtgccatccagttgacccagtctccatcctccctgtctgcatctgtaggagacagagtcaccatcacttgccgggccagtcagggcattagcagttatttagcctggtatcagacaaaaaaccgagggaaancccctaagctcctgatctattctgcctcatttgcaaagtgggtccatcaagttcagcggcagtggatcgtgggacagatttcactctcaccatcagcagcctgcagcctgaatntttgactaaacttattactgtacaaacagtactttaaatacgtttatctactacgtttcggacggaagggtaccaaggtcgagtatacaaacgtactgtgctgacacatctgtcttcacttcctccgcatctagacgtgatcgactgagcggctggcgaaggcacatgnn

SEQ ID NO: 10595 - DNA, 507 bp, Homo sapiens
  misc_feature: GYAE6OF02IIKC4.38.6.A06.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggcagtcagggcattagcagttatttagcctggtatcagacaaaaaccngggaaancccctaaagctcctgatctatgctgcctccactttgacaaagtgggtcccatcaaggttcagcggcaggtggatcgtgggacagtatttcactctcaccatcagcagcctgcagcctagaagtattttgactaactttattactgtacaaacagtactttaaatagttactctactacgtttcggacggagggacctaagggtcgaagatacaaacgtactgtgctgcacatctgtcttcactcctcccgctatctagacgtgatcgactgagcggg

SEQ ID NO: 10596 - DNA, 520 bp, Homo sapiens
  misc_feature: GYAE6OF02GOBYH.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaaccagggaaagcccctaaagctcctgatctatgctgcctccactttgcaaagtgggtcccatcaaggttcagcggcagtggatctgggacagatttcactctcaccatcagcagcctgcagcctgaagtattttgactaacttattactgtacaacagtacttaatagttatctctactttcgggacggtagggaaccgtaaggtcgaagtaactacgaaaacgtaactggtcggactgacaccatctgttccttacattccttacccgcctactctagaacgtcg

SEQ ID NO: 10597 - DNA, 588 bp, Homo sapiens
  misc_feature: GYAE6OF02GNVSH.38.6.A06.1.454.CMB.1.raw
  modified_base (248)..(248): a, c, t, g, unknown or other
  misc_feature (248)..(248): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaaccgagggaaacncccctaagcctcctgatctatgctcgccctcctactttgactaaaggtcgggtacccatcgaaggttcaggcggcaggtgatcgtgggacagtatttcacttctacacatcagcacgcctgcagcctagtaagtattttacgacttaacttattactagtacaactagttacttaattagttactcttactacgttcggacgggtaacgggaccgtaagggtacgaagtaacgtaaccgtaaacgtaacgtcggtacggtacgtcgaccgtaacctattccgtcgttacctttactaccgtttcccgttaccccgaccttacgttaccgtaggtaaccgg

SEQ ID NO: 10598 - DNA, 524 bp, Homo sapiens
  misc_feature: GYAE6OF02HEV8L.38.6.A06.1.454.CMB.1.raw
  modified_base (223)..(223): a, c, t, g, unknown or other
  misc_feature (223)..(223): n is a, c, g, or t
  modified_base (230)..(230): a, c, t, g, unknown or other
  misc_feature (230)..(230): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttatttagcctggtatcagcaaaaaccngggaaancccctaagctcctgatctatgctgcctccactttgcaaagtggggtccccatcaaggttcagcggcagtggatctgggacagatttcactctcaccatcagcagcctgcagcctgaagtattttgctaacttattactgtcaactagtacttaattagttatctactacgtttcgggacggtacgggacctaaggtcgagactacaaacgtactggtacggctcgcacctatctgttccttctacgttccttcccgcctatcctagtaacgttcgactcggactgaggtccggg

SEQ ID NO: 10599 - DNA, 532 bp, Homo sapiens
  misc_feature: GYAE6OF02F6X9K.38.6.A06.1.454.CMB.1.raw
  modified_base (238)..(238): a, c, t, g, unknown or other
  misc_feature (238)..(238): n is a, c, g, or t
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgngggaaacncccctaagctcctgatctatgctgcctccactttgcaaagtcgggtccatcaaggtcagcggcagtggatcgtgggacagtatttcactctcacctatcagcagcctgcagcctgaagtattttgactaacttattactgtacaacagtactttaaatagttactcttactacgtttcgggacggtagggtaaccgaggtacgagtactacgaaacgtacgtaggtacgctacgacacctatcttcgtcttactacgttccttcccgacctacgtctgtacgtacg

SEQ ID NO: 10600 - DNA, 508 bp, Homo sapiens
  misc_feature: GYAE6OF02JF27Z.38.6.A06.1.454.CMB.1.raw
  modified_base (223)..(223): a, c, t, g, unknown or other
  misc_feature (223)..(223): n is a, c, g, or t
  modified_base (470)..(470): a, c, t, g, unknown or other
  misc_feature (470)..(470): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaagcccctaagctcctgatctatgctgcctccactttgcaaagtgggtcccatcaaggttcagcggcagtggatcgtgggacagtatttcactctcaccatcagcagcctgcagcctgaagtattttgactaacttattactgtacaacagtacttaatagttatcttctacgtttcggacggtagggaccaggtcgaagtataccaaacgacttggtcggctcgacacctatcttgtcttcncttccttcccgcctatctagacgtgactcgagtgacgg

SEQ ID NO: 10601 - DNA, 554 bp, Homo sapiens
  misc_feature: GYAE6OF02GQ834.38.6.A06.1.454.CMB.1.raw
  modified_base (239)..(239): a, c, t, g, unknown or other
  misc_feature (239)..(239): n is a, c, g, or t
  modified_base (319)..(319): a, c, t, g, unknown or other
  misc_feature (319)..(319): n is a, c, g, or t
  modified_base (362)..(362): a, c, t, g, unknown or other
  misc_feature (362)..(362): n is a, c, g, or t
tcagtcgatcacgtcacgaccggtgctcgatttagatctactgacagggaggatggagactgggtccccgctcagcgtcctggggctcctgctcgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccngggaaacgcccctaagctcctgatctatgctgcctccactttgctaaagtgggtcccatcaaggttcagcgcagtgatcnggacagattcactctcaccatcagcagcctgcagcctgaagtntttgactaacttattactgttacaaactagtactttaaatagttatccttactaaccgttttcgggacggtaagggtacccaagggtccgaagtactacgtaaaacgaactggtcggacttaggacaacccgtataccttcgttacctttaccgacttcccgttacccgcctaacgtcttacggaacgttcg

SEQ ID NO: 10602 - DNA, 552 bp, Homo sapiens
  misc_feature: GYAE6OF02HRICO.38.6.A06.1.454.CMB.1.raw
  modified_base (239)..(239): a, c, t, g, unknown or other
  misc_feature (239)..(239): n is a, c, g, or t
  modified_base (247)..(247): a, c, t, g, unknown or other
  misc_feature (247)..(247): n is a, c, g, or t
tcagtcgatcacgtcacgaccggtgctcgatttagatctactgacagggaggatggacatgagggtcccgctcagctcctggggctcctgctgctctggctcccaggtgccagatgtgccatccagttgacccagtctccatcctccctgtctgcatctgtacggagactagagtcgaccatcacttcgccggccagtcagggcattagcagttattagcctggtatcagcaaaaaccngggaaacnccccgtaagctcctgatctatgctgcctcactttgcaaagtcgggtaccagtcaaggttcagcgcagtgatcgtgggacagattttcactcgtacaccattcagtcagccctagccagcctagaagtattttcgctaattattactgtactaactagtctttaatacgtttatcttctacgtttcgggaccggtacgggacctaagggttcgaacgtaacgtacgaaacgtacgtgtacggcttagaccgaactacgttcgtcgttacttcgtacttccttcccgtacctagttcctagtaaccg

SEQ ID NO: 10603 - DNA, 597 bp, Homo sapiens
  misc_feature: GYAE6OF02JFFZ5.38.6.A06.1.454.CMB.1.raw
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccagggaaancccctaagctcctgatctatgctgcctccactttgcaaaggtgggtcccatcaaggttcagcggnagtgatctgggacagtatttcactctcaccatcagcagcctgcagcctagtaagtattttgaccttaacttattactagtacaactagtactttaattagttaactccttacgtaaccgtttcgggaccgggtaacgggaaccgtaagggtacgaaggtactaaaccgtaaaacgtaaccgtagggtacgtaccgttacgaccgtaaccctatttacccgttacgttacctttccgtaaccttcccggttacccccaccgttacgttacccgtacggttaaaccgg

SEQ ID NO: 10604 - DNA, 631 bp, Homo sapiens
  misc_feature: GYAE6OF02GXXK6.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttggccgggccagtcgagggcattagctagttatttagcctggtatcagacaaaaaccgagggaaacgcccctaagctcctgatctatgctcgcctccactttgacgtaaaggtcggggtcccagtaccgtaaaggtttcgacggcgggacgtaggtgggacgttcgtaggggaactaggtactttccactcctaccaccagtcagacacgtcccgtggacaacgtccctagggaaacgttacttttacgacttaactttacttactacgtacaaactacgttactttaaattagttactccttacgttacgtttcgggacgggtaaggaccgtaaagggtccgaagtactaaccgaaacgtactcggtagcgtacgccaacctagttccttgtaccttacgtacttcccgttacccgccttacgttcgtacggtaacgttcgtacgtacgtacgtgtacggg

SEQ ID NO: 10605 - DNA, 532 bp, Homo sapiens
  misc_feature: GYAE6OF02FWVIO.38.6.A06.1.454.CMB.1.raw
  modified_base (245)..(245): a, c, t, g, unknown or other
  misc_feature (245)..(245): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccagggaaacncccctaagctcctgatctatgctgcctccactttgcaagtcggggtcccatcaaggttcagcggcagtggatcgtgggacagtatttcactctcaccatcagcagcctgcagcctagaagtattttgactaactttattactgtacaacagtacttaattagttactcttactacgtttcgggacggtagggaccgtaaggtcgaagtactacgaaacgtaacgtgtagtcgtgcctaacctattcgtcgttccttactacttccttcccgctacttcgtagtaacg

SEQ ID NO: 10606 - DNA, 635 bp, Homo sapiens
  misc_feature: GYAE6OF02G4JNX.38.6.A06.1.454.CMB.1.raw
  modified_base (252)..(252): a, c, t, g, unknown or other
  misc_feature (252)..(252): n is a, c, g, or t
  modified_base (275)..(275): a, c, t, g, unknown or other
  misc_feature (275)..(275): n is a, c, g, or t
  modified_base (384)..(384): a, c, t, g, unknown or other
  misc_feature (384)..(384): n is a, c, g, or t
tcagtcgatcacgtcacgaccggtgctcgatttagatctactgacagggaggatggacatgagggtcccgctcagctcctgggctcctgctgctctggctcccaggtgccagatgtgccatccagttgacccagtctccatccctccctgtcctgcatctgtaggagacagagtcaccatcacttgccgggccagtcagggctattagcagttatttagccttggtatcagaacaaaaaaccgagggaaacncccctaaagctcctagattctangctgcctccgatttcgacaaaaggttcgggtacccagtactaggtttaccaagccggtacaaggtggtacttcgtacggggacaggtattttccgacttcgtacaaccntcaagcagcctcgacagaccgtagaagtattttgacgttaacttacttacttactacgtaacctagtactttaaattacgtttaactcgttacttaccggtttaccgggtacggtaaccgggtaccggtaaaggttacggtaagtaacgttaaccgaaaacgtaacgttacgaggtcgtacgacctacgtaacttccgttacgttaccttacgacctttccgtaccctaccgtactaccgtaccgtaacgg

SEQ ID NO: 10607 - DNA, 585 bp, Homo sapiens
  misc_feature: GYAE6OF02GS468.38.6.A06.1.454.CMB.1.raw
  modified_base (378)..(378): a, c, t, g, unknown or other
  misc_feature (378)..(378): n is a, c, g, or t
  modified_base (432)..(432): a, c, t, g, unknown or other
  misc_feature (432)..(432): n is a, c, g, or t
tcagtcgatcacgtcacgaccggtgctcgatttagatctactgacagggaggatggagactgggtcaactggatggcacgatctggcgtcccaggtgccagatgtgccatccagttgaacccaggtactccatcctccctgtctgcatctgtaggagactagagtacaccgactcacttggccgggccagtcagggcattagcagttattagtcctggtactcaagacaaaaaccgagggaaacgccctaagcctcctgactctatgtctcgtccttacctactttcgactaaacggtcggggttaccctaagtacgtaacggttcacggtacggtcgaggtggactcgtagggacagtactttaccactctacaccntcacgcacgctcgcagtcctagtatatttcactaacttatactcgtactaacgngtacttatacgtctatctacgtttcggacggacgtacgaggtacgagtactaacgaacgtacgtgtcgtcgtacgtacacgtatcgttacttcttactcgttaccttaccgtactacttgtacgtaccgtgtacctacggtacgtacgtcggg

SEQ ID NO: 10608 - DNA, 593 bp, Homo sapiens
  misc_feature: GYAE6OF02IMTKY.38.6.A06.1.454.CMB.1.raw
  modified_base (226)..(226): a, c, t, g, unknown or other
  misc_feature (226)..(226): n is a, c, g, or t
  modified_base (234)..(234): a, c, t, g, unknown or other
  misc_feature (234)..(234): n is a, c, g, or t
  modified_base (335)..(335): a, c, t, g, unknown or other
  misc_feature (335)..(335): n is a, c, g, or t
tcagtcgatcacgtcacgaccggtgctcgatttagatctactgacaggggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttatttagcctggtatcagacaaaaaccgngggaaacncccctaagcctcctgatctatgctgcctccactttgactaaaggtggggtacccatcaaaggttcaggcggcaggtgatcgtgggacagtactttcactcncaccatcagcagcctgcacgcctagaagtcttttcgacttaaactttattactacgtacaaactagtaactttaaatagttaactcttacttaccgtttcgggacggtacgggtaaccaagggtcgaagaacttaacgaaaaccggtacgtggtacggtacctagccaacctagttccgttctacctttactacttcccgttcccgactacgttaccgtagtaaccgttacgtactccggtacgtcggacggtccggg

SEQ ID NO: 10609 - DNA, 563 bp, Homo sapiens
  misc_feature: GYAE6OF02JKS65.38.6.A06.1.454.CMB.1.raw
  modified_base (244)..(244): a, c, t, g, unknown or other
  misc_feature (244)..(244): n is a, c, g, or t
tcagtcgatcacgtcacgaccggtgctcgatttagatctactgacagggaggatggacatgagggtcccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccaggaaacnccctaagctcctgatctatgctgcctccactttgacaaaggtcgggtcccatcaaggttcagcggcagtggatcgtggacagtatttcactctcactatcacgcagcctagcagcctagaagtattttcgactaactttattaactgtacaactagtactttaatagttatcttactacgtttcggacggacgggtaacctaagggtccgtaagtacgtaacgaaaacgtaccgttagtacggcgttcggaccaaccgttatacgttcgttacgtttactacttaccttccccggtacctacgttcgtacgttaaccgg

SEQ ID NO: 10610 - DNA, 509 bp, Homo sapiens
  misc_feature: GYAE6OF02IV9D5.38.6.A06.1.454.CMB.1.raw
  modified_base (229)..(229): a, c, t, g, unknown or other
  misc_feature (229)..(229): n is a, c, g, or t
  modified_base (332)..(332): a, c, t, g, unknown or other
  misc_feature (332)..(332): n is a, c, g, or t
  modified_base (471)..(471): a, c, t, g, unknown or other
  misc_feature (471)..(471): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttattagcctggtatcagcaaaaaccagggaaancccctaagctcctgatctatgctgcctccactttgacaaagtggggtcccatcaaggttcagcggcagtggatcgtgggacagtatttcactctcaccatcancagcctgcacgcctagaagtattttagactaactttaactttactgtacaactagtacttaatacgttatctctacgtttcggacggaggaccgaaggtcgagtatacaaacgtactgtgactgctacatctgtctcgnttcctccgctactctagtacgtgactcgtacgtgacgg

SEQ ID NO: 10611 - DNA, 589 bp, Homo sapiens
  misc_feature: GYAE6OF02H9TXM.38.6.A06.1.454.CMB.1.raw
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcacatcacttgcccgggcagtcagggcattagcagttattagcctggtatcagacaaaaaccgagggaaacgccctaagctacctgactctatcgactgccctcactttgactaaggtcgggtacccatcgtaaggttcaggcggacaggtggatcgtggacagtnttcactctacacatcgancacgcctgccacgctagtaacgtattttcgacttaactttatacgtacgtacaactagttactttaattacgttacttacttacgtaccggtttcgggtaccggaacggggtacctaacgggtacgtaagtaacgtaccgtaaacgtacgtaggtacgactacgacctaactacttacgtcgttacttccgtacttcccgttacccgtacctacgttaccgtacgtaacgg

SEQ ID NO: 10612 - DNA, 542 bp, Homo sapiens
  misc_feature: GYAE6OF02HQY17.38.6.A06.1.454.CMB.1.raw
  modified_base (246)..(246): a, c, t, g, unknown or other
  misc_feature (246)..(246): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaaccgagggaaancccctaagctcctgatctatgctgcctccactttgcaaagtcggggtcccatcaaggttcagcggcagtggatcgtgggacagtatttcactctcaccatcagcagcctgcacgcctgaagtattttgactaactttattactgtcaaacagtactttaaatagttattctactacgttttcgggacggtacgggacctaagggtcgagtaataccgaaacgtactgtcggctcgacaaccgtattcctagttccttactacgttcccttcccgacctactcgttacgacgttacg

SEQ ID NO: 10613 - DNA, 528 bp, Homo sapiens
  misc_feature: GYAE6OF02JC937.38.6.A06.1.454.CMB.1.raw
  modified_base (203)..(203): a, c, t, g, unknown or other
  misc_feature (203)..(203): n is a, c, g, or t
  modified_base (290)..(290): a, c, t, g, unknown or other
  misc_feature (290)..(290): n is a, c, g, or t
  modified_base (301)..(301): a, c, t, g, unknown or other
  misc_feature (301)..(301): n is a, c, g, or t
  modified_base (511)..(511): a, c, t, g, unknown or other
  misc_feature (511)..(511): n is a, c, g, or t
  modified_base (528)..(528): a, c, t, g, unknown or other
  misc_feature (528)..(528): n is a, c, g, or t
tcagtcgatcacgtcacgaccggtgctcgatttagatctactgacagggaggatggagactggctcccaggtgccagatgtgccatccagttgacccagtctccatcctccctgtctgcatctgtaggagacagagtcaccatcacttgccgggccagtcagggcattagcagttatttagcctggtatcagacaaaaaaccngggaaacgcccctaagctcctgatctatgctgcctccactttgcaaagtgggtcccatcaaggttcagcggcagtgatcgtgggacngatttcactcncaccatcagcagcctgcagcctgaatattttgactaactttatactgtacaactagtcttaattagttatcttactacgtttcgggacggacgggacctaagggtcgaagtaataccgaaacgtaacgtggtcgacgtcgacctaacctattccgtcgttctttacacttccttacccgcctatccgtagacgtgagtcgactgagcggntcggacaggcacagtgn

SEQ ID NO: 10614 - DNA, 524 bp, Homo sapiens
  misc_feature: GYAE6OF02GX0MM.38.6.A06.1.454.CMB.1.raw
  modified_base (223)..(223): a, c, t, g, unknown or other
  misc_feature (223)..(223): n is a, c, g, or t
  modified_base (518)..(518): a, c, t, g, unknown or other
  misc_feature (518)..(518): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggcagtcagggcattagcagttatttagcctggtatcagacaaaaaccngggaaacgcccctaagctcctgatctatgctgcctccactttgcaaagtgggtcccatcaaggttcagcggcagtggatcgtgggacagtatttcactctcaccatcagcagcctgccagcctagaagtattttcgactaactttattactgtacaactagtacttaattagttactcttacctacgtttcggacggtacgggaccaaggtacgagtatacgaaacgtagtgtggtctgccacattctctcttctacgtccttcccgctatcgtagacgttcgatacgactacgngtcggg

SEQ ID NO: 10615 - DNA, 494 bp, Homo sapiens
  misc_feature: GYAE6OF02FWMYR.38.6.A06.1.454.CMB.1.raw
  modified_base (362)..(362): a, c, t, g, unknown or other
  misc_feature (362)..(362): n is a, c, g, or t
  modified_base (463)..(463): a, c, t, g, unknown or other
  misc_feature (463)..(463): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgcctggccagtcagggcattagcagttattagcctggtatcagcaaaaaccagggaaagcccctaagctcctgatctatgctgcctccacttgcaaagtgggtcccatcaaggttcagcgcagtggatcgtgggacagtatttcactctcaccatcagcagcctgcagcctgaacgtntttgactaacttattactgtacaactagtacttaattagttatctctacgtttcggacggtaggacaaggtcgtagactacaaacgactgtgctgctaacntctgtctctatccttcccgctactctgtacg

SEQ ID NO: 10616 - DNA, 510 bp, Homo sapiens
  misc_feature: GYAE6OF02I7V58.38.6.A06.1.454.CMB.1.raw
  modified_base (230)..(230): a, c, t, g, unknown or other
  misc_feature (230)..(230): n is a, c, g, or t
  modified_base (377)..(377): a, c, t, g, unknown or other
  misc_feature (377)..(377): n is a, c, g, or t
  modified_base (426)..(426): a, c, t, g, unknown or other
  misc_feature (426)..(426): n is a, c, g, or t
  modified_base (475)..(475): a, c, t, g, unknown or other
  misc_feature (475)..(475): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcaacaaaaaccagggaaancccctaagctcctgatctatgctgcctccactttgcaaagtggggtcccatcaaggttcagcggcagtggatctgggacagatttcactctcaccatcagcagcctgcagcctagaagtattttgactaactttattactgtacaanagtcttaaatagttatctcgtactttcggacggtaggaccaaggtcganatacaaacgactgtggctagcaccatctgttctacgtactccgttaccncctatcctagacgttgactcgacgtgaggtccggg

SEQ ID NO: 10617 - DNA, 537 bp, Homo sapiens
  misc_feature: GYAE6OF02IRTZQ.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagtttatttagcctggtatcagacaaaaaccgagggaaagcccctaagctcctgatctatgctgcctccactttgcaagtggggtcccatcaaggttcagcggcagtggatctgggacagtactttcactctcacatcagcagcctgcagcctgaatatttgactaactttattactgtacaactacgtacttaaatagtttatctactactttcgggacggtagggacctaaggtacgagtagtaccaaacggtaactggtggctagacaccgtatcgttacgttccttactaacttccttacccgcctacttcgtacggtacttacgg

SEQ ID NO: 10618 - DNA, 581 bp, Homo sapiens
  misc_feature: GYAE6OF02G7J5Q.38.6.A06.1.454.CMB.1.raw
  modified_base (238)..(238): a, c, t, g, unknown or other
  misc_feature (238)..(238): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgngggaaacgcccctaagctcctgatctatgctgcctccactttgcaaagtgggtcccatcaaggttcagcggcagtggatcgtgggacagtattcactctcaccatcagcagcctgcagcctgaagtatttgactaacttattactgtacaactagtacttaaattagtttactctacgtacgttttccgggacgggtaacgggtaccaacgggtacgtaacgacgttaaccgaaaacggtaacgttacggtaggtacctacgtacctaccgtaacttccgttagttccctttaccgtacgtttcccttccccgaccttacgttaccgttagtaacccgttacg

SEQ ID NO: 10619 - DNA, 535 bp, Homo sapiens
  misc_feature: GYAE6OF02II15O.38.6.A06.1.454.CMB.1.raw
  modified_base (510)..(510): a, c, t, g, unknown or other
  misc_feature (510)..(510): n is a, c, g, or t
tcagtcgatcacgtcacgaccggtgctcgatttagatctactgacaggggaggatggacatgagggtccccgctcagctcctggggctcctgctgctctggctcccaggtgccagatgtgccatccagttgacccagtctccatcctccctgtctgcatctgtaggagacagagtcaccatcacttgccgggcagtcagggcattagctagttattagcctggtatcagacaaaaaccgagggaaacgcccctaagcctcctgatctatgctgcctccactttgactaaaggtcgggtaccatacaaggttcagcgctaggtgatcgtgggactagtatttcactctacacatcagcacgcctgccagccgtgaacgtattttagactaacttattactagtacaacagtactttaagtactttatctactacgtttcgggacggtaagggtacctaaggtacgaagtactaacaaacgactagtcggactgccaactactctgtccttntactccttcccgctactcgtatacg

SEQ ID NO: 10620 - DNA, 621 bp, Homo sapiens
  misc_feature: GYAE6OF02HPGHN.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccggcagtcagggcattagctagttattagcctggtatcagacaaaaaccgagggaaacgacccctaagcctcctagactctatgctcgcctacctactttgacgtaaaggtcggggtacccagtacgaagttcaggcgcaggtggatcggagatagttcttacactccacactacacgacgtaccacgtacgacgacgtcgtaagtaagtttacttactaacttaacttacgtactacgtaactaacgtagttaacttaattacgttactacgttacgttacggttacgggaacgggtaccggtaacggtacggtacgaacgtaacgtaaaccgaacgtacgtggtacgtacgtacgaccgtaacgttacgttcgttacgttacttaccgttccgttaccctccgtactaccgttacgtaacgttacgtagtacg

SEQ ID NO: 10621 - DNA, 605 bp, Homo sapiens
  misc_feature: GYAE6OF02IWZTE.38.6.A06.1.454.CMB.1.raw
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
tcagtcgatcacgtcacgaccggtgctcgatttagatctactgacagggaggatggagactgggtcccgctcagctcctgggctcctgctgctctggctcccaggtgccagatgtgccatccagttgacccagtctccatcctccctgtctgcatctgtaggagacagagtcaccatcacttgccggccagtcagggcattgcagttattagctggtatcagacaaaaaccgnggaaacnccctaagctcctgatctatgctacgcctacctactttgactaaaggtcgggtacccagtcgaacggttcacggtcggactaacggtggaactcgtagggaaccagtactttcaactcgtacaccattcgagcagcctgccagcctagagtactttgactaacttatctagtacaactagtacgtttaatagttactacttaccgtacgtttacgggaccggtaaagggtacccgtaagggtaccgtaagtaactacgtaaaaccgtacggttagtaccgggtctaggaccctaacgtcgttaccgttagttccttaacgtaccgttacctttccccggacttacgtacgttacgtacggttaacg

SEQ ID NO: 10622 - DNA, 555 bp, Homo sapiens
  misc_feature: GYAE6OF02J1RTN.38.6.A06.1.454.CMB.1.raw
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
  modified_base (355)..(355): a, c, t, g, unknown or other
  misc_feature (355)..(355): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttattagccttggtaatcagacaaaaaccgnggaaacgccctaagctctgatctatgctgccctcctactttgactaaaggtcgggtacccatcaaggttcaggcggcaggtggatcgtagggacagtntttcgactctacacntcagcacggtctgcagcctagagttatttcgatacttattactgtacaactagtactttaattacgttactctactacgtttcgggacggtaggaaccgagtcgaagtaactacaaacgtacgtgtacgctagtaccgaacctatacttcgtacctttaccgtacttccgttcccgtacctacgttaccgtacggtaacg

SEQ ID NO: 10623 - DNA, 483 bp, Homo sapiens
  misc_feature: GYAE6OF02GB2AS.38.6.A06.1.454.CMB.1.raw
  modified_base (237)..(237): a, c, t, g, unknown or other
  misc_feature (237)..(237): n is a, c, g, or t
  modified_base (470)..(470): a, c, t, g, unknown or other
  misc_feature (470)..(470): n is a, c, g, or t
  modified_base (472)..(472): a, c, t, g, unknown or other
  misc_feature (472)..(472): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccnggaaagcccctaagctcctgatctatgctgcctcactttgcaaagtgggtcccatcaaggttcagcggcagtggatcgtgggacagatttcactctcacatcagcagcctgcagctgagattttgcaacttattactgtacaactagtcttaatagttatctcactttcggacgagggaccaaggtcgagatacaaacgaactgtgctgcaaccatctgtcttcactctcccncnctactgtaacg

SEQ ID NO: 10624 - DNA, 517 bp, Homo sapiens
  misc_feature: GYAE6OF02HUJM5.38.6.A06.1.454.CMB.1.raw
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (496)..(496): a, c, t, g, unknown or other
  misc_feature (496)..(496): n is a, c, g, or t
tcagtcgatcacgtcacgaccggtgctcgatttagatctactgacagggaggatggagactgggtcaactggatggcacatctggctccaggtgccagatgtgccatccagttgacccagtctccatcctccctgtctgcatctgtaggagacagagtcacatcacttgccggcagtcagggcattagcagttatttagcctggtatcagacaaaaacgngggaacnccctaagctctgatctatgctgcctccgactttgacaaagtcggggtcccaatcaaggttcagcggcagtggatcgtggacagatttcactctcaccatcagcagcctgcacgctgagtatttgactaaacgttnttactgtacaatntacttaatattactctactacgttggcgtaaggacgaggacgagactacgaacgactggtacgctcgacacctatactcgttcttcgaactttccgttaccgcctacgtctacgtaacgtnacgttcgtacgtcggtaacgg

SEQ ID NO: 10625 - DNA, 599 bp, Homo sapiens
  misc_feature: GYAE6OF02ISRVX.38.6.A06.1.454.CMB.1.raw
  modified_base (221)..(221): a, c, t, g, unknown or other
  misc_feature (221)..(221): n is a, c, g, or t
  modified_base (228)..(228): a, c, t, g, unknown or other
  misc_feature (228)..(228): n is a, c, g, or t
  modified_base (364)..(364): a, c, t, g, unknown or other
  misc_feature (364)..(364): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccggccagtcagggcattagcagttattagcctggtatcagacaaaaacngggaaanccctaagctctgatctatgctcgcctcctactttgacgtaaaggtcgggtacccagtcgaaaggttcaggcggcaggttggatcgtggtacagtatttcaccttcacacctaatccagcagcctagcagctgaagnttttcgctaattacttactagctaacgatacgttaaattagtatacgttcgtaacgtttcggcgtaagggacctaaagggtccgtaaggtaactaccgaaaacgtaaccgtggtacccggtagtaccggacctaaccttaagttccttacggttaccttaaccgtaacgttccctacccgtccgttaacttaccggttacgtaaccgggtcttagttacccggattacggacggg

SEQ ID NO: 10626 - DNA, 586 bp, Homo sapiens
  misc_feature: GYAE6OF02JJVUL.38.6.A06.1.454.CMB.1.raw
  modified_base (250)..(250): a, c, t, g, unknown or other
  misc_feature (250)..(250): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
  modified_base (330)..(330): a, c, t, g, unknown or other
  misc_feature (330)..(330): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcacatcacttgccgggccagtcagggcattagctagtttattacgcctggtatcagaccaaaaaccgaggggaaacncccctaagcttcctgatctatgctgcctcacttgacaaggtcgggtaccagtcaacgtnaggcgnagtggatcgaggacngtacttcactctacacatcagctacgcctgacacgtccgtagtaacgtattttcgacctaactttacttacgtagtaccaacgtactaactttaatacgtttatccgttacgtaccggtttcgggacgggtaacgggaacccgtaaggtacgaagtaactacgaaacggtacgttggtacgcgtcgtaccaccgtacgttccgttgttccttaccgtaccgttccttaccccgcttacgtacgtacggtacgtacg

SEQ ID NO: 10627 - DNA, 562 bp, Homo sapiens
  misc_feature: GYAE6OF02I4WFN.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcaagacaaaaaccgagggaaacgcccctaagctcctgatctatgctgcctcactttgctaaggtcgggtcccatcgaaggttcaggcgcaggtgatcgtagggactagtactttcacttctcaccatcagccacggtcctagcacgctagtaatattttcgacttaacttattactgtacaactgtactttaatagttactctactacgtttcggacggtaggaccgtaggtacgaagtacgtaacaaacgtacgtgtacggtctacgacctactacgttctagttcccttacgtacttccccgttacccggtacctacgttacgtacggtaaccgg

SEQ ID NO: 10628 - DNA, 576 bp, Homo sapiens
  misc_feature: GYAE6OF02HFV3C.38.6.A06.1.454.CMB.1.raw
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccngggaaancccctaagctcctgatctatgctgcctcctacttgacaaagtcggggtcccatcaaggttcagcggcagtggatcgtggactagacttcacttcncaccatcagcagcctgcngtcctagatatttgactaactttatactagtacaacgtataccttaaatagtttatcctcttacgtttcggacgggtacggaccgtaaggtcgaagtacttaacgaaacgtacgtaggttaggacctcgaaccgtaccgtacttaccttgggttacccttacgtaccgtttacccgttccccggtacccttattacccgttacggtaaccgttaccgg

SEQ ID NO: 10629 - DNA, 524 bp, Homo sapiens
  misc_feature: GYAE6OF02GDST9.38.6.A06.1.454.CMB.1.raw
  modified_base (506)..(506): a, c, t, g, unknown or other
  misc_feature (506)..(506): n is a, c, g, or t
tcagtcgatcacgtcacgaccggtgctcgatttagatctactgacagggaggatggagactgggtccccgctcagctcctgggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccgagggaaagcccctaaagctcctgatctatgctgcctccactttgctaaaggtcgggtaccatcgaaggttcagcgcagtggatctgggacagtattcactctcacatcagcagcctgcagcctagaaagtattttagactaaactttattaactgtacaactagtacttaatatttactctactacgtttcgggacgtaagggaccaaggtacgagactacgaaacgtactgtgctgacacctatcttgtaccttgacttccgtcccncctagtctagtacgtacg

SEQ ID NO: 10630 - DNA, 781 bp, Homo sapiens
  misc_feature: GYAE6OF02I9FF3.38.6.A06.1.454.CMB.1.raw
  modified_base (263)..(263): a, c, t, g, unknown or other
  misc_feature (263)..(263): n is a, c, g, or t
  modified_base (290)..(290): a, c, t, g, unknown or other
  misc_feature (290)..(290): n is a, c, g, or t
tcagtcgatcacgtcacgaccggtgctcgatttagatctactgacaggggaggatggacatgagggtccccgctcacgctcctggggctcctgctgctctggctcccaggtgccagatgtgccatccagttgacccagtctccatcctccctgtctgcatctgtaggagacagagtcaccatcacttgccgggccagtcagggcattagctaggttactttaggccttaggtactcgaagaccaaaaaccggagggaaaaccncccctaagcctacctgaattcctagtncctcgaccctacctacgtttggacctaaagggttccgggtaccccaagttaccgaaacgggtttcacggtccgggactagggtcggtacgttacggtacggggaacttaacggtacttttaccgaacctttactacccgaacctaagtaccgaaggtcccaacggtccccttagggaaccgaaccggtacccgttaaggtaaaccgttttagtttttacccggaactttaaaaccgttttattaacccgttaggtaaacctaaaccgttacgttaacttttaaagttaacttttaaccgtcctttacccgttacgggttttaccggggaaacgggtaaccggggtaaaccgtaacggggttaaccggtaaaggtaaaccgtaaaccggaaaccgttaacgttcggttaggtcttaggacccgtaacgttaacctacgttcgttaccgttacttacgttcccgttacccgactacgttaccgtaggtaaccg

SEQ ID NO: 10631 - DNA, 580 bp, Homo sapiens
  misc_feature: GYAE6OF02JZC5G.38.6.A06.1.454.CMB.1.raw
  modified_base (335)..(335): a, c, t, g, unknown or other
  misc_feature (335)..(335): n is a, c, g, or t
  modified_base (360)..(360): a, c, t, g, unknown or other
  misc_feature (360)..(360): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccggccagtcagggcattagcagttatttagcctggtatcagacaaaaaccgagggtaaacgcccctaagctcctgatcatgctgcctccactttgcaaaggtcgggtcccatcgaaggttcagcggcagtggatgtagggacagtatttccacttctacaacnctcagtcagcctgcagcctagaatnttttcgactaacttatacgtgttacaactacgtaacgtttaataagttactcgtacttacgttttcggacggtacggtaacctaaggtacgtaaggtaactacgaaaacgtaacgtgtacggtccgtagaccaacgtactcgtacgttaccttcaactttcccgttcccggacctacgttacgtacgtaaccggttgacctttacggtacacggtaacgg

SEQ ID NO: 10632 - DNA, 665 bp, Homo sapiens
  misc_feature: GYAE6OF02JYE0U.38.6.A06.1.454.CMB.1.raw
tcagtcgatcacgtcacgaccggtgctcgatttagatctactgacaggaggagtggacgatgaggtcccggcgtcagctcctgggcgtccgtgctgctctggctcccgaggtgccagatgtgccatccagttgacccagtctccatcctccctgtactgtcatctgtaggagtacagagtcaccatccactgcccggcagtcagggccattagactagtttattacgcgttaggtactcgaagtaccaaaaaccgagggaaacgtacccctaagccttaccgtagacttcctaagtcgctcgacctcccgtatttcgacaaacggttcgggtacccagtacgaacgggttcaacggtcgacgacgtggtactccggttaggacgttagacgtttcaccgttactacgacctagtcgactcgacgtaccctggactagacccgtagtaacgtactttagtaacctactttagtaaccgttgtaactactagtacctttaataacgttactacttacttaccggtacgttacggtacggtacgtaacgggttgaacgtacttaaacgaaacgtaccgtaggtacgtacgtcgtactaacccgagttaccgtacttacgttaccttacgtacccgttcccgtaacctcgttaccggtacgttaaccgg

SEQ ID NO: 10633 - DNA, 480 bp, Homo sapiens
  misc_feature: GYAE6OF02FQE5J.38.6.A06.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaaccngggaaancccctaagctcctgatctatgctgcctcactttgcaaagtgggtcccatcaaggttcagcggcagtggatctgggacagattcactctcaccatcagcagcctgcagcctgaagattttgctaacttattactgtcaacagtcttaatagttatctcactttcggcgagggacctaaggtcgagatacgaaacgaactgtagctgcacatctgtcttcatctccgccatctgagtcg

SEQ ID NO: 10634 - DNA, 569 bp, Homo sapiens
  misc_feature: GYAE6OF02HHR4H.38.6.A06.1.454.CMB.1.raw
  modified_base (244)..(244): a, c, t, g, unknown or other
  misc_feature (244)..(244): n is a, c, g, or t
  modified_base (329)..(329): a, c, t, g, unknown or other
  misc_feature (329)..(329): n is a, c, g, or t
  modified_base (377)..(377): a, c, t, g, unknown or other
  misc_feature (377)..(377): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggcagtcaggcattagcagttattagcctggtatcagacaaaaaccgagggaaacncccctaaagcctcctgatctatgctgcctccactttgctaaaggtcgggtacccatacgaaggttcaggcggcaggtgacttcgngggacaggtattcactctacaccatcaagcagcctgcagctagaattntttagactaacttattactgtacaacagtacttaagtacttactctactacgtttccgggacggaacgggtacctaaggtacgaacgtactaaccgaaacgtactgggtacgtcctacgaccgtactaacgttcctagttaccttacctacgttacccgttcccgacctagttaccgttacggtacgtacgg

SEQ ID NO: 10635 - DNA, 703 bp, Homo sapiens
  misc_feature: GYAE6OF02J2NPL.38.6.A06.1.454.CMB.1.raw
  modified_base (648)..(648): a, c, t, g, unknown or other
  misc_feature (648)..(648): n is a, c, g, or t
  modified_base (653)..(653): a, c, t, g, unknown or other
  misc_feature (653)..(653): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttcgacccagtctccattcctccctgtctgctatctagtagagacagacgtaccaccatcctacgttcggccggcctagtcgacgggctattacgtctagtttacttagccgtaggtatacaagaaccgtaaaaaccgaggggaacctccccgttaagccttccgtagtactcgtagtcgccttcgtaccttcctacgtttcggaaccgtaaggttccgggtaccacgttacggaaacggtttccgaacgggtccgtacgtaacgggtacggtacgtaccggtagggtactacggttacctttaaccaccttccgtacacgtacttaccgacgtacgtaaccgtcgtacgacgttaccgtaccttaagggtaaccttactttacgtaaccttaacgtttaccgttactcggtaaccctaagttaccgtaatttacgttacgttacttccgttacggttacggtaccgggtacggtaacggtacggtacgtacgtacaacgttaccgaaagtcgtagtaccgngtacnccacgttagtctacttcctacgcttcctaccgatactcgtacgagttccg

SEQ ID NO: 10636 - DNA, 634 bp, Homo sapiens
  misc_feature: GYAE6OF02ICQLS.38.6.A06.1.454.CMB.1.raw
  modified_base (216)..(216): a, c, t, g, unknown or other
  misc_feature (216)..(216): n is a, c, g, or t
tcagtcgatcacgtcacgaccggtgctcgatttagatctactgacagggaggatggagactgggtccccgctcagctctggggctcctgctgctctggctcccaggtgccagatgtgccatccagttgacccagtctccatcctccctgtctgcatctgtaggagacagagtcaccatcacttgccgggccagtcagggcattagcagttatttancctggtatcagacaaaaaaccgagggaaagcccctaaagcctcctagatctaatgctcgcctcctatttcgacgtaaaacggttcggggtaccccaatacgaaggttcaaggccggacgaaggtcggaatccgtagggaactaaggacttttcacctctcaacatcagcacggcctagcacgcctagaagttattttagactaaactttactttaacgtagttaaccaaactacgttaactttaaattacgttaattccttacgttacgtttacgggaccgggtaagggtaaccgaaggtcgaagtaacgtaacgtaaaaccggtaacgtagtaggtactaggtacctacgtacttacgtgttccgttactaacgttcccgttacccgaccctaacgtaccgttacggtaaggttacg

SEQ ID NO: 10637 - DNA, 573 bp, Homo sapiens
  misc_feature: GYAE6OF02GCQSS.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggcagtcagggcattagcagttatttagcctggtatcagacaaaaaccagggaaacgcccctaagcctcctgatctatgctgcctccactttgacaagtgggtacccatcaaggttcagcggcaggtggatctgggacagtatttcactctcaccatcagcacgcctgccagtcctaggtaagtacttttcgactaactttactttacgtacgtactaacagtactttaaattaacgtttatccttactacgtttcgggacggacgggtaacgacggtacgaacgtactacgaaacgtacgtgtacgctcgaccaacctactcgttcgttaccttacgttactccctttacccgcctacgttaccgtacgtaacgttgacgttccggtactcggacggg

SEQ ID NO: 10638 - DNA, 525 bp, Homo sapiens
  misc_feature: GYAE6OF02F5H0T.38.6.A06.1.454.CMB.1.raw
  modified_base (367)..(367): a, c, t, g, unknown or other
  misc_feature (367)..(367): n is a, c, g, or t
  modified_base (501)..(501): a, c, t, g, unknown or other
  misc_feature (501)..(501): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagcaaaaaccagggaaagcccctaagctcctgatctatgctgccctcactttgcaaagtcgggtcccatcaaggttcagcggcagtggatctgggacagtatttcactctacaccatcagcagccctgcagcctagaagtnttttagctaacttattactgtacaacagtactttaatagttatccttctaccttttcgggaccggtaagggtaaccgaagggttcgaagacttacaaacgaactgtacgtctagccacctatacttgtccttcncttcccttccgccatcctagactg

SEQ ID NO: 10639 - DNA, 578 bp, Homo sapiens
  misc_feature: GYAE6OF02GQEGU.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttgccgggcagtcagggcattagcagttattagcctggtatcagacaaaaaccagggaaagacccctaagctcctgatctatgctgcctccactttgacaaagtggggtcccatcaaggttcagcggcagtggatcgtggacagtatttcactctcaccatcagcagcctgcagcctgaagtattttgactaactttattactagtacaaacgagtactttaattaagtttataccttactacgttttaccgggcgggtaacgggaaccctaaagggttaccggaagtaacttaacgaaaaccggaaacttggtacggtcgtacggtaccaaccgtacttacgttcgttctttaccaccttcctttaccccggaccctacttccgtacgtaaccg

SEQ ID NO: 10640 - DNA, 517 bp, Homo sapiens
  misc_feature: GYAE6OF02F1ZOF.38.6.A06.1.454.CMB.1.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
tcagtcgatcacgtcacgaccggtgctcgatttagatctactgacagggaggatggagactgggtcaactggatggcacatctggctcccaggtgccagatgtgccgtccagttgacccagtctccatcctccctgtctgcatctgtaggagacagagtcaccatcacttgccgggccagtcagggcattagcagttattagcctggtatcagcaaaaaccngggaaacncccctaagctcctgatctatgctgcctccactttgacaaagtgggtcccatcaaggttcagcggcagtgatcgtgggacagtatttcactctcacatcagcagcctgcagcctagaacgtattttcgactaactttattactgtacaacatacttaaatagttactctacgtacgtttcggcggaacggaccgtaaggtcgaagactacaaacgacgtgtaggctgcactatctgtcttcacgtcctacccgctacttctagacgtgtactcgacgtcgaggtcggg

SEQ ID NO: 10641 - DNA, 755 bp, Homo sapiens
  misc_feature: GYAE6OF02J28XN.38.6.A06.1.454.CMB.1.raw
  modified_base (137)..(137): a, c, t, g, unknown or other
  misc_feature (137)..(137): n is a, c, g, or t
  modified_base (170)..(170): a, c, t, g, unknown or other
  misc_feature (170)..(170): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
tcagtcgatcacgtcacgaccggtgctcgatttagatctactgacagggaggatggacatgagggtccccgctcagctcctggggctcctgctgctctggcctcccaggtgccagatgtcgccatccagttgacccngtctccatccctccctgtctgcatctgaagganactagactcaccatcacgttcggccgggccagtcaggcattagctagttacttagcctaggtatccgaanaacgaaaaaccgagggaaacncccctaagctacctgactctatcgctcgtccctcctactttcgacgtaacggttcgggtacctagtaccgtaacggttcaaggtccggacgtaggtcggtaactccggtacggggaactacgtttacctttccgaaccttcccgtacctaaacctaccttacggaaccgtccgtaaccgggtccctcgggaaccctaacggtaccgtaacgtaaacgggtttctttttaacccggaacctttaaacgttttaccgttaaccggtactaaccgtaaaactacggtttaacctttaaagttaccgtttaactcgttacccggttacggtttaccgggaaccggtaacggtaacccgtaggttaaccgaacgtaccgtttaaacgaccggtaagttcggggacttacggcctttaaccaaccgtttacctcgtttcccgttacctttaccggtaacccttcccgtacccttagttaaccgttccgtaaggttaccgg

SEQ ID NO: 10642 - DNA, 536 bp, Homo sapiens
  misc_feature: GYAE6OF02F1B4D.38.6.A06.1.454.CMB.1.raw
  modified_base (247)..(247): a, c, t, g, unknown or other
  misc_feature (247)..(247): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagccttggtatcagacaaaaaccaggggaaancccctaagctcctgatctatgctgcctccactttgcaaaggtcgggtcccatcaaggttcagcggcagtggatcgtgggacagtattcactctcaccatcagcagcctgcagcctgaagtatttgactaactttattactgtacaacagtactttaaatagttactcttactacgtttcgggacggtaaggaccgtaaggtcgaagtactacgaaacgtactggtgctgaccgacctactcttcgttccttactacttccgtttcccgacgtattccgtagacgtacgg

SEQ ID NO: 10643 - DNA, 717 bp, Homo sapiens
  misc_feature: GYAE6OF02I4ALY.38.6.A06.1.454.CMB.1.raw
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccggccagtcagggcattagctagttattagcctggtatcagacaaaaaccgngggaaacnccctaagctctgatctatgctcgcctcctactttgactaaacggttcggggtaccccaagttaccgtaaagggttccaacggccgggaccaggttggacgttcgtaggggaactaggtacttttccacgttcctaccgaaccctataccgagacctaacggcccttggacctacgtcccttaggtaaacgttacttttttacggaccttaaactttactttaaccgttacgttaaccaaacgttacgttaactttaaacgtttaacggtttacttccgttaaccgttacgttttaccgggacgggtaacgggtaaccgtaagggtaccggtaagtaacgtaaccgtaaacgtaacgttcggtacggacctacgaccctaacgtacgttaccttcggttacctttaccgtaactttcccgttacccgtaccgttaacgttaccgttacggtaacgttcgtaacgttacccgtacgttaggaccggg

SEQ ID NO: 10644 - DNA, 583 bp, Homo sapiens
  misc_feature: GYAE6OF02ILBYA.38.6.A06.1.454.CMB.1.raw
  modified_base (251)..(251): a, c, t, g, unknown or other
  misc_feature (251)..(251): n is a, c, g, or t
  modified_base (326)..(326): a, c, t, g, unknown or other
  misc_feature (326)..(326): n is a, c, g, or t
  modified_base (386)..(386): a, c, t, g, unknown or other
  misc_feature (386)..(386): n is a, c, g, or t
tcagtcgatcacgtcacgaccggtgctcgatttagatctactgacaggggaggatggagactgggtccccgctcagctcctgggggctcctgctgctctggctcccaggtgccagatgtgccatccagttgacccagtctccatcctccctgtctgcatctgtaggagacagagtcaccatcacttggccggccagtcagggcattagctagttattagcctggtatcgaagacaaaaaccgagggaaacncccctaagcctcctgatctatgctgcctcctacgtttgacgtaaaggtcggggtaccagtcgaaggttcagcggnagtggatcgtaggacagtattcactcacactatcagcacgcctgcacgtctagtaagttntttacgactaactttatactgtacaagtatacttaaattacgttactacttcgtaacgtttccggggacggtaacgggtaccgtaagggtccgaagtaacttaacgaaacgtacgtcggtacgtctcgactaccgtacgttccttagtccttacctacttcccgttacccgtacctacttacgtacgtaacggttcg

SEQ ID NO: 10645 - DNA, 568 bp, Homo sapiens
  misc_feature: GYAE6OF02HM4C3.38.6.A06.1.454.CMB.1.raw
  modified_base (236)..(236): a, c, t, g, unknown or other
  misc_feature (236)..(236): n is a, c, g, or t
  modified_base (243)..(243): a, c, t, g, unknown or other
  misc_feature (243)..(243): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccggcagtcagggcattagcagttattagcctggtatcagacaaaaaaccngggaaancccctaagctcctgatctatgctgcctcctactttgactaaagtcggggtacccatcaaggttcaagcgcagtgatcgtggacagtattcactctacacatcagcagcctgctagcctagaacgtattttcgactaaactttattactgtacaactagacttaaattagttatcctactacgtttcgggacggtaacgggtacctaagggtacgaagtactaacaaaacggtaacttggtacgattcgacctaacccgtattaccgttgttaccttacgtactttcccgttaccccggacttaaccgttcgtacgtacgttacgg

SEQ ID NO: 10646 - DNA, 606 bp, Homo sapiens
  misc_feature: GYAE6OF02GGYK9.38.6.A06.1.454.CMB.1.raw
  modified_base (247)..(247): a, c, t, g, unknown or other
  misc_feature (247)..(247): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttatttagcctggtatcagacaaaaaccaggggaaacncccctaaagctcctgatctatgctgcctcactttgcaaaggtcgggtcccatcgaaggttcaggcggcaggtggatcgtgggacagtactttcactctcaccatcagcagccctgaccagcctaggtaagtattttcgactaactttaattctacgtacaactagtactttaatagtttactcttcgtacgtttacgggacgggtaacggaacctaagggtcgaagtaacttacgaaaacgtacgttaggtcggtacctacggacctaccgtaacgttccgtttacggttaccctttacgtacctttccccgtttaccccggtacccttaacgttccggttaacggtaaccggttacgg

SEQ ID NO: 10647 - DNA, 598 bp, Homo sapiens
  misc_feature: GYAE6OF02IN81X.38.6.A06.1.454.CMB.1.raw
  modified_base (236)..(236): a, c, t, g, unknown or other
  misc_feature (236)..(236): n is a, c, g, or t
  modified_base (244)..(244): a, c, t, g, unknown or other
  misc_feature (244)..(244): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccggcagtcagggcattagctagttattagcctggtatcagacaaaaccgngggaaacncccctaagctcctgactctatgctgcctctactttgactaaggtcgggtacccagtcgaaggttcagcggcaggtgatcgtgggacagtacttcactctacacatcagcagcctgcagtcctagaagttatttacgacttaaactttattaactcggttaccaacgtacgtactttaaagtacgttacttccttacgtacgtttacgggacggtaacgggtaacctaagggtcgtaagacttaaccgaaaacggtacgttacggtacgtacgtacgacctaaccgtatttaccgtgtttaccttcgtaacctttcccgtacccgtaccttaacgttcgtacggtaacgttacgg

SEQ ID NO: 10648 - DNA, 566 bp, Homo sapiens
  misc_feature: GYAE6OF02G3ETO.38.6.A06.1.454.CMB.1.raw
  modified_base (240)..(240): a, c, t, g, unknown or other
  misc_feature (240)..(240): n is a, c, g, or t
  modified_base (248)..(248): a, c, t, g, unknown or other
  misc_feature (248)..(248): n is a, c, g, or t
  modified_base (374)..(374): a, c, t, g, unknown or other
  misc_feature (374)..(374): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttcggccgggccagtcagggcattagctagttattagcctggtatcagacaaaaacngggaaacnccctaagctcctgatctatgctcgcctccactttgactaaaggtcgggtccatcaaggtcagcggcagtgatcgtggacagtatttcactctacacatcgagacagtcctgcacgtcctagaagtntttcgacttaacgttatactcgtaacaacgtagtactttaattacgttactctactacgttcggacggacggtaaccgtaagggtacgaagtacgttaaccgaaacggtaacgtggtacgtcgtacgacgtaacctagttccgttacgttcttaccgtacttcccttcccgactaacgttcctaggtaacgg

SEQ ID NO: 10649 - DNA, 591 bp, Homo sapiens
  misc_feature: GYAE6OF02I84UV.38.6.A06.1.454.CMB.1.raw
  modified_base (237)..(237): a, c, t, g, unknown or other
  misc_feature (237)..(237): n is a, c, g, or t
  modified_base (243)..(243): a, c, t, g, unknown or other
  misc_feature (243)..(243): n is a, c, g, or t
  modified_base (365)..(365): a, c, t, g, unknown or other
  misc_feature (365)..(365): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaacnggaacnccctaagctcctagatctatgctgcctcctactttgactaagtcgggtccatcgaaggtcagcggcagtgatcgtaggactagtattcactctcacatcagcagcctgacacgctagaagtntttagacttaacgtttatactcgtacaactacgtactttaaattagttacttctacgttaccgtttacgggacgggtacggtaaccgtaaggtcgtaagtacttaaccgaaaacggtactaggttacggtacgtacgtacctaccgtacgttccttcggttaccctttacgtaacctttcccgtttaccccgtaccttaccttaccgttacgtaaccggttaccgg

SEQ ID NO: 10650 - DNA, 580 bp, Homo sapiens
  misc_feature: GYAE6OF02I6CQN.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttattagcctggtatcagcaaaaaccagggaaacgccctaagctcctgatctatgctcgcctccactttgacaaggtcgggtccagtccaaggttcaggcggcaggtggatcgtgggacaggtatttcactctcaccatcagcagctgcgagctagtaacgtatttcgctaaactttattacctgtacactaagtactttaaagtagttactcttacgtacgtttccgggacggtacggaaccgagggttacgaaacgtcgtaaactaaaaccggagttcggtacggctaacgtccgaacttactccgttgtacctttacgtactttaccctcccgtacgtacttacgtacgtaaccggttatacgtccgtaacgtgtaccgggg

SEQ ID NO: 10651 - DNA, 533 bp, Homo sapiens
  misc_feature: GYAE6OF02GLAEO.38.6.A06.1.454.CMB.1.raw
  modified_base (225)..(225): a, c, t, g, unknown or other
  misc_feature (225)..(225): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagacaaaaaaccngggaaacgcccctaagcctcctgatctatgctcgcctccactttgctaaaggtcggggtcccatcgaaggttcaggcggcaggtgactcgtgggacagtatttcactctcacctatcagcagcctgcagcctaggaacgtattttcgactaacttatactgtactaacagtactttaatagttactctcttacgtttcgggacggacggtactaaggtcgaagtataccgaaacgacgtggtcgtctgacactatctgtccttcacttcctcccgctacttctacgtacgtgactcgacgtggtacgg

SEQ ID NO: 10652 - DNA, 612 bp, Homo sapiens
  misc_feature: GYAE6OF02JXC1I.38.6.A06.1.454.CMB.1.raw
  modified_base (230)..(230): a, c, t, g, unknown or other
  misc_feature (230)..(230): n is a, c, g, or t
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (295)..(295): a, c, t, g, unknown or other
  misc_feature (295)..(295): n is a, c, g, or t
  modified_base (307)..(307): a, c, t, g, unknown or other
  misc_feature (307)..(307): n is a, c, g, or t
tcagtcgatcacgtcacgaccggtgctcgatttagatctactgacagggaggatggagactgggtcccgctcagctcctgggctcctgctgctctggctcccaggtgccagatgtgccatccagttgacccagtctccatcctccctgtctgcatctgtaggagacagagtcaccatcacttgccggcagtcaggcattgcagttattagcctggtatcagacaaaacgngggaacnccctaagcctcngatcatgctcgcctcactttgctaaaggtcggtccatcacggttcngcggcaggtggntacgtgggacagtacttcgacttcgtaccacatcaacgtcgaacgtcccaggaccacgtccgtagtaacgtacttttaggactaaacgtttagttacttacgacgtaaactagtacttaaacgtttatttaacgtcctattaccggtttccggaaacggtacgggtaccctaaagggtctaacgtacttaaacgaaacgtaacgtgtacgtacgacggtactaaccctaggttaacctttcggtactttaccgactttacccggttacccacgttacccctttaggttaaccggtagttaaccgg

SEQ ID NO: 10653 - DNA, 634 bp, Homo sapiens
  misc_feature: GYAE6OF02H97JG.38.6.A06.1.454.CMB.1.raw
  modified_base (227)..(227): a, c, t, g, unknown or other
  misc_feature (227)..(227): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagctagttatttagcctggtatcaagacaaaaaccgnggaaacgccctaagctcctgatctatgctgcctccactttgactaaaggtcgggtacccagtacgtaaggtttcaaggccggactagtggacttcgtggggactagtacttcgactctacaccatcagcagctgctagcctagagtattttcgactaacttagtttactcgttacaaacgtagtactttaagtaacgtttacttaccttaccgttaaccgttttcggggacgggtaacgggtaaccccgttaaagggtccggtaagtaaccgttaaacgaaaaccgtacgttaggttacggacttcggacctaaccttagttccttacggttaccttacacgtttcccgtcccggtaacctacgttcctaggtaaccgttagtccgtttacgtacgtggtaaccggg

SEQ ID NO: 10654 - DNA, 590 bp, Homo sapiens
  misc_feature: GYAE6OF02I75DL.38.6.A06.1.454.CMB.1.raw
  modified_base (165)..(165): a, c, t, g, unknown or other
  misc_feature (165)..(165): n is a, c, g, or t
  modified_base (244)..(244): a, c, t, g, unknown or other
  misc_feature (244)..(244): n is a, c, g, or t
  modified_base (379)..(379): a, c, t, g, unknown or other
  misc_feature (379)..(379): n is a, c, g, or t
tcagtcgatcacgtcacgaccggtgctcgatttagatctactgacagggaggatggagactgggtccccgctcagctcctggggctcctgctgctctggctcccaggtgccagatgtgccacccagttgacccagtctccatcctcctgtctgcatctgtagganacagagtcaccatcacttgccggccagtcagggcattagctagttatttagcctggtatcagacaaaaaccagggaacncccctaagctcctgatctatgctcgcctacctactttgacaaaggtcgggtcccatcgaagttcagcgacaggtgatcgtagggactagtactttcactctcactatacagctagcctgactagcctagtaagtnttttacgacttaacgttattactgtacaacgtagtactttaagttacgttacttcctacttacgtttcgggaccgggtaacggtaccgtaacggtacgaacgtactaaccgtaaacgtacgttagtacggtactacggacctacgtaagttccgttacgtcctttacactttcccgttacccgtctacttaccgtacgtaacgtgtaaccg

SEQ ID NO: 10655 - DNA, 610 bp, Homo sapiens
  misc_feature: GYAE6OF02IKEF9.38.6.A06.1.454.CMB.1.raw
  modified_base (244)..(244): a, c, t, g, unknown or other
  misc_feature (244)..(244): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctcctgtctgcatctgtaggagacagagtcaccatcacttgccggcagtcagggcattagctagttatttagcctggtatcagacaaaaaccgagggaacnccctaagctcctgatctatgctcgcctctattgactaaggtcgggtaccatacgtaggttcagcggcagtcgatcgtaggacagtacttctactcctacactatacagaccacgtccgtcgacacggtacctaggtaacgtttattttacgaacttaaactttacgtttaaccgtacgtaacctaaacgtagttaactttaaattagttacttacttaccgttacgtttacggggacggtacgggtaaccgtaaggtacgaagtaacttaacgaaacggtaagttacggtcgtaccgtacgacgtacctgttaccttcgttaccttacgtactttcccgtccgtacttacgtcgtacgtacgtacg

SEQ ID NO: 10656 - DNA, 567 bp, Homo sapiens
  misc_feature: GYAE6OF02H0XJX.38.6.A06.1.454.CMB.1.raw
  modified_base (338)..(338): a, c, t, g, unknown or other
  misc_feature (338)..(338): n is a, c, g, or t
  modified_base (547)..(547): a, c, t, g, unknown or other
  misc_feature (547)..(547): n is a, c, g, or t
  modified_base (560)..(560): a, c, t, g, unknown or other
  misc_feature (560)..(560): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccggccagtcagggcattagctagttattagcctggtatcagacaaaaaccaggaacgaccctaagctcctgatctatgctgcctctacttgacgtaacggtcgggtccatcaaggttcaggcgcgacgtgactcgtggacagtattcgactcgtacacctatccanccagctgacacggtacctaaggtaatacttttgacctaacgtttaacttatacgtactaacgaacgtacttaaattattacttcttacgtacgtttacggacggtacggacgtaaggtacgaagtataaccaaacgtacgtggtcggacttacgactaccgtagtctacgtcttactactaccgttcccaccgtactacgtctaacgtntacgtacgtacgnggtacgg

SEQ ID NO: 10657 - DNA, 601 bp, Homo sapiens
  misc_feature: GYAE6OF02JZS2I.38.6.A06.1.454.CMB.1.raw
  modified_base (221)..(221): a, c, t, g, unknown or other
  misc_feature (221)..(221): n is a, c, g, or t
  modified_base (229)..(229): a, c, t, g, unknown or other
  misc_feature (229)..(229): n is a, c, g, or t
  modified_base (361)..(361): a, c, t, g, unknown or other
  misc_feature (361)..(361): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttattagcctggtatcagcaaaaacngggaaacncccctaagctctgatctatgctgcctcactttgacaagtcggccatcgaaggttcagcggcagtggatcgtgggactaggtatttccacgttctacacctaagtcacggtcacgccctggactgaccgttanaaggttacttttcgaactactttactacttagtaccaactagtaactttaagttacgttactacgttcgtaccgtttacggacgggtaacgggaactaacggtaccgggataacgttaacgaaacggtaccgttaaggtcggtaccttagaccgtacgtacgttacttcgtacctttcactttaccggtcccctaccgtattcctacggtaaccgtcgtacctacgttacggcgtaacgg

SEQ ID NO: 10658 - DNA, 833 bp, Homo sapiens
  misc_feature: GYAE6OF02IZP3O.38.6.A06.1.454.CMB.1.raw
tcagtcgatcacgtcacgaccggtgctcgatttagatctactgacagggaggatggacatggacgggtccccgctcagctccgtggggctcctgctgctctggctcccgaggtgccagatgtcgccatccagttcgacccagtcctccactccctccctgtctgcatctgtaggagacagacgtcaccatccacgttcggcccgggccagtcgagggctagttacgactagtttatttacgccgtaggttactacgaacgaaaccgtaaaaaaccggaacggggaaaaccgtacccccgtaaaggccttaccgtagtaacttaccttaagtcgtcctacgtccccttcccttaacgttttacggaacgtaaacgggttccgggtaccctaagtaccggtaacggttccgacggcggacgtaggttggacgtcgtacgggaactaggttactttaccaccgttcctaccaacctacttacgacgtaccgaccgtcctacggaccgtacggtcctttaaggtaaacgttttagtttttaccggaaacctttaaactttttaaccgtttaacgttacggtaaacctaaacgttaacgttaacgtttttaaagtttaacggtttaccttaccgtttacccgtttaaccgggtttaccggggaaccgggtaacgggttaaacccggttaaacgggttacgtaagttaaccctaaacggtaaaaccggtacgtttacgggaccgtacgtaccgaacctaccgttaacgttccctttaggttccttaaccgtaccgttttcccctaccccggtatttacggttacctaacggttaaccgg

SEQ ID NO: 10659 - DNA, 606 bp, Homo sapiens
  misc_feature: GYAE6OF02G8QTG.38.6.A06.1.454.CMB.1.raw
  modified_base (224)..(224): a, c, t, g, unknown or other
  misc_feature (224)..(224): n is a, c, g, or t
  modified_base (231)..(231): a, c, t, g, unknown or other
  misc_feature (231)..(231): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagacaaaaaccngggaaancccctaagctcctgatctatgctgcctccactttgacaaggtcggggtcccatcaaggttcagcggcaggtggatcgtgggacagtactttcactctcaccatcagcacgcctgcacgcctaggaagtatttttcgaccttaacgtttaattacctagttaccaacgtacgtacttaaattacgttactccttacgttacgtttacgggtacggtaacgggtaaccgtaagggtcgtaacgtacgtaaccgtaaacggtaacgttcggtacggtccttacgacctaacctacgttaccgttcgttacttccgtacttcccttcccgtacctacttaccgtacgtaccggttacgtacgtccggtacgtgtacggg

SEQ ID NO: 10660 - DNA, 725 bp, Homo sapiens
  misc_feature: GYAE6OF02H1ALQ.38.6.A06.1.454.CMB.1.raw
tcagtcgatcacgtcacgaccggtgctcgatttagatctactgacagggaggatggagactgggtcccgctcagctcctggggctcctgctgctctggctcccaggtcgccagatgtgccatccagttcgacccagtcctccatccctccctgtcctgcatctaggtaggagacagacgtcaccatccacttggccgggaccaggtcagggcagttacgctagtttattacgcctggtactccgaagaccaaaaaacgcgggaacgtacccctaaggccttaccgtaggtactacgtaactcgtacctcgacccttacctacgtttacgaacgtaaaggtccgggtacctacgtacgtaacgtacgacggacggtacaaggttcggacttccggtagggaactaacggttacttttaacccgacgttacctaccggaacctacgtaccgacggactaccgtaccgtcgacgtacggtaccgtaaggtaacgtttacgtttacgtactaaacgtttacgttacgtacgtaactaacgtagtacgtttaaattacgttactacgttacgtaccgttaacgggacgggtaccggaacgttaggtacgtacgaacgttaacgaaacgttacgtacggtactaccgtagtacctacgtactttaccggtcttaccgttactcgtttaccccgtccttaccgttacgttacgttacccggtagttaaccgg

SEQ ID NO: 10661 - DNA, 649 bp, Homo sapiens
  misc_feature: GYAE6OF02HM2NU.38.6.A06.1.454.CMB.1.raw
  modified_base (222)..(222): a, c, t, g, unknown or other
  misc_feature (222)..(222): n is a, c, g, or t
  modified_base (230)..(230): a, c, t, g, unknown or other
  misc_feature (230)..(230): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccggcagtcagggcattagctagttattagcctggtatcagacaaaaaccngggaaacnccctaagctcctgatctatgctcgcctcctactttgacaaagtcggggtacccatacaaggttcagcgcagtggatcgtaggacagtatttcactctacacatcagtcacgctacgcacgtccgtagtaaggtactttttacgaccttaactttacgttactacgttacaacgtacgttactttaaacgttagtttacttacttaccgttaccggtttaccgggacgggtaacgggtaaccgtaacggtacgtaacgtaacgttaaccgaaacgtaaccgttagggtaccgtacgttacggtaaccctaaccgttaacttacgttcgtttaccgtttacctaaccgttcccgtttcccgaccgttaaccgttcgttaacggtaccgttacggtacgttaccgtacggttggtaaccggg

SEQ ID NO: 10662 - DNA, 681 bp, Homo sapiens
  misc_feature: GYAE6OF02IRQCY.38.6.A06.1.454.CMB.1.raw
  modified_base (269)..(269): a, c, t, g, unknown or other
  misc_feature (269)..(269): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagctaagttattagcctggtatcgaagacaaaaaccgagggaaacgacccctaagctcctgactntaactgctgcctcgtacttgacgtaaagtcggggtacccaagtccgaaaggttcacggtcgggacacggttaggacttcgtagggaactagtactttcaaccttctacaccctaagtccgaagtcaacgcctagaccgagtacctagggtaaactagtttttacgaccttaaacttacttaacgtaggtaactaaacgtaacgttacttaaacgttagtttaactcgtacttacggtttcgggaccgggaacggtaaccggaagggttaccgaaaggtaacgttaaccgaaaaggtaacgtacgtacgggacttagacccgtaacctaaagttccgttacgttacgttaccgttaacccgtttcccgttaccccgttaacctagtttaccgttacggtaaacgttaaccggg

SEQ ID NO: 10663 - DNA, 525 bp, Homo sapiens
  misc_feature: GYAE6OF02HLUIF.38.6.A06.1.454.CMB.1.raw
  modified_base (224)..(224): a, c, t, g, unknown or other
  misc_feature (224)..(224): n is a, c, g, or t
  modified_base (232)..(232): a, c, t, g, unknown or other
  misc_feature (232)..(232): n is a, c, g, or t
  modified_base (301)..(301): a, c, t, g, unknown or other
  misc_feature (301)..(301): n is a, c, g, or t
  modified_base (458)..(458): a, c, t, g, unknown or other
  misc_feature (458)..(458): n is a, c, g, or t
  modified_base (471)..(471): a, c, t, g, unknown or other
  misc_feature (471)..(471): n is a, c, g, or t
  modified_base (501)..(502): a, c, t, g, unknown or other
  misc_feature (501)..(502): n is a, c, g, or t
  modified_base (519)..(519): a, c, t, g, unknown or other
  misc_feature (519)..(519): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatccctccctgtctgcatctgtaggagacagagtcaccatcacttgccgggcagtcagggcatagcagttatttagcctggtatcagacaaaaaacgngggaaacnccctaagctcctagatctatcgctgcctcactttgactaaagtcgggtccatctaaggttcaggccggnagtggactcgtgggaacagactttcgacttcaccaacctatcgacgctaggccctgcagtccgtaggaaactgtttttcgaactaaactttacgttaactgttaacaactagtacttaagtgttaactctacttacgttcggacggaggacagcganatacaaagactgngctgacatatctctctcattcctccgactnntcgactgtaactcgtanggacgg

SEQ ID NO: 10664 - DNA, 754 bp, Homo sapiens
  misc_feature: GYAE6OF02IYQ3A.38.6.A06.1.454.CMB.1.raw
tcagtcgatcacgtcacgaccggtgctcgatttagatctactgacagggaggatggagactgggtcaactggatggcacatctggctcccacggtgccagatgtgccatccagttgacccagtctccactcctccctgtctgcatctgtaggagacagagtcaccatcacttgccgggccagtcgacgggcattagctagttattagccttggtatcagaccaaaaaccaggggaaactacccgtaacgtcctcctagtatctatcgactcgcctcctaacttttgacgtaaacggtcggggtccccaagttaccgtaaggttacgacggccggtacgaggttggaacgttccgtagggacgtaagttactttccgaactccgtaccactaactccgaacgtcgacgtacctcggactaccgtacccgtaggtaaacgtttacgtttttacgaacttaacgtttaacgtttacctagttaccgaaactacggttactttaaacgttaatttaacctcccgtttagttaccggttttaccgggggacgggaaaccgggttaaccggttaaacgggtacggaacgttaacgtaaaccggttaaaaccgtaaggttgtaccggggtaacctccgtaaccgtaacgtaacctttgttaccggttctttacccgtaagtttacccccgttcctaccgttaacctttacggtaccgttacgggttaccgtacgtcccggtaacgttcgggtaacccgggg

SEQ ID NO: 10665 - DNA, 681 bp, Homo sapiens
  misc_feature: GYAE6OF02IRWCW.38.6.A06.1.454.CMB.1.raw
  modified_base (244)..(244): a, c, t, g, unknown or other
  misc_feature (244)..(244): n is a, c, g, or t
  modified_base (432)..(432): a, c, t, g, unknown or other
  misc_feature (432)..(432): n is a, c, g, or t
tcagtcgatcacgtcacgaccggtgctcgatttagatctactgacagggaggatggagactgggtcccgctcagctcctggggctcctgctgctctggctcccaggtgccagatgtgccatccagttgacccagtctccactcctcctgtctgcatctgtaggagacagagtcaccatcacttgccgggcagtcagggcattagctagttattacgcctggtatacagacaaaacagggaaacnccctaagctctagactctatacgctcgcctactacgtttcggacgtaaaggttcgggtacccctagtaccgtaacgggttcacggtccggatacggtggacttcggtagggactaggtactttcgaacttctaccacgtactcgaacgtccacgtaccctgaccgtacgtaccgttaggtaaacgttnttttaacggaccctttaaacgtttacgttaccgttacgtaacctaaacgttacggttacttttaaaacgttcgtttaacttaccttacgttacgtttaccgggaacgggtaacggtaacctaggggtaccaagttaccgtaaacgtaacggtaacgttcggacggttacgaccgtaaccgtacggtaacttcggtacgttaacctaccgtacgttacccgtccctacttcgttactacggtaaccgtcg

SEQ ID NO: 10666 - DNA, 642 bp, Homo sapiens
  misc_feature: GYAE6OF02JX3GP.38.6.A06.1.454.CMB.1.raw
  modified_base (168)..(168): a, c, t, g, unknown or other
  misc_feature (168)..(168): n is a, c, g, or t
tcagtcgatcacgtcacgaccggtgctcgatttagatctactgacagggaggagtggacatgagggtccccgctcagctcctggggctcctgctgctctggctcccaggtgccgagatgtgccatccagttgacccagtctccatcctccctgtctgcatctgtaggngacagagtcaccatccacttcgccgggccaggtccagggcattgcagttattacgcctggtatcagactaaaaccgaaggaacgacccctaagtctaccgtagtactaccttaatgcctcgtaccctcgtaacttgacgtaaagtcgggtaccccatacgtaacggttcacggtcggatcggtaggtactcgtaggggactacgtacttcgactctacgaacctagtccagccgtacgtccgtcgactacgtaccgtagacgttatttacgacttaactttaacttactacgtactaacagttacttaacgtaattacttacttactacgttttcgggaccgtaacggtaccgaaggttaccgtagaattaacgtaaacgaacgttcgggtacggtagaccgtacgtaaccgtacttcgttacttaccttacgtactttcccgtacccgtaccctaagttccgtattaaccggg

SEQ ID NO: 10667 - DNA, 804 bp, Homo sapiens
  misc_feature: GYAE6OF02HVICT.38.6.A06.1.454.CMB.1.raw
  modified_base (228)..(228): a, c, t, g, unknown or other
  misc_feature (228)..(228): n is a, c, g, or t
  modified_base (236)..(236): a, c, t, g, unknown or other
  misc_feature (236)..(236): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttcgccgggcagtcgagggcattagctagtttattagccttggtatcagacaaaaaccgngggaaacnccctaagctctgatctatgctcgcctctactttgacgtaaaggtcggggtacccaagttacgtaacggttcgaaggccggtactaggtaggacttcgtaggggactagtactttcgaccttctaccactactcgaagccaacgtcctacggacctagtacccgtaggtaacgttagtttttcgaacctttaaacgtttacttaaccgttacgtaacctaaacgttaacgttacgttttaaaacgttaacggtttacttacccgttaaccggtttaacccggtttttaccgggggaaccggggttaaaccggggtaaaaccgtaacggggtttacccgaaaaggttaaaccgttaaaacccggtaaaacccggtttaacgttacgggggttaacccgggttacttaacccggggtaaacccttacccggttaacgtttccgttacccgggttacctttttacccggtaaccgtttcccccggtaaccccgtacgttaaacccgttcggtttaaacgggtacccggttaagtttaccgggacccggtttaccgggacgggtaacccgggg

SEQ ID NO: 10668 - DNA, 878 bp, Homo sapiens
  misc_feature: GYAE6OF02IT66A.38.6.A06.1.454.CMB.1.raw
  modified_base (166)..(166): a, c, t, g, unknown or other
  misc_feature (166)..(166): n is a, c, g, or t
tcagtcgatcacgtcacgaccggtgctcgatttagatctactgacagggaggatggacatgagggtccccgctcagctcctgggctcctgctgctctggctcccaggtgccagtatgtgccatccagttgacccagtctccatccctcctgtctgcatctgtaganacagagtcaccatcgacgttcggccggccagtcgagggctagttagctagttattacgccgtgtatacgagaacgaaaaaccgaggaaaccgtaccctaagtccttaccgttaggacttacctaagtcgcttacgcccttccgtaacgtttcgacgtaaagggttccgggtacccctaagtaccgtaacggttaccgacggtaccggacgtaagggttacggtaacgttaccgggtaggggtaaccgtaacggtttaaccttttacccgaacctttacccgttaacctaaaccccgtaacgttacccgaaccggtacccgtaaccggttcccgttaacgggaccgtaaccggtacccgttaagtaaacgtttacgttttaacggaacctttaaaaccgttttacgttaaccggttacggttaaacctaaaccggttacgtttaaaccgttttaaacgttaacggtttaaccttaccgtttaacccgttaaccgggttttaccggggaaccggggttaaaccgggtaaccgttaacggttaaccggtaacgttaaccgttaaaccggaaaacggttacgtttacgggtaccggtaccgttaccgtaaccgttaaccccgttatttaccgggttaccgtttacccgtttacccgttaacccgtttccccgttaacccggttaccctaacgtttaccggttaccgttaaaccggg

SEQ ID NO: 10669 - DNA, 560 bp, Homo sapiens
  misc_feature: GYAE6OF02FUDN0.38.6.A06.1.454.CMB.1.raw
  modified_base (244)..(244): a, c, t, g, unknown or other
  misc_feature (244)..(244): n is a, c, g, or t
  modified_base (327)..(327): a, c, t, g, unknown or other
  misc_feature (327)..(327): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctcctgtctgcatctgtaggagacagagtcaccatcacttggccgggcagtcagggcattagctagttattagcctggtatcagacaaaaacgaggaacnccctaagctctgatctatgctgcctctacttgacaaggttcgggcccatcgtaaggttcacgcgcagtggatcgaggacagtntttcacttctcactatcgagcgacgcctgccagtccgtagaacgttacttttcgacttaacttacttactacgtacaacgttacgttactttaaattagttactcttacgtacgttcggacgggacggtaccgtaagggtacgagtaactaacgaaacgtacgtcgtacgctcgacgtacctattccgtagtaccttagtaccttccgttacccgactacttaccgagtaacg

SEQ ID NO: 10670 - DNA, 667 bp, Homo sapiens
  misc_feature: GYAE6OF02GCY3G.38.6.A06.1.454.CMB.1.raw
  modified_base (166)..(166): a, c, t, g, unknown or other
  misc_feature (166)..(166): n is a, c, g, or t
  modified_base (252)..(252): a, c, t, g, unknown or other
  misc_feature (252)..(252): n is a, c, g, or t
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
  modified_base (289)..(289): a, c, t, g, unknown or other
  misc_feature (289)..(289): n is a, c, g, or t
  modified_base (319)..(319): a, c, t, g, unknown or other
  misc_feature (319)..(319): n is a, c, g, or t
  modified_base (428)..(428): a, c, t, g, unknown or other
  misc_feature (428)..(428): n is a, c, g, or t
tcagtcgatcacgtcacgaccggtgctcgatttagatctactgacagggagggatggagactgggtcccgctcagctcctggggctcctgctgctctggctcccaggtgccagatgtgccatccagttcgacccagtctccatcctcctgtctgcatctgtagganacagtacgtcaccatcgacttcgccgggaccagtcgagggcctattacggctagtttactttagcctggtatcacgacaaaaaccngggaacnccctaagctctgatcangctgcctcagttnacaagtcgggccagtccaagttcagacggntagtgactgtagggacagtaacttcgactcctacacgatcgacgttcacgcctaggtcacgggacctaggaaacgttgttttcggaaccttaacgtttactaacggttntaacctaaagtaccgttactttaaacgttaggttaacttacccgttactaaaccggttttccggggacggggtaaaccggtacgttaacgggtcctaaaggtacgttaaccaaacgggttaagtcggtaggtacccgtaggaaccttccggaacttaccggttccggttaccttaaccctacgtttcccccgttaacccgtaccgtttaccgtaaccggtttacggaaaccccgtttgg

SEQ ID NO: 10671 - DNA, 641 bp, Homo sapiens
  misc_feature: GYAE6OF02G04HF.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccatccctccctgtctgcatctgtaggagacagagtcacatcacttgccgggccagtcagggcattagctagttatttacgctggtatcgagaacaaaaaaccgagggaaacgcccctaaagcctacctagatctatgcctcgccctctactttgacgtaaaggtcgggtacccatcgtaaggttcacggcggactaggtaggtatcgtagggactagtactttacactctacaccatcagcagtccgtgaccacgtacctaggtaaacgtttacgttttacgaaccttaaactttaacttaccgttacgtaaccgaaacttaacgtaactttaaagttaacttagttaccttacgttacggtttacggggacgggtaacgaaccgtaaggggtaccaagttaacgtaacgtaaacgtaacgtcgtacggtactaggacctaactgttccgttagtaccttcgtaacgttccccttacccgacgtacttaccgtagtaacgg

SEQ ID NO: 10672 - DNA, 552 bp, Homo sapiens
  misc_feature: GYAE6OF02FJ513.38.6.A06.1.454.CMB.1.raw
  modified_base (235)..(235): a, c, t, g, unknown or other
  misc_feature (235)..(235): n is a, c, g, or t
  modified_base (242)..(242): a, c, t, g, unknown or other
  misc_feature (242)..(242): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagcaaaaccngggaaancccctaagctcctgatctatgctgcctccactttgcaagtggtccatcaaggttcagcgcagtggatctgggacagtatttcactctcaccatcagcagcctgcagcctagaagtattttcgactaacttattactgtacaacagtacttaatagtttatcctactacgtttcgggacgggtacgggtaaccaaggtacgaagtaactaccgaaaaccgtaacttaggtacggtctacgaccaccgtaatcctacgttccttaccacgttccttaccccgacctacgttaccttacggtaaccgttacgg

SEQ ID NO: 10673 - DNA, 1082 bp, Homo sapiens
  misc_feature: GYAE6OF02GJY78.38.6.A06.1.454.CMB.1.raw
  modified_base (245)..(245): a, c, t, g, unknown or other
  misc_feature (245)..(245): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctcctgtctgcatctgtaggagacagagtcacatcacgttgccggccagtcgagggctattagctagtttattagcctggtatcagacaaaacgaggaaacnccctaagctcctgatctatcgctacgccctacctactttaggaccgtaaaggttccggggtacccctaaggttaccgtaaacgggtttccgaacgggtccgggtaccgtagggttacggggtaaccgtttccgggtaacgggggtaaccgttaagggtttaaccttttacccggtaaacccgtttcccctttaacccgggtaaacccctaacgtttacccggtaaaacggaccccgttaaccgggtaccccgtttacggggacccgtaaacccgggttaccccggggttaaagggtttaaaacgggttttaaccggtttttttaacggaaacccctttttaaaacccgtttttaaacccggttttaacccgttttaaccggggtaaaaccctaaaacccggttaaacggttttaaaccccgtttttttaaaaagggttaaaccggtttttttaaccctttaaccccgtttttaaacccgggttttaaccgggttttttaaccccgggggggaaacccggggggttaaacccggggggggttaaaaacccccgtttaaaaccggggggggtttttaacccgggtaaaacgggtttaaaacccgtttaaaacccccggggttaaaaaaacccgggtttaaacccgggttttaaccggggtttaacccggggttaacccgttacccggggttaacccttaacccgggttaaccgttttaacccggtttaaccggttttacccgttttaaccccgttaacgtttttaccccccggttttacccccgtacccgttttaaccggttttaccccgggttacggtaaacccgggttttacccggg

SEQ ID NO: 10674 - DNA, 816 bp, Homo sapiens
  misc_feature: GYAE6OF02FVZWN.38.6.A06.1.454.CMB.1.raw
tcagtcgatcacgtcacgaccggtgctcgatttagatctactgacagggaggatggagactgggtccccgctcagctccgtgggctcctgctgctcgtggcctcccgaggtcgccagatgtcgccatcctagttcgacccagtcctccatccctccgtgtctgcatctggtaggagacagacgtaccacatctacgttcggccgggcctagtcgagggctagttacgactaagtttagtttacgccgttaggtactacgaacgaaacctaaaaaaccggaggggtaaaccgtaccccgtaaacgtccttaccgtagtacttacttacgtcgcgtaccgtcccttacctacgttttacgaacgtaaacgggttccgggtaccctaagttaccggtaacggttccgaacgggtccgggacgtagggtacggttacgtacggtacgggtaactacgttacttaccgtaccttccgtacctaaccgtacgttaccgaacgtaccgtaacgtccgttacgaccgtaacgtaccgttaagttaacggtttactttacgaacctttaaacgttttaacgttaccgttacgtaaacctaacggtaacgttaaacgttttaaacgttacgtttaaaccttccttaacggttttaccggtttaccggggaacgggttaaaccggtaaccgttagggtaacccgaaagttaacctaaaccgaaaccgtacgttacggtacgtctacgacctaaccggtcttaccgttacgtttacctacgttaccttacccgtacccgtaccttaggtaccgtaagtaccggtaccg

SEQ ID NO: 10675 - DNA, 613 bp, Homo sapiens
  misc_feature: GYAE6OF02GID13.38.6.A06.1.454.CMB.1.raw
  modified_base (241)..(241): a, c, t, g, unknown or other
  misc_feature (241)..(241): n is a, c, g, or t
  modified_base (249)..(249): a, c, t, g, unknown or other
  misc_feature (249)..(249): n is a, c, g, or t
tcagtcgatcacgtcacgaccggtgctcgatttagatctactgacagggaggatggagacctgggtccccgctcagctcctggggctcctgctgctctggtctcccaggtgcctaggatgtgccatccagttgacccagtctccatcctccctgtctgcatctgtaggagacagactcaccgatcacttggccggcagtcagggcattagcagttattagcctggtatcagacaaaaccgnggtaaacnccccgtaagctcctagatctatcgctcgccctccacgtttcgacaaggtcgggtacccatccgaaggttccaggtccgacaggttggaactcggtagggaactaggtactttccacgttacctactaacccattcgacgacgtacggacctggaccaggtccgtaagtaacgttattttcgacttaacttacttacgtacgtacaacgtgtactttaagtagttactcgtactacgtttacgggacggtacggacctacgggtacgagtacgtaaccaaacgtactacggtcgactacgcctaccgtgttacctcgttccttccgaatttcccgtaccgtcctacgtccggtacgacgttacgg

SEQ ID NO: 10676 - DNA, 673 bp, Homo sapiens
  misc_feature: GYAE6OF02FKZD9.38.6.A06.1.454.CMB.1.raw
  modified_base (179)..(179): a, c, t, g, unknown or other
  misc_feature (179)..(179): n is a, c, g, or t
  modified_base (257)..(257): a, c, t, g, unknown or other
  misc_feature (257)..(257): n is a, c, g, or t
  modified_base (273)..(273): a, c, t, g, unknown or other
  misc_feature (273)..(273): n is a, c, g, or t
  modified_base (288)..(288): a, c, t, g, unknown or other
  misc_feature (288)..(288): n is a, c, g, or t
tcagtcgatcacgtcacgaccggtgctcgatttagatctactgacagggaggatggacatgagggtcccccgcgtcagctccgtggggctcctgctgctctggctcccgaggtgcctagattgtgccatccagttgaccctagtcctccactcccgtccctgtctgcatcgtgtagganacgagagtccacctatccacgttggcccgggacctagtcgagggctagttagctagttattacgccttggtatcgaanacaaaaacgaggaacnccccgtaagcctacngacttcgtatcggctcgtcctccgtacgtttgacgtaaacggtccggtaccctagtcgtaggttcgagtccgactacggtcgactcggtacggacgtaggtcttacgacgttctaccgtaccgtatacgacaccgacgtcccgtagaccgtacgtcgtagtaagttacgttttacgaacctttaattacgttactacgtaacctaacgtagttaacttaacgttacgttactcgttacgtacgttccgggacggacggtaccgtaacggtaccgaagtactaaccgaacgtacgtgtaccgtacgtccgtaacgtaccgtacggttaccgtcgttaccgtttacctacttcccggttaaccgtcctacgttacgtacgtaaccgg

SEQ ID NO: 10677 - DNA, 749 bp, Homo sapiens
  misc_feature: GYAE6OF02H0VBL.38.6.A06.1.454.CMB.1.raw
  modified_base (235)..(235): a, c, t, g, unknown or other
  misc_feature (235)..(235): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatccctcctgtctgcatctgtaggagacagagtcaccatccacgttcggccgggccaggtcagggctattagctagtttattagccttggtacncagaacaaaaacgaggaaaccgccctaagctctgatctatgctcgccctactactttgacgtaaggtcgggtacccagtacgaaggttcgacggcgacgtaggtggctacggtaggacctagttactttaccaaccgttcctaccgaacctagttaccaacgacctaacggtcccgttaggacccgtaacgtcccgttaaggtaaacgtttacgtttttacggaacctttaaacgttttaacgttaacgttcgtaacctaaacttacggttaaacttttaaattacgtttaacttacctttaccggttccggttttacgggaaccgggtaaacggtaacccgtaaacgggttacgtaacgttaaacctaacggtaaaaaccggtacgtttacgggactacccggttacgacccgtaaacctttaccggttaccttacccgtttaccgtttacccgttaaccgtttacccccgttacccgtaccctttaacggttaccggtaccgttaaaccggg

SEQ ID NO: 10678 - DNA, 785 bp, Homo sapiens
  misc_feature: GYAE6OF02HWDLI.38.6.A06.1.454.CMB.1.raw
  modified_base (166)..(166): a, c, t, g, unknown or other
  misc_feature (166)..(166): n is a, c, g, or t
tcagtcgatcacgtcacgaccggtgctcgatttagatctactgacagggaggatggacatgagggtcccgctcagctcctggggctcctgctgctctggctcccaggtgccagatgtgccatccagttgacccagtctccatcctccctgtctgcatctgtagganacagagtcacatcacttggcccggcagtcagggctagttagctagtttattacgccgttaggttactacgaagaaccaaaaaacgaggggtaaaaccgaccctaaagcctaccgttagaacgtctaacgtcgactcgtacccttacctacgtttacgacgtaaacgggtccgggtaccctacgtacgtaaggttaccgacggacggtaccgtaaggtcggtacgttacggtacgggaacgtacgttaagtttacccgtaattccgtactaacctaagtacagtaaccgacgtcccgtacgaccgacgtaccgtaggtaacttagttttcgaactttaaacttacgttaacgtactaactaaacgtacgtttaaccgtttaaaagttactttaccgttacgttaaccgttaaccgggttccgggtaaccggggtaaaggtaccccgggtaagttaacccggtaaaggttaaccgtaaacccggtaaaaggttaacccgttagggtaccgttaccgggtaccctaccgggttaaccctagtttcccgttaaggtttaccctttaccgtacccgtttaccccggttaccccacggtttaacttcccggttaggttaaacccg

SEQ ID NO: 10679 - DNA, 674 bp, Homo sapiens
  misc_feature: GYAE6OF02HWRAL.38.6.A06.1.454.CMB.1.raw
  modified_base (251)..(251): a, c, t, g, unknown or other
  misc_feature (251)..(251): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcacatcacttgccgggccagtcgagggcattagctagttatttacgccttggtatcagaacaaaaacgagggaaacnccctaagcctcgtagatctatcgctcgtccctcctactttacgacgtaaaggttcgggtacccagtacgtaaggttcaggcggtagaggtggagttcgagggactagtactttcacttctaccactactcacgcacgtcccgtgacgtacgtcgtaggtaatttacgttttacgaaccttaatttaacgttaacgttcgtaactaaactacgttaacttttaaagtaacgtttacttacgttaccgtaccggttttacgggaccgggtaacggtaaccggtaacgggtacgaacggtacctaaaccggtaaacgtacggttcgggtacggtaccgttacgacccgtaaccgttcgtttaccgtacgtttacccttacgtaccgtttcccgtaccccgtacctacgttccgttaacgtaaccgg

SEQ ID NO: 10680 - DNA, 657 bp, Homo sapiens
  misc_feature: GYAE6OF02G09CK.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacgttcggccgggccagtcgagggctattacgctagtttattagcctggtactcgaagaccaaaaaccgagggaaacgcccctaaagccttccgtagacttctaatcgactcgccctcctactttgacgtaaaggtcgggtaccctagtcgaaggttcgaggcgcgaggtgagtcgtagggactacgtattacactctaccaactacgtcacgcgacgccgtagccacggtacctaggtaaacgttacgttttacgaaccttaaactttacgttaactacggttacaaacgtagttaaccgtttaaattacggttaacttccgtaccgtttaaccggtttccgggaccgggtaaacgggtaacccggaaggttacgaacgttaactaacgtaacggaacgttagtcggactacgactaccgtacttgttacgttccttacgtacgttccctaccgccttacgtacgtcgtaacgtcg

SEQ ID NO: 10681 - DNA, 641 bp, Homo sapiens
  misc_feature: GYAE6OF02GS4CR.38.6.A06.1.454.CMB.1.raw
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttagcctggtatcagacaaaaaccnggggaaacncccctaagctcctgatctatgctgcctccactttgcaaaggtggggtcccatcaaggttcaggcggcaggtgggatcgtgggactagtactttcactcctacaccatcagcagcctgcagcctgaagtattttcgactaactttattactgtacaaactagtactttaaattacgtttactcttaccgttacgtttcgggaccgggtaacggggtaacccgtaagggttaccggaacggtaacgtaaccgtaaaaccggtaaccgttgggtacgggtaccttacggaccctaaccgtacgtttccgtcggtttacctttaccgtaacgtttcccgtttaccccgtacccttaacgttccgttaacggttaaccggttacgtaacgttccggtacgttcggtaccgggg

SEQ ID NO: 10682 - DNA, 671 bp, Homo sapiens
  misc_feature: GYAE6OF02JAW21.38.6.A06.1.454.CMB.1.raw
  modified_base (195)..(195): a, c, t, g, unknown or other
  misc_feature (195)..(195): n is a, c, g, or t
  modified_base (230)..(230): a, c, t, g, unknown or other
  misc_feature (230)..(230): n is a, c, g, or t
  modified_base (238)..(238): a, c, t, g, unknown or other
  misc_feature (238)..(238): n is a, c, g, or t
  modified_base (250)..(250): a, c, t, g, unknown or other
  misc_feature (250)..(250): n is a, c, g, or t
  modified_base (331)..(331): a, c, t, g, unknown or other
  misc_feature (331)..(331): n is a, c, g, or t
  modified_base (347)..(347): a, c, t, g, unknown or other
  misc_feature (347)..(347): n is a, c, g, or t
  modified_base (355)..(355): a, c, t, g, unknown or other
  misc_feature (355)..(355): n is a, c, g, or t
  modified_base (359)..(359): a, c, t, g, unknown or other
  misc_feature (359)..(359): n is a, c, g, or t
tcagtcgatcacgtcacgaccggtgctcgatttagatctactgacagggaggatggagactgggtcaactggatggcacatctggctcccaggtgccagatgtgcccatccagttgacccagtctccatcctccctgtctgcatctggtaggagacagagtcaccatcacttgccgggccagtcagggcagttanctagttatttacgcctggtatcaagacaaaaacgngggaaacnccctaagctccngatctatggtctcgcctcctacgtttgacgaaaggtcgggttacccagtcgaaggttcaggcggacagtggatcgtggacngatttcactctacacntcagcgancctnactagtcctaggtaacgttatttacgacttaactttacgtacgttactaacgtaactacttacgtttaaactaagtttacctcgttacccttacggtttaccggacgggtaacgggtaccggtaacggtacggtaacggtaactaaccgtaaacggtaacgttacggttacggggcttaccgacccgtaacgtaacgtttccttacgttttccttaaccggttccttaaccccgtttttcccgacccgttacctttaaccgttaacggtacggtttacggtacttacccggtacggttacgggtaacccggg

SEQ ID NO: 10683 - DNA, 696 bp, Homo sapiens
  misc_feature: GYAE6OF02I4ZU0.38.6.A06.1.454.CMB.1.raw
tcagtcgatcacgtcacgaccggtgctcgatttagatctactgacaggggaggatggagactgggtccccgctcagctcctgggggctcctgctgctctggctcccaggtgccagatgtgccatccagttgacccagtctccatccctccctgtctgcatctggtaggagacagagtcaccatccacgttcggccgggccagtcgagggctattagctagtttattacgcctggtatcaagaaccaaaaccgagggaaacctaccccgtaagctcctagtactctatcgctcgtcctacctacttcgacgtaacggtcgggtacccagtacgtaaggttcgacggcggtacgaggtaggtacgtcggtacgggtactacgttacgttaccaccgttcctaccacctacgtaccacggtaccaacggtccctagtaccgtacggtaccgttaagtaacggtttacttttacgaactttaacgtttacttactacgtaactaacgtacgttaactttaagtttacttacgtccttacgtaccggtttacgggaccgggaacggtaaccgtacgggtagaacgttaacgaaccgtaaacggtacgtacggtacggtactcgacctaccgtcgttccgtaccgttaccttacgtacccgttccgttaccccgattaccggttactaccggtacgttaccg

SEQ ID NO: 10684 - DNA, 633 bp, Homo sapiens
  misc_feature: GYAE6OF02I09J2.38.6.A06.1.454.CMB.1.raw
  modified_base (249)..(249): a, c, t, g, unknown or other
  misc_feature (249)..(249): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctcctgtctgcatctgtaggagacagagtcaccatcacttcgccgggccagtcagggcattagctagttatttagcctggtatcagacaaaaaccgagggaaacncccctaagcctcctgatctatgctgccctcctactttgactaagtcggggtcccagtacaaggttcgaggccggacgtaggttggtactcgtgggactagtacttttccgaccttctacacctatcgaacgcacgtacccgtcgacgtaagtcccgtaagttacggtaatttttcgactttaaactttattaaccttcgtaacctaaacctagttaacctttaagttacgtttacttaccttaccgttacgtttccgggacgggtaaccgggtaccgaaagggttcgaacgtactaaaccgaaacgtaaaccgtggtacggtactgaccgtactacttcgtacgttccttactacgttccttcccgactacgttctagtaacgg

SEQ ID NO: 10685 - DNA, 627 bp, Homo sapiens
  misc_feature: GYAE6OF02HQ8DF.38.6.A06.1.454.CMB.1.raw
  modified_base (248)..(248): a, c, t, g, unknown or other
  misc_feature (248)..(248): n is a, c, g, or t
tcagtcgatcacgtcacgaccggtgctcgatttagatctactgacagggaggatggagactgggtccccgctcagctcctgggggctcctgctgctctggctcccaggtgccagatgtgccatccagttgacccagtctccatcctccctgtctgcatctgtaggagacagagtcaccatcacttgccgggccagtcagggcattagctagttattagcctggtatcagacaaaaaccgagggaaacncccctaagctcctgatctatgctcgcctcctactttgactaaaggtcggggtccatcgaaggttcaggcggcaggtggattcgtgggactagtattaccacttctcaacccatcgacgcgagtccctgaccacgacctagaacgttattttcgaccttaaactttattactgtactaaaccgtagttactttaaagttagtttacttccgttacttacgtttaccgggacggtaacggggtaccgtaaagggtcgaagtaactaaccgaaacggtaacgtgggtacgacgttacgacccgtaccgtaacgttccgtagttaccctttacgtacctttcccgtttacccgaccttacgttaccggttagtaacccgtcgg

SEQ ID NO: 10686 - DNA, 530 bp, Homo sapiens
  misc_feature: GYAE6OF02FRN4T.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggccagtcagggcattagcagttattagcctggtatcagacaaaaaccagggaaacgccctaagctcctgatctatgctgcctccactttgcaaaggtcgggtcccatcaaggttcagcgcagtggactcgtgggacagtacttcactctacacatcagcagcctgcagctagaagtattttgactaacttattactgtacaacagtacttaatagttatctctacgttcggacggtacggacgaaggtacgagtacgtaacaaacgtactggtcgtactacgctacgtcttactcgttcttactacgttcccttcccgacctactcgtacggtacgtacgg

SEQ ID NO: 10687 - DNA, 514 bp, Homo sapiens
  misc_feature: GYAE6OF02F3HD6.38.6.A06.1.454.CMB.1.raw
  modified_base (242)..(242): a, c, t, g, unknown or other
  misc_feature (242)..(242): n is a, c, g, or t
  modified_base (249)..(249): a, c, t, g, unknown or other
  misc_feature (249)..(249): n is a, c, g, or t
tcagtcgatcacgtcacgaccggtgctcgatttagatctactgacaggggaggatggagactgggtccccgctcagctcctggggctcctgctgctctggctcccaggtgcctagatgtgccatccagttgacccagtctccatcctccctgtctgcatctgtaggagacagagtcaccgatcacgttgcccgggcagtcagggcattagcagttattagccttggtatcagcaaaaaaccngggaaancccctaaagctcctgatctatgactgcctcactttgcaaagtgggtcccatcaaggttcagcggcagtggatctgggacagatttcactctcaccatcagcagccctgccagcctgaagattttgctaacttattactgtacaacaagtcttaaagtagttattcgtactacgtttcggacggtaggaaccaaggtacagactacaaacgaactgtgctgacacgatctgtacttacatccttacccgcctactctagacgtacg

SEQ ID NO: 10688 - DNA, 743 bp, Homo sapiens
  misc_feature: GYAE6OF02HNRCT.38.6.A06.1.454.CMB.1.raw
  modified_base (268)..(268): a, c, t, g, unknown or other
  misc_feature (268)..(268): n is a, c, g, or t
  modified_base (512)..(512): a, c, t, g, unknown or other
  misc_feature (512)..(512): n is a, c, g, or t
  modified_base (714)..(714): a, c, t, g, unknown or other
  misc_feature (714)..(714): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttcgacccagtctccatcctccctgtctagcatctggtaggagacagagtcaccatccacgttcggccgggtccagtcgagggctagttagctagtttattacgccgtaggtactacgacgaacaaaaaaccgagggaaacncccccttaaggcctacctaggattccgtaagtcgacctgcccttccgtactttacgaacgaaacggttcgggtaccctaagttaccgtaaggttccgaaggccggacgtaggtggaacttccgggacgggtacacggttacttcgtaaccttcacctaccaagtcaacggcaacggtcctacgacgtcgtacacgtaagttactttacgaacttaacgttaacttaacgtacgtaacctaaacngtttaaacttaaacgtttacgttaacttacgtcgtttaaaccgggtttccgggaacggggttaacgggtaacccgttaaacgggtaccggtaaagttaccgtaaaaccgtaaaacggttacgtaccgggtagaccgtttaccgacgtaacccgtcgtttaccctcggttaaccgtttactaccgtttccccggttaccccgnttaacggtaccgttacggtacggtaaccg

SEQ ID NO: 10689 - DNA, 695 bp, Homo sapiens
  misc_feature: GYAE6OF02IN5K6.38.6.A06.1.454.CMB.1.raw
  modified_base (173)..(173): a, c, t, g, unknown or other
  misc_feature (173)..(173): n is a, c, g, or t
tcagtcgatcacgtcacgaccggtgctcgatttagatctactgacaggggagggatggagactgggtccccgctcagctcctggggctcctgctgctctggctcccaggtgccagatgtgccatccagttcgacccagtctccatcctcctgtctgcatctgtaggagacagngtcaccatcacgttggcccgggacagtcgagggctattagctagttattacgccgtggtatcgaagaacaaaaaccgagggaaaccgacccctaaagtcctacctgactctagtgacctcgcccttacctactttcgacgtaaacgggttcgggtacctagtacgtaacggttcgacggtacggacgtagggtaggtacgttcggtaacggggtaactaggttacttttaccgtaccgttacctaaccgtaaccctacgtacgacgtaccgacggtcccgttagacctaccgtaccgtaaggtaagtttacttttacgaaccttaaacgtttacgttaactacgtaactaaactagttaacctttaaagttattacttcgtacgttacggttcgggacgggtacggtaaccgtacggtacgaagtaactacgtaaaacgtgtaggtacgtacgtacgaccgaccgtatttaccgacgttcttacctcttacccgttccgtcctaagttcgtacgtacgtacg

SEQ ID NO: 10690 - DNA, 839 bp, Homo sapiens
  misc_feature: GYAE6OF02GLGKQ.38.6.A06.1.454.CMB.1.raw
  modified_base (252)..(252): a, c, t, g, unknown or other
  misc_feature (252)..(252): n is a, c, g, or t
tcagtcgatcacgtcacgaccggtgctcgatttagatctactgacagggaggatggacatgagggtccctgctcagctcctggggctcctgctgctctggctcccaggtgccagatgtgccatccagttgacccagtctccatcctccctgtctgcatctggtaggagacagagtcaccatcacttggcccggccagtcgagggcagttagctagttattagcctggtatcagacaaaaaccgagggaaacnccctaagcctctgatctatgctcgcccttcacgtttacgacgtaaacggtcggggtacccagttacgtaaacggttcgacgggtaccgggcgtaagggttacgggtaacgttaccggtaacgggggaaacctacggtttaaacgttttacccaacccgtttaccctacccgtaaacccgtacttaaccggaacgggtaccctaacggtccccgttaagggacccgtaccggttaacccggtttaaggtaaaacgttttacgtttttacggaaaccctttaaaaccgtttttaacgttaaccttaaccgggttaacctaaaacgttaacgtttaaactttttaaacgttaacgttttaaccgttacccgttttaacccggttaacgggttttaccgggggaaacccggggttaaaccggggtaacccggttaaacgggtacggtaaaaccgttaacgttaaacccgtaaaaacgggtaaccgttcgggttaccggaccgttaccggtaacctaacccgttagttacccgtttagtttacccttaccgttacgtttcccccgtacctcccgtttacgtacccttaacgg

SEQ ID NO: 10691 - DNA, 698 bp, Homo sapiens
  misc_feature: GYAE6OF02IG11M.38.6.A06.1.454.CMB.1.raw
  modified_base (230)..(230): a, c, t, g, unknown or other
  misc_feature (230)..(230): n is a, c, g, or t
  modified_base (251)..(251): a, c, t, g, unknown or other
  misc_feature (251)..(251): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccggcagtcgaggcattagctagttatttacgcctggtatcagacaaaaccgaggaacnccctaagctactgatctatcnctcgcctcctactttcgacgtaacggtcggggtacccagtaccgtaaggttccacggtcggacgtaggtggactcggtagggatacgtactttcacttctacaccctatacgacgaccacgtcctagaccgacgtaccttaaggtaacgttacttttacggaacctttaacttttaacgtttaacctacgttaacctaaacttagttaaactttagttacgtttactttaccgttccttacgggttttccgggaaccgggttacggaaccgtaagggtacgaacggtacttaacggaacgttacgtacgggtaccgtcgttaacgaccctaacgttaccgttcgttacgtttcctttaaccgtcccgttacccttaccccggtaccttaccgtttacgtaccggttaacggtccgttaaccgtaccgggtacgttcgggtacccggg

SEQ ID NO: 10692 - DNA, 791 bp, Homo sapiens
  misc_feature: GYAE6OF02F96FW.38.6.A06.1.454.CMB.1.raw
  modified_base (746)..(746): a, c, t, g, unknown or other
  misc_feature (746)..(746): n is a, c, g, or t
  modified_base (783)..(783): a, c, t, g, unknown or other
  misc_feature (783)..(783): n is a, c, g, or t
tcagtcgatcacgtcacgaccggtgctcgatttagatctactgacagggaggatggagactgggtcaactggatggcacatctggctcccaggtgccagatgtgccatccagttgaccagtctcactcctccctgtctgcatctagtaggagacagagtcaccatcctacgttcggcccgggactacgtcgagggctaagttagctagtttacgtttagccttggtactacgaacgaacaaaaaaccggtagggaaaccgacccctaagccgtacctagattcctaatcggtacctccgtccctaccttagtttacgaacgtaaacgggtcgggttaccctaagtaccggtaaaggttccgacggtaccggacgtaacggtacggtagtaccggtacgggaactacgttactttaccgtacctaccgttacgaacctacgtacgtacggtccaacggtccgtacgaccgtaacgttacccgtaaggttaaacggttttaccgtttagtaacccgttaaacttttaactaccggttaattaaaccctaacggttaaggtttaacccttaaaagtttacggttactttaccgttaccggttacggtttaacccggggaacggtaaacggaaccgttaacgggtacaaagttaaccgaaaacggttaaagacccggttgggtaccaccgggttacaaccttattacgtcgttacgtttactccggttaactcccggtaaccctacggtnttaaggtaccggttaacgttcgaacgtcccgttaggnggaaccgg

SEQ ID NO: 10693 - DNA, 571 bp, Homo sapiens
  misc_feature: GYAE6OF02F24DQ.38.6.A06.1.454.CMB.1.raw
  modified_base (203)..(203): a, c, t, g, unknown or other
  misc_feature (203)..(203): n is a, c, g, or t
  modified_base (247)..(247): a, c, t, g, unknown or other
  misc_feature (247)..(247): n is a, c, g, or t
  modified_base (250)..(250): a, c, t, g, unknown or other
  misc_feature (250)..(250): n is a, c, g, or t
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcaccatcacttgccgggccagtcagggcattagcagttatttanctggtatcagcaaaaaccaggaagcccctaagctcctgatctangcngcctccactttgcaaaggtggggtcccatcaaaggttcagcggcagtggatcgtgggaacagatttcacttctacacatcagcacgcctgcagcctagaagattttgactaactttacttactattacgaaacagtacttaaagttaagtttaatcctctaaccgttttcgggacgggaacgggtaaccgaaacggttcggaacgacgtacctaaaacggtaaccttaggtcgggtactacgccaaccgatcgttcgttccgttcaacttccttacccgtccctaacttctcggtaacggtagtactcgtactggtaacgg

SEQ ID NO: 10694 - DNA, 713 bp, Homo sapiens
  misc_feature: GYAE6OF02JUNUP.38.6.A06.1.454.CMB.1.raw
  modified_base (448)..(448): a, c, t, g, unknown or other
  misc_feature (448)..(448): n is a, c, g, or t
  modified_base (636)..(636): a, c, t, g, unknown or other
  misc_feature (636)..(636): n is a, c, g, or t
  modified_base (650)..(650): a, c, t, g, unknown or other
  misc_feature (650)..(650): n is a, c, g, or t
tcagtcgatcacgtcacgaccggtgctcgatttagatctactgacagggaggatggacatgagggtccccgctcagctcctggggctcctgctgctctgggctcccaggtgccagatgtgccatccagttgacccagtctccatccctccctgtctgcatctgtaggagacagagtcacatccacgttggccggtccaggtcagggtcattagacgtagttagttacgccgttaggtactcgaacgaaccgaaaaacccgaggggaaaaccgtccccgtaaaggccttacccttcgacttacctagtcggacctcggaccccttaccgtacgtttacgaacgtaacggttccgggtaccctataccgtaggttacaggccggtacgtaacgtggtacgtcggtagggaactagtaacgtttcaccgtctaccactagtacacgcgacncgtacgactacgactagtaacgttatttccgaacttaacgttactttacggtactacctaaagtacggttaaccgttttataaccggtttacttaccgttacgttacccgggttacgggtaccggggtaacgtacccgggtaaggtaactaccgttaacgtaaccgtaacggtactagccgggttacncgtaccgtaacgtnttacgtaccgttccgttactacccggttcctaacccggtacccttaaggtcccgtaagtacgg

SEQ ID NO: 10695 - DNA, 735 bp, Homo sapiens
  misc_feature: GYAE6OF02HSE9C.38.6.A06.1.454.CMB.1.raw
  modified_base (286)..(286): a, c, t, g, unknown or other
  misc_feature (286)..(286): n is a, c, g, or t
  modified_base (523)..(523): a, c, t, g, unknown or other
  misc_feature (523)..(523): n is a, c, g, or t
  modified_base (647)..(647): a, c, t, g, unknown or other
  misc_feature (647)..(647): n is a, c, g, or t
tcagtcgatcacgtcacgaccggtgctcgatttagatctactgacagggaggatggacatgagggtccccgctcagctccgtggggctcctgctgctctggcctcccaggtcgccagatgtgccatccagttcgacccagtcctccatccctcctgtctgcatctggaggacgacaggactcacactcacgttcggcccgggcagtcgaggctattagctagtttattacgccgtaggtactcaacgaaccgaaaaaccgagggaaaccgtcccaagtctccgtanacttctatcggtcctcgacccttccttaacgttcgaacgtaacgggtccggtacctacgtacgtaacggttcgaacggccggagtacggtaggtacgtacggacgggtaacctattacgttaccacctccgtaactaaccgacgtacctaggacctacgggtcctaccgacggtaccttaggtaaacgtaacgtttagtttaccgtaacttaactttacgtacgactacgtaaacgntttaaaccttaggtacttacccttgtaccggtttaccggtacggggtaaccggggtaaaccgtaaccgaaggggtacgtaacgttaaacgtaaaccggaagttaaccgtgggaccgtacccgtnaccccgttaaatccggtttcgttaacgtttacccttacctacccgtttacccgaccccgttacgtaacccgttagtaacgggtaaccg

SEQ ID NO: 10696 - DNA, 694 bp, Homo sapiens
  misc_feature: GYAE6OF02H5NFV.38.6.A06.1.454.CMB.1.raw
  modified_base (167)..(167): a, c, t, g, unknown or other
  misc_feature (167)..(167): n is a, c, g, or t
  modified_base (258)..(258): a, c, t, g, unknown or other
  misc_feature (258)..(258): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgtcatctgtagganacagagtcacatcacttcgccggcagtcagggctattagctagttattacgccgtggtatcagacaaaaccgaggaacgtccctaagctcngtactctagtgctcgtcctcctattcgctaaggtcgggtacctagtacgtagtcgagcggacgagtcgtactcggtacggacgtagtacttacacttaccacactactacgagtcactccgtagccgtactccgtagtacgttacgtttcgaaccttaatttacgttactacggtaacctaacaacgttacttaaacttacgtttactaccgttacgtaaccggtttaccgggcgggtaaacggtaacccgtaacggggtacgtaaacggtaaccttaaccgtaaacggtaaccgttcgggtacgggttaccctaaggaccccgtaaaccgttacggtttacccttaacggttcctttaacccggttaacccttttaccccgggtttacccggaccctttaccggtttaaccggtttaaccgaacccgggtttccg

SEQ ID NO: 10697 - DNA, 864 bp, Homo sapiens
  misc_feature: GYAE6OF02IBMXI.38.6.A06.1.454.CMB.1.raw
tcagtcgatcacgtcacgaccggtgctcgatttagatctactgacagggaggatggagactgggtcaactggatggcacatctggctcccaggtgccagatgtgccatccagttgacccagtctccatcctccctgtctgcatctgtaggagacagagtcacatctacttcgccgggacagtcgagggctaattagctagtttatttagccgtaggtatacgaacgaaccaaaaaccgtagggaaaccgacccctaagaccttaccgtagtacttacgtagtcgtacgtcggaccccttaccttaacgtttacggaacgtaaacgggttccggggttaccctaagttaccgtaaacgggttccgtacgggaccggtacgtaaggttcgggaacgttacggttaacggggaaccgttaacgttaactttacccgaacgttacctacctaaaccgaacttaccgaacggtaaccgtaacggtacccgtacgtaacgtacgtaacccttaagggtaaaccgttaagtttttaccgaacctttaaaacctttacttttaaacccggtacgttaacctaaacgttaacgtttaaactttaaacgttaacgtttaaaccgtttacttaaccggtttaaccggtttccggggaacccggggtaaacggggtaaacccgggttaacgggtaaccggaacgttaaacgttaacccggaaaacggttaccgttaaccggtacgggtaaccttacggaaaccctaacccgttacttaccggttacccgttaccttaccgtaacctttaccccggtttacccgaccttacgttacccttacggaacgttggtaaacgtcgtacgtcggtaaccggg

SEQ ID NO: 10698 - DNA, 783 bp, Homo sapiens
  misc_feature: GYAE6OF02JAR09.38.6.A06.1.454.CMB.1.raw
tcagtcgatcacgtcacgaccggtgctcgatttagatctactgacagggaggatggagactgggtcccgctcagctcctggggctcctgctgctctggctcccaggtgccagatgtgccatccagttgacccagtctccactcctcctgtctgctatctgtaggagacagagtacaccatctacgttcggccgggaccaggtcgagggtctagttacgaccgtaagtttacgttacgccgttaggtactacgaacgaacgaaaaaccgacggggaaaccgtccctaaacgtcctccgtagtactactatcgtctcgtcctccgtacttagacgtaacggtcgggtacccagtacgtaggtccgcggcggacgtaggtacggtacgtcggtacggacgtaacgttacttacgactcctacgacctagtacgacgtactacgccgtcgaccgtacgtacccgttaaggttaacgtttacgttttacgaaacctttacgtttaacgttaccgtacgttaaaccgtaaacgttaccggtttaactttaacggtttaacgtttccgttaccgtttacggttaaccgggttccgggtaaaccgggtaaccgggtaaccggttaacggttacgtaacggtaaccttaaaccggtaaaccggttacgttaggggtaccgaccggttcaaccccggttaacgtttaccgttaccggtttacggtaaccctttaaccggttaacccgttcccggttaccctaccgttacgtaccgttaaggtacccgttacgg

SEQ ID NO: 10699 - DNA, 900 bp, Homo sapiens
  misc_feature: GYAE6OF02HAS8U.38.6.A06.1.454.CMB.1.raw
  modified_base (254)..(254): a, c, t, g, unknown or other
  misc_feature (254)..(254): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttgacccagtctccatcctccctgtctgcatctgtaggagacagagtcaccatcacttcgccgggccagtcgagggctattagctagttattacgccttaggtactcagaacaaaaccgaggaaacncccctaagcctactagactctatcgctgccttacctacgtttacgacgtaaacggtccggggtacccacgtaccgtaaggtttcgaacggtccggactacgggtacggtacgttcggtacgggaactacggttacttttaccgacctttacctacccaaccttaacgttccgaaccgtaccctaaccggtaccccgttacggacccgtaaccggtccccgtttaagggtaaaaccggttttacgtttttacccggtaacccttttaaaacccggttttaacttttaaacccgggtttaacgttaaaccccggttaaaaccgttaacgggtttaaaaccttttaaacggttttaaaccgttttaaccgttaacccgtttaccccggttttaaccgggtttttaacccgggggaccgggggttaaacccggggttaaaccggttaaaccggggtttaaccggaaaccgttaaaaccgttaaaccgggtaaaaacccggttaacggtttaacgggttaccggttaccgtaacggttaccccgtaaaccgtaacgttttaccggtttaccgtttaacccgttaccgttaacccttttccccgggttaccccttacccgttaacgtttacccggtaacggtttaaccccgg

SEQ ID NO: 10700 - DNA, 746 bp, Homo sapiens
  misc_feature: GYAE6OF02IP2BT.38.6.A06.1.454.CMB.1.raw
  modified_base (151)..(151): a, c, t, g, unknown or other
  misc_feature (151)..(151): n is a, c, g, or t
  modified_base (156)..(156): a, c, t, g, unknown or other
  misc_feature (156)..(156): n is a, c, g, or t
  modified_base (162)..(162): a, c, t, g, unknown or other
  misc_feature (162)..(162): n is a, c, g, or t
  modified_base (393)..(393): a, c, t, g, unknown or other
  misc_feature (393)..(393): n is a, c, g, or t
  modified_base (455)..(455): a, c, t, g, unknown or other
  misc_feature (455)..(455): n is a, c, g, or t
  modified_base (625)..(625): a, c, t, g, unknown or other
  misc_feature (625)..(625): n is a, c, g, or t
tcagtcgatcacgtcacgaccggtgctcgatttagatctactgacagggaggatggagactgggtcaactggatggcacatctggctcccaggtgccagatgtgcatccagttgaccagtctccatcctcctgtcctgcagtctgtagganacagntccacntactctcggccgccgtagtcgagggctaagtacgacgttaggtttaatttacgtccgttaaggacttacgaaacgaaaccaaaaaccggaggtaacccgacctaaggcctctagagttactagtcgcgtctcctaccttacgttacgaaccgtaaggtccgggtacctacgtacgttaacggtcgtacggcgtcggaagtgggactacggtacggagtacgtttacgtacnctacctacaactcgtcgacgtactacgtcgtagacctacggtactaaggtactttacgtttntaaccgtttaaattcttaagttaccgtaacaaacggttacttaaacgtttaaacgtttaccgttaactttccgttaaccggtttacgggtaccgggtaacggggtaacccgtaaggtacggacggttaacaacccggtaacgtaaacgggtaccgttcgtaacggttccncggtttaacccgaccttacgttcccttttagttacccgttacgttacccggtttacccgtacctaccgttaagtacccggttaacgtacggtccgtaacggttccggaggttcccgacggg

SEQ ID NO: 10701 - DNA, 579 bp, Homo sapiens
  misc_feature: GYAE6OF02F0VCD.38.6.A06.1.454.CMB.1.raw
  modified_base (339)..(339): a, c, t, g, unknown or other
  misc_feature (339)..(339): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagagtcaccatcacttgccgggcagtcagggcattagcagttattagcctggtatcaagacaaaaaaccgaggaaagcccctaaagctcctgatctatgctgcctcactttgcaaaggtcggggtcccaatcaaggttcagcggcagtggatcgtgggacagattcactcncacatcagcagcctgcagcctagaagtattttagactaactttattactagtactaacagtattaaatagttacttctacgtacgtttacgggacggtaacgggaaccgtaagggtacgaagaacttacgaaaaccgtacgttacggtaggaccgttacgaccgaaccgttactaccgttacgttacctttacgtaccttccgttaccccggaccttagttccgtacggtaccgttacgg

SEQ ID NO: 10702 - DNA, 690 bp, Homo sapiens
  misc_feature: GYAE6OF02JLF7N.38.6.A06.1.454.CMB.1.raw
  modified_base (257)..(257): a, c, t, g, unknown or other
  misc_feature (257)..(257): n is a, c, g, or t
  modified_base (601)..(601): a, c, t, g, unknown or other
  misc_feature (601)..(601): n is a, c, g, or t
tcagtcgatcacgtcacgaccggtgctcgatttagatctactgacagggaggatggacatgagggtcccgctcagctcctgggctcctgctgctctggctccaggtgccagatgtcgccatccagttcgacccagtctccatcctccctgtctgcatctgtaggagacagacgtcaccatcacttggccgggccaggtcagggctagttagcctagttactttagccgttggtactcagaacaaaaccgaggaaacncccctaagccttccgtagtactacttatcggccttacggcccttcccgtacttttcggaccttaaacgggtcggggttccccaagttaccgtaaacgggttccaaacgggtccggtactacgggttacgggacttaccggttacgggaacctaggtagttttacccaacgttcctaccgaacctagttccgaacggtccaacgtcccgtagcctacggtaccttacggtaacgttacgttttagccttaaacgtttacttactacgtacctaaacctgttactttaacttagttactcgtacttacggttacgggttacggaacggtaccgaaggttccgtaanaaccgttacgaaacgttacgttgaggtactacgacgtaccattacgtacttcgttactccgttcctcccgtacgtattccgtagtaccg

SEQ ID NO: 10703 - DNA, 671 bp, Homo sapiens
  misc_feature: GYAE6OF02IF6VZ.38.6.A06.1.454.CMB.1.raw
  modified_base (264)..(264): a, c, t, g, unknown or other
  misc_feature (264)..(264): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtaggagacagacgtcaccatcacttcggcccgggccagtcgagggtctattagctagtttatttacgccgttggtaatcacgaaccaaaaaccgagggaaaccnccctaagccttcctgacttctatcgctcgtccctcctactttcgacgtaagggtccgggtaccatacgtaaggtcgagcggcaggtcgagttcgaggactagtacttcactctacaccgnacgacncgacgcctcgacgacgtcgtagttaactttgtttacgaacttaacttattaacgctaaactacgtacgttaactttaagttacttacgtaccgtttaccgttacgggttaccgggacgggtacggtaaacggtaggtaccgaaagttaaccggaaacgtaaaacggtcggttcggtacgtcgtaccggtcctaacgtctttcgttacgtttaccttacccgtttaaccgttccccgtttaacccggacttacccgtacggttaacggtaccgttaaccggg

SEQ ID NO: 10704 - DNA, 732 bp, Homo sapiens
  misc_feature: GYAE6OF02IXK5O.38.6.A06.1.454.CMB.1.raw
  modified_base (429)..(429): a, c, t, g, unknown or other
  misc_feature (429)..(429): n is a, c, g, or t
  modified_base (436)..(436): a, c, t, g, unknown or other
  misc_feature (436)..(436): n is a, c, g, or t
  modified_base (542)..(542): a, c, t, g, unknown or other
  misc_feature (542)..(542): n is a, c, g, or t
tcagtcgatcacgtcacgaccggtgctcgatttagatctactgacagggaggatggagactggctcccaggtgccagatgtcgccatccagttgacccagtctccatcctcctgtctgcatctgtaggagacagcgtcaccatcacttgccggccagtcagggcattagcagtttatttacgccttaggtatcgacgaaccaaaacggaggaacctaccgtagccttaccgtgtacttctagtcgtcgtccgtacctccgttacgttagaacgtaacgggttccgggtacctagtaccggttaaggtccgacggccggtacgtaggtacggtagttcggaaggtactagtttacttccgaccttccaaccactagtacacgcaccgtcctgaccgcgtacgtaagtagttcttacgtacttaacgtttntaccgtntaaccgaaagttgttaaactttaaggttacttccgtaacctacgttccgggttacgggacgggtaacgacgtacggtagactaacctacgaacgttgtccgggtanccacgcctacgttatttcccgtagtttacctacgtacccgttcccgtacccgacttacggtacccgttaacgggtacgttacgtaccggtttaaccctaaggggtttaaccccgggcgggtttttcccggggacccttttaagggggaccccgggttaacggaccccgttttaaaggcgggtttaacgcg

SEQ ID NO: 10705 - DNA, 769 bp, Homo sapiens
  misc_feature: GYAE6OF02I4MON.38.6.A06.1.454.CMB.1.raw
tcagtcgatcacgtcacgaccggtgctcgatttagatctactgacagggaggatggagactgggtcaactggatggcacatctggctcccaggtgccagatgtgccgtccagttcgacccagtctccatcctcctgtctgcatctgtaggagacagacgtcacctatcacttgccggcagtcgaggcattacgctagtttattagccttggtactacgaacgaaccgtaaaaacgagggaaaccgacccctaagacctcctagtagttcctagtcgtctcgtccttacctacgtttagaccgtaaaggtccggtaccccaagttaccgaaggttccgaacggtcggacgtaaggttcgataccggtaggactagttacgttctacctctaccgactaacgtccaacggtccaacgtccgtacgtacgtaacgtaccgttaaggtaacctttaggttttacaaccgtttaaactttcgtttaaaccgtacgtaacctaaacgttctttaacgtttaaactttacggttacttaaccgttacgtttaaccgggtttaccgggaacccgggtaacggtaaaccgttaacgggtactaaacggtaaccgttaaaccgaaaccggttaacgttcgtaccggttcaacggtaccctacgttaagtttccgtactttaccgtacgttaacccgttcccgttaacccgtacgttaaccgttaccgtaaccggttacgtacggttaccgtacggtttaaacggtgggacccgggtcgg

SEQ ID NO: 10706 - DNA, 864 bp, Homo sapiens
  misc_feature: GYAE6OF02F8MDY.38.6.A06.1.454.CMB.1.raw
tcagtcgatcacgtcacgaccggtgctcgatttagatctactgacagggaggatggagactgggtccccgctcagctcctggggctcctgctgctctggctcccaggtgccagatgtgccatccagttcgacccagtctccatcctccctgtctgcatctgtaggagacagagtacacactaccacttcggccggaccagtccgagggctaagttacgcgtaagtttacgttagccttaggttactacgaacgaaaccaaaaaaccgaggggtaaaaccgaccccgtaaacgtccgttacctacggtaacttacgtagttagcgttacgccttacccgttacgttttaacgacggtaaacgggttccgggtacccctacgttaaccgtaaacggttacgtaacggacgggtacgacggttacggtacgttaccggtacgggtaactaaacggttactttaccgtaccgttaccgtacccgtaactaactcgaacgactaccgtcgtacgacgtacgtacgtaacgtaaggttatttacggaaaccctttaaaggtttaacttaccgggttaactaacccgtaaacggttaacgttaaccgttttaaaacgttaccgttttaaactacccggttaacctttaacccggggtttacgggttaaacccgggggaaagggtaaaccccggttaagggtaaccggtaaaccggtaaaccgttaaacccggttaaaacgaaccggtttcggtaaccggtacctacggaaccgttaacgtccttttaaccggttcttaacccgtttaccgtttaaccctcccggtttacccctaagtacccggttttactaaccgggtaacgtttaaccgg

SEQ ID NO: 10707 - DNA, 797 bp, Homo sapiens
  misc_feature: GYAE6OF02JQHHZ.38.6.A06.1.454.CMB.1.raw
  modified_base (151)..(151): a, c, t, g, unknown or other
  misc_feature (151)..(151): n is a, c, g, or t
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (752)..(752): a, c, t, g, unknown or other
  misc_feature (752)..(752): n is a, c, g, or t
tcagtcgatcacgtcacgaccggtgctcgatttagatctactgacagggaggatggagactgggtcaactggatggcacatctgctcccaggtgccagatgtgccatccagtgacccagtctccatcccgtcctgtctgcatctagagganactagagtccaccgtntcncttcggcccggacagtacgagggtcattagctagttagttcgcctggtactcgaaacgtaaccaaaaacgacgggtaacgaccccgttaagcccttccgtataacgttccgtaatcggtaccttcggtacccttacctaacgtttacggaaccggtaaacggtccgggggtaccccctaaggttaccggtaacggttcgaacgggtccggacgtacggtaggtacgtacgtcgggaactagttactttccaacgtctacgtacacttcgaccgtacggactccgtacgtccgtacggacctttaacggtaacggttactttcggaaaccgtttaacgtttaaccttacgttaaccggtaacgtaaacccgtaagttaccgtttaaacgttaacgttacgttacccgttaacggttaacccgttccgggtaacggtaaccggtaaccggttaaacggtacgggtaacgtacggttaaaccgaacggtaaaccgttagggtcgtaaccgttaccgaccgtaaccgttacttccggttaacttccggtacctaccgtttaccccgtaccggtacttaacccggtntacggttaaaccggtgtaaccgtacgtaccggttacggtcccggg

SEQ ID NO: 10708 - DNA, 624 bp, Homo sapiens
  misc_feature: GYAE6OF02GI8ID.38.6.A06.1.454.CMB.1.raw
  modified_base (241)..(241): a, c, t, g, unknown or other
  misc_feature (241)..(241): n is a, c, g, or t
  modified_base (248)..(248): a, c, t, g, unknown or other
  misc_feature (248)..(248): n is a, c, g, or t
tcagtcgatcacgtcacgaccggtgctcgatttagatctactgacagggaggatggagactgggtccccgctcagctcctgggggctcctgctgctctggctcccaggtgccagatgtgccatccagttgacccagtctccatccctccctgtctgcatctgtaggagacagagtcaccatcacttcgccgggccagtcagggcattagctagtttattgcctggtatcagacaaaaacgnggaaacnccctaagctcctagatctatgctcgccctacctactttcgacgtaaaggtcgggtacccagtacgaacggttcacggcggcgtaggtcgagtccgtggactagtacttccgacttctacacctatcacgcgaacgcgtagccagtccgtagaacgttatttcgaaccttatttacgttactacgtaacaacgtacgttacttaaacgttagtttactaccgttacttaccggtttacgggaccgggttaaacggaccgtagggtacctaagtactaaccgaaacgtacgtggtacgtcgttacgacctaccgtacttaccgttacgttaccttccgtactttcccgtacccgtacgtacttcgtaacgtcgtaacg

SEQ ID NO: 10709 - DNA, 749 bp, Homo sapiens
  misc_feature: GYAE6OF02JC76K.38.6.A06.1.454.CMB.1.raw
  modified_base (114)..(114): a, c, t, g, unknown or other
  misc_feature (114)..(114): n is a, c, g, or t
  modified_base (119)..(119): a, c, t, g, unknown or other
  misc_feature (119)..(119): n is a, c, g, or t
  modified_base (327)..(327): a, c, t, g, unknown or other
  misc_feature (327)..(327): n is a, c, g, or t
  modified_base (459)..(459): a, c, t, g, unknown or other
  misc_feature (459)..(459): n is a, c, g, or t
tcagtcgatcacgtcacgaccggtgctcgatttagatctactgacaggggaggagtggacatgagggtccccgctcagctcctggggctcctcgctgctctggcctcccaggtnccagntgtgccatccgagttcgacccagtcctccacttccctccctgtctgctatctaggtaggagactagacgtaccaccatctacgttcggccggccagtcgagggactagtacgacgtagtttaattcgaccgttggtataccgaagaacccgaaaaacggacggaaacccgtacccgtaacgtccgtacctgtaacttaccggttaacncggtaccttccgtaccccttaccgtttacgtttaccggaacgtaacgggtccggtaaccctagtaacgtacggtcgtacgcggtacgtaggtgtaaccgtggtacgactagtaccttcacctcctactacgntaccgagtactccgtaccgtacaccgtacgtacgtaacgttacgtacgtttacacttaactttaacgtaccttacgtaactaacgttacgtaactttagttacgtttacgtaccttacggttaccggttacgggcggtaaccgggtaccgtaacgtaacggtaacgtaaccgttaaccgtaagtacccgtagggtacgtacccgttacgaacgtccttacgtacgttcgttaaccgtttccgtaacccggttaccttacccgttacggtaccgtttaccgaagttaccgg

SEQ ID NO: 10710 - DNA, 819 bp, Homo sapiens
  misc_feature: GYAE6OF02F3AHD.38.6.A06.1.454.CMB.1.raw
  modified_base (362)..(362): a, c, t, g, unknown or other
  misc_feature (362)..(362): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttcgacccagtctccatccctcctgtctgcatctgtaggagacagagtcaccatctacgttcggccgggcagtcgaggctatacgctagttacttagcctaggtatacaacgaacaaaaaccgacgggaactaccccgtaagcctactagtatctagtcgactccgcctacctactttgacgtaacggtcgggtaccctagtacgtaagggtcaggcggacaggtggtatacggngggactagtactttaccacctacgtaccaactactaccgagtacacggtcctacggactaccggtaccgttaaggtaacgtttaacgtttacggtaaccgtttaaacctttaacgttttaaccgttaacgttaaacccgtaaacgtttaaacgttaaccgttttaaaagtttaacgtttaaacctttccgtttaaaccgggtttaacccggtttaccgggggtaaaccggggtaaccgggggttaaacccggtaaacgggggtttaaccggaaacgggttaaaaccgttaaaccggtaaaaaccggttaaccgggttaggggtacccgggttagttaacccgtaacccgggtaaccctttaggttaaaccctttcggtttaccgttttaacctttacccggtttacccccgtttacccggtaacccttacggtttacccgttaacgggttaaacccg

SEQ ID NO: 10711 - DNA, 671 bp, Homo sapiens
  misc_feature: GYAE6OF02IDKBN.38.6.A06.1.454.CMB.1.raw
  modified_base (629)..(629): a, c, t, g, unknown or other
  misc_feature (629)..(629): n is a, c, g, or t
tcagtcgatcacgtcacgaccggtgctcgatttagatctactgacagggaggatggacatgagggtccccgctcagctcctggggctcctgctgctctggctcccaggtgccagatgtcgccatccgagttgacccagtctccatccctccctgtctgctatctggtaaggagacagagtcaccatccacgttgcccgggaccaggtccgagggctagttagctaagtttagtttacgccttagggtactaccgaacgaaaccgaaaaaaccgaacggggaaaaccgtaccccgtaaacgaccttaccgtacgtaacttaccgtaactcggtctccgtcccttaccctacgtttacggacgttaaacggtcgggtaacccagtacgtaaggtcgagtaccggacgtaggtggtatcggtcggactacggtacttccgaccttctacacctacgtacacgtacacggcctacgacgacgtaccgtaggtaactttagtttcgaaccttaagttacttactagaactactaattacttaattactacttctcgttacgttcgggacggacggtaccgtagtacgaagtaactaacgaacgtaaggtacgtcgtactacgactacgacgttntaaccgtctttacgccttccggccctactactcggtagtacg

SEQ ID NO: 10712 - DNA, 603 bp, Homo sapiens
  misc_feature: GYAE6OF02JBLWP.38.6.A06.1.454.CMB.1.raw
  modified_base (284)..(284): a, c, t, g, unknown or other
  misc_feature (284)..(284): n is a, c, g, or t
  modified_base (390)..(390): a, c, t, g, unknown or other
  misc_feature (390)..(390): n is a, c, g, or t
  modified_base (403)..(403): a, c, t, g, unknown or other
  misc_feature (403)..(403): n is a, c, g, or t
  modified_base (409)..(409): a, c, t, g, unknown or other
  misc_feature (409)..(409): n is a, c, g, or t
  modified_base (456)..(456): a, c, t, g, unknown or other
  misc_feature (456)..(456): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccactcctcctgtctgcatctgtaggagacagatcaccatcacttgccggccagtcgaggctagtagctagttatttagccgttaggtataccaacgaactaaaaaccgagggaaaaccgcccctaaagcctaccagtactcttancgcgtcgtccctaccttatttacggacgtaaacggtcgggtacctacgtacgtaaggttcaggtcggcgaaggtcgtagtcgtacgggatacgtacttccacgtcncacctagctagcncgccgngctagaccgtataacttacgtttcaacttacttacgttatacgttanaacttattacgttaactgttactcttacgtcgtacgggacggaagtacgtacgagtaacacttacgaactacgtcgacgtcgacactacgtcttctacggtcttacgtacccttcctcccgttactacgtcgtaacggtacttacgg

SEQ ID NO: 10713 - DNA, 832 bp, Homo sapiens
  misc_feature: GYAE6OF02HAQGZ.38.6.A06.1.454.CMB.1.raw
  modified_base (169)..(169): a, c, t, g, unknown or other
  misc_feature (169)..(169): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttcgacccagtctccatccctccctgtctgcatctgtagganacgagagtcacatcacgttcggccggacctagtcgagggctatttacgacgttagttatttacgccgttaggtactacgaacgaaccaaaaaaccggtaacgggaaaccgtacccccgtaaagtcccttaccgtagtaacttaccgttagtcggtccgtacgtccccttaccgttacgtttacggaaccggttaaaacgggttccggggttaccccgtaagtaccggttaaacgggttaccggaacgggtccggacgtacgggtaggtacgttaccgggtaacgggaacgtacggttacttttacgtaccgttaccgttaccaacccgtagttaccgaacgaccgtacggtcccgtacgaccgtaccgtaccgtaaggttaagtttaccgttttaacgtaacctttaaacgtttaacgtttaacgttacgttaacctaaacgttaactttaaaccgtttaagtttaaacgtttaccttaccgttaccggttacccgggttttacggggaacgggttaaccgggttaaccgtaacggggttaacgtaacgtaaccgttaaacgtaaaccgttaagttcgtacgtacgttccgaaccgtacgtacttacggttctaccgttaccttaccgttacccgtcccgtactacgttaccgtacgtaacgg

SEQ ID NO: 10714 - DNA, 667 bp, Homo sapiens
  misc_feature: GYAE6OF02JFTB9.38.6.A06.1.454.CMB.1.raw
  modified_base (173)..(173): a, c, t, g, unknown or other
  misc_feature (173)..(173): n is a, c, g, or t
  modified_base (407)..(407): a, c, t, g, unknown or other
  misc_feature (407)..(407): n is a, c, g, or t
  modified_base (441)..(441): a, c, t, g, unknown or other
  misc_feature (441)..(441): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttcgacccagtcctccactcctccctggtcctgcatctggtagganacagacgtccaaccatcacttcggccgggaccagtcgaagggctattacgctagtttacttacgctaggtactcaagaaccaaaaaccggaggaaccgtcccctaaggcctctagacttactagtcgcctacgtcccttctacgtttacggaacgtaacgggtccggtaccctagtacgtacggttcgacggtccgataagggtgacttacggacgggtactaggtactttacnccgtcctacactacgtacaggacctacgccgttnacgacgtaccgtagtacttcggtttacaacttacgttacttactagtaacccgaatacgttaattacttacgtacttctacgtacggttacgggacggaaccgtacgtaacgcgtaacgtacgtaaacgtaaacctagtcggtaccgcgttacgaccggtaacttctaccgttacttacgttacctaccttcccgttaccgactttacgttacgtaccgtaacggg

SEQ ID NO: 10715 - DNA, 840 bp, Homo sapiens
  misc_feature: GYAE6OF02JB6US.38.6.A06.1.454.CMB.1.raw
  modified_base (129)..(129): a, c, t, g, unknown or other
  misc_feature (129)..(129): n is a, c, g, or t
  modified_base (666)..(666): a, c, t, g, unknown or other
  misc_feature (666)..(666): n is a, c, g, or t
tcagtcgatcacgtcacgaccggtgctcgatttagatctactgacaggggaggatggagactggctcccaggtgccagatgtgccatccagttgaccagtctccatcctcctgtctgcatctgtagganacagacgtcaccataccacgttcggcccgggacctaggtacgacgggtactagtttacggactaggtttacttacggccttagggttactacgaaacgaaccgaaaaaaccggacggggaaaccgtaccccgtaaggtcctaccgttagtaacgttacgtacgtcgtccgtacggtacccttaccgttaacgtttacgtaaccggaaaagggtttcccggggtaaccctatttaacgggaaacggttcggaaccggtacgggtctaaacggggttcggtaacgttcgggtaccgggaacgttgttaccttacgtacctccgttaaccgaacctgaccgaacgtaccgtacgtacccgtggaaccgtagtaccgtaacgggttaacttcttttacggaactttaaccggtttaacttacgttcgaaacctaacggtagtttactttaaacggttctttaccttctaccgtttacggtacgggtacggtacggtacggtaagtacgtaacgtactaacgaaacgtcgtacgtacgtacncgtacttaaccgtcgttacgtccgtttaactcgttacccgttaccgttacccgtacgtacgttacggttaaccgtaccgttcgtacccgttaccgggtaacggccggttaacccggggttaccggtccggttaaccggttaacgggaccctacggggaccgttaggttcgacgg

SEQ ID NO: 10716 - DNA, 722 bp, Homo sapiens
  misc_feature: GYAE6OF02IZ3EY.38.6.A06.1.454.CMB.1.raw
tcagtcgatcacgtcacgaccggtgctcgatttagatctactgacagggaggatggacatgagggtccccgctcagcctcctggggctcctgctgctctggctcccaggtgccagatgtgccatccagttcgacccagtctccactccctcctgtctgcatcgtggtaggacgacagtacgtcacctatcacgttcggccggcagtcgaggctattagactagttattacgcctaggtactcgaacgtaacgaaaaaccgagggaaacctaccccgtaacgtccgtaccgtatacttactagtccgcctccgtacccttccgttacgtttacgaccggtaacgggtccgggtaccctagtacgtaacggtcgacggccggtagtaggtacggtagtccggaggtactacgttacttccctacgtcctaccgtaacctagtacgaacgtccgtacgtccgtacgacgtacgtaccgagttaacgtttagttaccgtaactttaaacgtttcgttaacgtaccgttaacaaacgttaacgttaactttaatttacggtttacccttaccgttaccgttcccgggttacgggaacgggtaaccgggtaacgtacgggtaacgtaacgtactaacggtaaacgtcggttgtaccggtctacggcctaccgttcgtactccgttaccttacgttccttaccctccggtataccgttccgagttaccg

SEQ ID NO: 10717 - DNA, 732 bp, Homo sapiens
  misc_feature: GYAE6OF02F5YZG.38.6.A06.1.454.CMB.1.raw
tcagtcgatcacgtcacgaccggtgctcgatttagatctactgacagggaggatggagactgggtcccgctcagctcctggggctcctgctgctctggctcccaggtgccagatgtgccatccagttcgacccagtctccatcctccctgtctgcatctgtaggagacagagtcaccatcacttgccgggcagtcgagggctattagctaagtttagtttacgcctaggtactcgaacgtaaccaaaaaaccggtacgggaaacgtacccctaaagtccttccgtaggtaacttccttaacgtacgcctacgcccttacctaacgtttacgaccggtaaacgggttccggggtaacccacgttacgtaacggttcgacggccggactaggtcggtacgtcggtacgggactagttacttccgacttaccgtacaccgtactcgaacgtcgacggtccgtagccgtacgtcgtagtaaacgtttacgtttagtaaccttaacgtttacttacgtacgtacctaaacggtacgttaacgtttaaagttacgtttaacttccgtttacgtaccggtttcgggaaccgggttaacgggtaacctaagggtacgaacgttacgtaacgaaacgtacgttcgggtagtaccgtacgtcccgaacgtttcggctttaccgttccttacgtacccgttccgttccccgttaacctcgtaaccggtttacgacggttaacg

SEQ ID NO: 10718 - DNA, 810 bp, Homo sapiens
  misc_feature: GYAE6OF02HQ787.38.6.A06.1.454.CMB.1.raw
  modified_base (167)..(167): a, c, t, g, unknown or other
  misc_feature (167)..(167): n is a, c, g, or t
tcagtcgatcacgtcacgaccggtgctcgatttagatctactgacagggaggatggagactgggtcccgctcagctcctggggctcctgctgctctggctcccaggtgccagatgtgccatccagttcgacccagtctccatcctccctgtctgcatctgtacgganacagagtcaccatcctacgttcggccgggccagtcgaggtctattagctagttattacgccgttggtactacaacgaaccgaaaaaaccgaggggaaaccacccccgtaagccttccgtaggtacttctactggacctcggtacccttcctaacgtttaggaaccggtaaacgggttccggggtacccctaagttaccgtaacggttcgacgggtcccggtagtagggttacgtcgttaccggtacggggtactaggttacttttaccgaacgttccgtacctaacccttagtacccgtaagtaccgacggtacccgtgtacccgtaacggtcccgtaaggttaactttaacgttttaccgtaactttaaaccgtttattacgtacggtaactaaacgtacgttaactttaaagtttaacgttactttacgttaccgtacggtttaccgggacgggttaaaccgggaaccgttaagggtaaccgttaacggtaacgttaaacgtaaacccgggttaaagtcgggtacgtacgtacgtacccgttaacggtaaccgttttaccgttccggtttaccctttacgtaacccgtttcccctttacccggtaaccttaccgggtttaccgtacggtaaccggttacgg

SEQ ID NO: 10719 - DNA, 831 bp, Homo sapiens
  misc_feature: GYAE6OF02FOWR7.38.6.A06.1.454.CMB.1.raw
tcagtcgatcacgtcacgaccggtgctcgatttagatctactgacagggaggatggacatgagggtccccgctcagctcctggggctcctgctgctctggctcccaggtgccagatgtgccatccagttgacccagtctccactccctccctgtctgctatctgtaggagacagagtccacatcacttggccggccagtcagggctattagctagttactttacgccgttggtataccgaagtaaccaaaaaaaccggtacggggaaaaccgacccccttaaaggtccctttaccgtaggtactttaccgttaagttccgtacccttccgtacccctttacccttaagttttccggaacggtaaaaacggggtttcccgggggtaccctaacgttaccgggttaaaaccgggtttaccgaacgggccgggtacgtagggttacgggttacttacccgggttaggggaacccgtaaggtttaccttttaccgtacctttacctaaccctaaccctaagttcccaacgggaccttaacggttcccgtacgaccgtaccggaccctaaggtaacgttttacgttttacaaacctttaactttaacgtttaccgtacgtttaactaaccttaaaggtttaacttttaacgggtttaaactttcgttacccgttacgggttaccggtttaaccggggaggggtaaaccgggtaacccgttaagggtaccggtaaacgtacaaaccgtaaacgtcgttagtcggtacctacgacctaaccgtcttacgttacgttacccttaccgtactttccccgtccacgttcttacggatacgg

SEQ ID NO: 10720 - DNA, 660 bp, Homo sapiens
  misc_feature: GYAE6OF02HGR5S.38.6.A06.1.454.CMB.1.raw
  modified_base (168)..(168): a, c, t, g, unknown or other
  misc_feature (168)..(168): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
  modified_base (351)..(351): a, c, t, g, unknown or other
  misc_feature (351)..(351): n is a, c, g, or t
  modified_base (594)..(594): a, c, t, g, unknown or other
  misc_feature (594)..(594): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctcctgtctgcatctgtaggagacngagtcacatcacttcgccgggcagtcagggctattagctagttatttagcctggtatcagacaaaaccgaggaagacccctaagcctctgatctatgactcgacctcctacttgacgtaaggttcgggtacctaagtcgtaaggttacngtaccggacgagtaggtntacgttggactaagtntttacctactaccgtctaaccctatacaacgcctaagtcccgtagccgacgtccgtaggtaaacgtttacgttttacgaacctttaacgtttacttaacgtttcggtaactaaacgtacgttaactttaaacgttacgtttactcttaaccgttaccgtttcgggacggtaacgggtaccgtaggtaccgaaggttaccaagtaaaccgtacgttaacggtccgtacgtccgacttacccgtnttccgttacgttccttacgttaccgtttcccgtcccgacttacgttaccgttacggtaccgtacgg

SEQ ID NO: 10721 - DNA, 794 bp, Homo sapiens
  misc_feature: GYAE6OF02IXTXC.38.6.A06.1.454.CMB.1.raw
tcagtcgatcacgtcacgaccggtgctcgatttagatctactgacagggaggatggagactgggtccccgctcagctcctgggggctcctgctgctctggctcccagtgccagatgtgccatccagttgacccgagtctaccactcctaccctgtctgcatctgtaggagacagagtacaccatccacgttcggccgggctagtcacgggactagttaggcctaagtttagtttacgaccgttaggtactacgaagaaaccgaaaaaccgtaggggaaaccgtccctaaacgctcctaaggtactacgtacgtcgcctacgccttacctaagtttcgaaacgtacggtaccgggtaccaacggtacgtaaaggttccgacgggaccggtaccgtaaggttcggtaacgttcggtaacgggtacgtaaacgttaccggtttaactaaccgttaccttaacgtaaccctacgttaaaccgacggaaccccgtaaccgtccccgtaaacggtcccgtaaccggtaacccggttaaggtaaacggtttattttaccggaaactttaccttaacgttaccgtacgtaaacgtaaccgtaatttaccgttaagtttacctaacgttccttacggtaccgtttacgggaaccggagggttaacccgtagggtacctaaggtaactaacccgtaaagggtacgttgaccgggttactaccgaaccttacgtaaccgttacgttccgtacgttaccctttagttccccaacggttacctaggtttacccttaggtacgtaccg

SEQ ID NO: 10722 - DNA, 749 bp, Homo sapiens
  misc_feature: GYAE6OF02H4R9J.38.6.A06.1.454.CMB.1.raw
  modified_base (167)..(167): a, c, t, g, unknown or other
  misc_feature (167)..(167): n is a, c, g, or t
  modified_base (448)..(448): a, c, t, g, unknown or other
  misc_feature (448)..(448): n is a, c, g, or t
tcagtcgatcacgtcacgaccggtgctcgatttagatctactgacaggggaggatggacatgagggtccccgctcagctccgtggggctcctgctgctctggctcccgaggtgccaggatgtcgcatccagttcgacccagtctccactccctccctgtctgcattntggtaggagaccaggcgtccacatcctacgtcggccgggccagtccgaggtctacttagcgttagttattacggcgtggtatcaacgaaacgtaaaacccgagggtaaacccacctaagtcctaccgttagaccttctagtccgccgttaccgtcccttacccgttacgttcggaacggttaccgggttccgggtacctattaggtacgggttccaaggtcgagtcggtaggtgtacggaggtactaggttactttcaccttaccgtaccaactacgaacncggtaacctcccgcttacgacgtacggtaacgtacggttaatttcgtttaactaacttaaaccgtttaagttactaaccggtaattaaccggaactttacgtttaaattcgttaccttccgttacggtaacgttcccggggtaacgggtacgggtacccgtaagggtaacggtaactaaccgtaaacgaaccggttacggtacgtaccgtccttaacccgtccgaacggttacgttcgttacgttcccctttattacccggttcccggtccccgtacttacgttacccggtaggtaccggg

SEQ ID NO: 10723 - DNA, 774 bp, Homo sapiens
  misc_feature: GYAE6OF02JWDTW.38.6.A06.1.454.CMB.1.raw
  modified_base (143)..(143): a, c, t, g, unknown or other
  misc_feature (143)..(143): n is a, c, g, or t
  modified_base (691)..(691): a, c, t, g, unknown or other
  misc_feature (691)..(691): n is a, c, g, or t
  modified_base (745)..(745): a, c, t, g, unknown or other
  misc_feature (745)..(745): n is a, c, g, or t
tcagtcgatcacgtcacgaccggtgctcgatttagatctactgacagggaggatggagactgggtcaactggatggcacatctggcctcccaggtgccagagtgtgccatccagttcgacccagtctccactcctcctgtctncatctgtaggacgacgagacgtcacctatctacgttcggcccgggaccaggtccgagggtactagttacgactagttttacgttacgccgttagggtactacgaacggaacctaaaaaccggtaacgggaaaccgaccccgttaaagtccgtaacctcgttacgttacgtaggtcgaccgttaccgtcccgttaccttacgtttacggaccgtaaaacggttccgggttacccaacgttaccgtacggttcgaacggcgtacgaggtacgtaagtccggtacgacgttacgttacttaccgacttacaccgtaacggtaccacgtacggtactacgttaccgtagtaacccgagttaccgtaacgttaacgtttactttaacgtacccgttttaacttacggttttaaccagttaacctaaacgtactttacgttaaacgtttaagtaccttttacgccgtttaacggtccgaagggtaaacccgagttacggtaacttaccgttagaacccggtaaacgtcgttaccgtggtaacttaccggtaccngtttaagcccgttttactcgttcctaaccgtccctttacgaaccttcgttaacnggtacctacctcggagtacgtcgtacggg

SEQ ID NO: 10724 - DNA, 656 bp, Homo sapiens
  misc_feature: GYAE6OF02JYJ6W.38.6.A06.1.454.CMB.1.raw
  modified_base (594)..(594): a, c, t, g, unknown or other
  misc_feature (594)..(594): n is a, c, g, or t
tcagtcgatcacgtcacgaccggtgctcgatttagatctactgacagggaggatggagactgggtccccgctcagctcctggggctcctgctgctctggctcccaggtgccagatgtgccatccagttgacccagtctccatcctccctgtctgcatctgtagagacagagtcacatcacgtgccggcagtcgagggctagttagctagtttagttacgcctaggtatacgacgaacaaaaccgaggtaaacgacccgtaaagcctacctagtacttctagtacgcttacgacccttaccgtactttacggacgtaacggtcgggtacctacgtacgtaacggttcgacggtcggacgtaaggtttggacgttcggtacggtaactacgtacgttactaacgttccgtaccaacgtacgtacgacgtacgtaaccggtcctacgaccgtacgtcgtaacgtaacgttactttacgaactaacgtttatacgtactaacgaatacgttattaacgttacttaacttcctaacgtacgtttacggacgtaacgggtaccaacggtgaacgtactaacgtaacgttacgtcgacgtntacgacgttactgttacctagttcctacgtactccggttcctacgtactacgtacgtatacg

SEQ ID NO: 10725 - DNA, 636 bp, Homo sapiens
  misc_feature: GYAE6OF02I46V4.38.6.A06.1.454.CMB.1.raw
  modified_base (359)..(359): a, c, t, g, unknown or other
  misc_feature (359)..(359): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (400)..(400): a, c, t, g, unknown or other
  misc_feature (400)..(400): n is a, c, g, or t
  modified_base (430)..(430): a, c, t, g, unknown or other
  misc_feature (430)..(430): n is a, c, g, or t
  modified_base (544)..(544): a, c, t, g, unknown or other
  misc_feature (544)..(544): n is a, c, g, or t
tcagtcgatcacgtcacgaccggtgctcgatttagatctactgacagggaggatggagactgggtcaactggatggcacatctggctcccaggtgccagatgtgccatccagttcgacccagtctccatccctccctgtctgcatcgtgtaggagacagagtcaccatcacttcggccggcagtcgaggctattacgctagtttattcgtccgttagtactacgaacgtaaaccgaaaaaccgaacgggtaaaccgacccctaagaccttccgttagactactagtcgtcctaccgtcccttacctaacgttcgaaccggtaacggttcggtaccctaagtaacgtaggtcgacgcggngtagtcgagtcggtaggaatgtactcacctcaccanacncncacgtcgctgccgagtacgtaagtacgttnttactactttattatcgtaattacgatagttaacctagtacttctcgtaccgttaggtccggagtacggcctaacgtgaacgtactaacgacgagttaccgacgtccgttaacnccttaacgtacgttcttaccgtcgttaccctcgttcccgtacgtaaccttagtacgtactcggtttaacacgtttcgggtacggtaggccgg

SEQ ID NO: 10726 - DNA, 803 bp, Homo sapiens
  misc_feature: GYAE6OF02IZ347.38.6.A06.1.454.CMB.1.raw
  modified_base (155)..(155): a, c, t, g, unknown or other
  misc_feature (155)..(155): n is a, c, g, or t
  modified_base (203)..(203): a, c, t, g, unknown or other
  misc_feature (203)..(203): n is a, c, g, or t
  modified_base (221)..(221): a, c, t, g, unknown or other
  misc_feature (221)..(221): n is a, c, g, or t
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
tcagtcgatcacgtcacgaccggtgctcgatttagatctactgacagggaggatggagactgggtcaactggatggcacatctggctcccaggtgccagatgtgccgtccagttcgacccagtctccatccctccctgtctagcatctgtagganacagacgtcaccagtcacttcgccggacagtcgacggactagttacgntagttattagccgtagtnacacgaacaaaaccgtaggaaccaccctaagctaccgtgactntacngctcgtcctacctacgttcgaacgtaacgggtccgggtaaccagttaacggaacggttacacgggtcggtaccgaggtacggtacgtcggtacggacgtacgttacttacctacctacgtaccttacgacttacgaacgccgtaacgtccgtacgtactaccggttacgtaaacggttaacttttaacggtttaccgtaacctttaaacttttaacccggtaacgttaacccgttaaccgttaaaacggacttttaaccgttaaagtttaaccggtttaacttacccgtaccgttttaaacgggtccgggaacgttaaacccggggttaccgtaaaccgggtacggtaaaaccacggttaaaccgaaaccgggttacgtacgggtccgtaacgttaccgtaaactaccggttaactttcggttaaccgtttacgtaccgttacccgttcccggtttaaccccacgttaaacggttcccgtaaacggtttaacgtccgaacgtttaacccgggatacccgggtggggtaacccggg

SEQ ID NO: 10727 - DNA, 772 bp, Homo sapiens
  misc_feature: GYAE6OF02JG6YU.38.6.A06.1.454.CMB.1.raw
  modified_base (539)..(539): a, c, t, g, unknown or other
  misc_feature (539)..(539): n is a, c, g, or t
  modified_base (726)..(726): a, c, t, g, unknown or other
  misc_feature (726)..(726): n is a, c, g, or t
tcagtcgatcacgtcacgaccggtgctcgatttagatctactgacagggaggatggagactgggtccccgctcagctcctggggctcctgctgctctggctcccgaggtgccagatgtgccatccagttcgaccagtactccatccctcctgtctcgactatcgtaggtaggagacagacgtaccacatctacgtcggccggtcctagtacggacgggtactaagttacgacgttaagtttacgttaaccggtcccggttaaggttacctaccgaaaccgggtaaacccgtaaaaaaaccgggaacgggggtaaaaccccgtacccccgttaaagtcccgttacccgttaaggtaccttaaccggttaaggtcccggttcggtcccgtacccccgtttacccgttaaccgttttacgggaaccgggttaaacggggttcccgggtacccttaacggtagtaaccggtacgtacggacggtaccggtagtaccgggtactacggcggtaactacttacgttacactcgaccctagtaacncgacgactcgccgtcgacgacttcgagttagttaacgttcgaacttaagttactgtacgtaactacgacttagttacgtactttcgtaaccttcgtaccggttacggacggtacgtaacgtagacgtaagaccgttaaccgtaaatccggttagaccgagtaccgctaacgttactcttacgttacnccttacccggtcgtacccgtacttacggtaccgtaggtcgtaccgg

SEQ ID NO: 10728 - DNA, 855 bp, Homo sapiens
  misc_feature: GYAE6OF02F685Y.38.6.A06.1.454.CMB.1.raw
tcagtcgatcacgtcacgaccggtgctcgatttagatctactgacagggaggatggacatgacgggtccccgctcagctccgtggggctcctgctgctctggctcccgaggtcgccagatgtgccatccagttcgacccagtcctcctactcccttccctgtctgctattcgtggtaaggagaccagtacgtccacctataccgtacgttcggacccgggtcaacggtcgacgggtctagttacgacttaagtttacgttacggaccgttagggtaactaccgaaacgtaaaaccgaaaaaaccggtaggggaaacctaccccgtaaaggcccttaccgtagaacttctaacgtcgtccttacgccccgttaccttacgttacggaaccgtaaacgggtttccgggacccctaacgtacgttaaacgggttcgacggtaccggtaccgtagggttaccggacgttccgggtaaacggggtactaacggtttacctttacctaacccggttccctacgtaacccgtacgttaccgacggccgtaaccgtcgttaccggacgtaaccggtacgtaaacgttaaggtttacttttaacggaccttttaaaacgtttccttacggttaaccgtaccgttaaaaccgtgttttaaaccgttaagtttaacgttccgttaccgtttaaccgtttccgggtttaaacgggaccgggtaaaaccggggtacttaccggggaaaccgtacgtaaaccgttaaacgtaacggaacgttcggtacggtctaacgaccgttacttacgtccggttcctacgtttacgcccctttaccgttccccgtagtcgttaggtaccggtaccg

SEQ ID NO: 10729 - DNA, 649 bp, Homo sapiens
  misc_feature: GYAE6OF02F2HA5.38.6.A06.1.454.CMB.1.raw
  modified_base (244)..(244): a, c, t, g, unknown or other
  misc_feature (244)..(244): n is a, c, g, or t
  modified_base (340)..(340): a, c, t, g, unknown or other
  misc_feature (340)..(340): n is a, c, g, or t
  modified_base (640)..(640): a, c, t, g, unknown or other
  misc_feature (640)..(640): n is a, c, g, or t
tcagtcgatcacgtcacgaccggtgctcgatttagatctactgacagggaggatggagactgggttcaactggatggcacatctggctcccaggtgccagatgtcgccatccagttgacccagtctccatcctccctgtctgcatctgtaggagacagagtcaccatcacttcgccggtccagtcgagggctattagctagtttatttagccgttggtactcaagacaaaaaccgagggaaacncccctaagctacctgatctatgctcgcctctacgtttgactaacggtcgggtcccatcgtaaggttcacggcgtacgaggtcggatcggtggaacngttactttacactcctaccacctagtcacgcacgtcctacgcctacgctaggtaatttacgttttcgaactttaactttacttaccgttacgtacctaacgtacttaacgtttaaagttaagtttacctccgtttacttaccggtttacggggaccgggtaacgggtaaccgtaagggttacgagtaactaaccgaacgttacgtcgtcggtaccacggtctaacgtacttccgtcgttaccttcgttaccttcctttacccgacttcgtaccgttactacggttcgtacgtacgtacgnggtaccggg

SEQ ID NO: 10730 - DNA, 704 bp, Homo sapiens
  misc_feature: GYAE6OF02I44PR.38.6.A06.1.454.CMB.1.raw
  modified_base (166)..(166): a, c, t, g, unknown or other
  misc_feature (166)..(166): n is a, c, g, or t
  modified_base (393)..(393): a, c, t, g, unknown or other
  misc_feature (393)..(393): n is a, c, g, or t
tcagtcgatcacgtcacgaccggtgctcgatttagatctactgacaggggaggatggagactgggtccccgctcagctcctggggctcctgctgctctggctcccaggtgccagatgtgccatccagttgacccagtctccatcctcctgtctgcatctgtagganacagagtcaccatctacgttcggcccgggccacgtcgagggactagttacgactaaggtttactttacggccgttgggttactacgaacgtaaccgaaaaaccgacggggaaaactccccgtaaagtcctacctagacttactaatcgtctcgccctcctacgtttgacgtaaaggttcggggtaccctagtactaacgggttcgagcggactaggttgcttacggngggtactacgttacttacactcctacacctattacgacgacgtacgtccttacgacctacgtaccgtagtaaacgtttatttacggaaccttagttttaacttaccgtaggtaaccaaccgtagttaactttaacttacgttactttctaccttacggttaccgggacggtacggtaacgtacggtaacgtaggtaacctaaccggtaaacgtaccgttaggcgtctaccgacggtcctaacgttcgttcgttacttacccgtacgtttaccccgttccgtaccttacgtacggttaggtcccggttaacg

SEQ ID NO: 10731 - DNA, 701 bp, Homo sapiens
  misc_feature: GYAE6OF02FS9HA.38.6.A06.1.454.CMB.1.raw
  modified_base (172)..(172): a, c, t, g, unknown or other
  misc_feature (172)..(172): n is a, c, g, or t
  modified_base (694)..(694): a, c, t, g, unknown or other
  misc_feature (694)..(694): n is a, c, g, or t
tcagtcgatcacgtcacgaccggtgctcgatttagatctactgacagggaggatggacatgagggtccccgctcagctcctggggctcctgctgctctggctcccaggtgccagatgtgccatccagttcgacccagtcctccactccctccctgtctgcatctggtagganacagagtcacctatcacgttcggccgggctaggtaccgagggtctattacggactaggtttaacgttacgccgttagggttaactaccgaagaaacccgaaaaaaccggtaagggaaaccgtaccccgtaaagtcctaccgtacgtactacgtagtcgtctcgtccttacctagttcgacgtaacggtccgggtaccagtactaagggttcacggtcggacgtaggttacgtacgtcggtacggacgtacgttacgttaccgaccgttcgtacccgactaaccgttacgaacggccgtaaccgtcccggttacgaccgtacggtacgtaacggtaagttcggtttaacgcttaaacgtttacgtaccttacgtacgaacttaggtacttaagtttaccttagtaccgttagtaccggttaccgggacggtaccggagacgttagacgtaacaactacggatcggactacgtcgacctgtactggttctacgttacgccttacccgtccttactacgtacgtnttaacgg

SEQ ID NO: 10732 - DNA, 639 bp, Homo sapiens
  misc_feature: GYAE6OF02I705C.38.6.A06.1.454.CMB.1.raw
  modified_base (247)..(247): a, c, t, g, unknown or other
  misc_feature (247)..(247): n is a, c, g, or t
  modified_base (630)..(630): a, c, t, g, unknown or other
  misc_feature (630)..(630): n is a, c, g, or t
tcagtcgatcacgtcacgaccggtgctcgatttagatctactgacagggaggatggagactgggtcaactggatggcacatctggctcccaggtgccagatgtgccgtcagttgacccagtctccatcctcctgtctgcatctggtaggagacagagtcaccatcacttgcggccagtcaggtcattagctagtttattcgcctaggtatcacgaacaaaaccgaggaacctacctagctccagtanctatgctcggaccctcactttgacgtaaacggtcggtaccctattacggtaaggttcgaaggcggtacgaggtacggtacgtcggtaaggaactaggttaccttcgaccctctacgtacctagaccgtgacctacgtcccgaggctaacggctacgtaagttacttttacggaactaactttaacgttctacgtactaaacgtattaacgttaagtaattctacgtaccgttacgggtacggacggtaacgtaccgggtaacgtacgtacgtactaaccgtaaagtaccgtacgtgtaccgtcggtactaacacgttcgttctacgttactccgttacctaacggtctaacttcggtataacggtgtaccgtagcggttacgngtacccggg

SEQ ID NO: 10733 - DNA, 766 bp, Homo sapiens
  misc_feature: GYAE6OF02JQN6J.38.6.A06.1.454.CMB.1.raw
  modified_base (309)..(309): a, c, t, g, unknown or other
  misc_feature (309)..(309): n is a, c, g, or t
  modified_base (327)..(327): a, c, t, g, unknown or other
  misc_feature (327)..(327): n is a, c, g, or t
  modified_base (512)..(512): a, c, t, g, unknown or other
  misc_feature (512)..(512): n is a, c, g, or t
tcagtcgatcacgtcacgaccggtgctcgatttagatctactgacagggaggatggagactgggtccccgctcagctcctgggggcctcctgctgctctcggctcccaggtcgccagatgtcgccatccagttcgacccagtcctccactccctcctgtctgcatcgtgtacggagacaggctaccacctatccgtaccgttcgggacccgggtacctaggtacgacgggaccttaagttacggtacgttaagtttacttacgccggttaggtactaccgaacgaaccgaaaaaccgacggggtaaccncccgtaacgtcctacgtntaactcgtatcgcctcgtaccctaccgttactacggacggtaacgggtccggtaaccagtacggtacggtcgacggacggtacgaggtcggtacgttacggtacggaacggtacgttaccttccgtacgtacctacaaccggtactcggacgctacgtcgacgactacgtgtacgtattaccgtntaaccttagtactcgtacactaacgtacttacttaattacgttacctcggtttccgtacgggtttaccggaaagggtacccgggtaacgtacgggtttaacgaaccggttaaccgaaacggttaaccgtagggttaaccgggtcaaccggttaccgttaccctaacggtttcctttaacgtacccgtttccgtacccgttaccgtttccccgggtacctaccgttacggtttaacgacgggtttacccgtacgg

SEQ ID NO: 10734 - DNA, 876 bp, Homo sapiens
  misc_feature: GYAE6OF02JG2DA.38.6.A06.1.454.CMB.1.raw
tcagtcgatcacgtcacgaccggtgctcgatttagatctactgacagggaggatggacatgagggtccccgctcagctcctgggctcctgctgctctggctcccaggtgccagatgtgccatcctaggttcgacccagtctccattcctccctgtctgcatcgtggtaggagacagtagtcaccgatccgacgttggcccgggaccaggtcgtaggggcctaagttacgcgtaagtttagtttacgaccttaggtactcaaggaaccaaaaaaccggtacggggaaacgtaccccctaaagtcccgttaccgtacgtaacttacctaagtcgtaccgttaccgtaccccttacccgtaacgttttaggaccgtaaaacgggttccggggttaccccaagttaccggtaaacggtttcgaacgggtccgggtaacgtacgggttacggtaaccgttcggtagggggtaaacctaaggttaacttttaacccgacttccgtactaacccgtacgtcgtaacggacccgtacgtaccgttacggacctaaccggtacccgttaacggtaaacgtttaacgttttacgtaaaccttaaacgtttaacttaaccgttacgtaaccgtaaactaacgttaagtttaaacgtttacgtttaacgtccgtttaacccgttacggttaccggggaccgggtaacgggttaaacccggtaagggttaaccggaacgtaacgttaaaccgtaaaccggttaacgtttacggtccgggttacgttacgaaccgttaacccggttaactttaacggttccgtttaccgttttaacgtaccgttttcccttaaccccggtaactttacgtttaccggtacggttaaccgg

SEQ ID NO: 10735 - DNA, 145 bp, Homo sapiens
  misc_feature: GYAE6OF01DTWIL.53.12.B01.1.454.CMB.1.raw
  modified_base (145)..(145): a, c, t, g, unknown or other
  misc_feature (145)..(145): n is a, c, g, or t
tcagcgcgtatacacacgaccggtgctcgatttagtagtgtagattccgcgggcacgaccggtgctcgatttagtagtgtagattcgcgggggatggcctccctcgagtctacagtgctctgagcgggctggcaaggcgcatagn

SEQ ID NO: 10736 - DNA, 144 bp, Homo sapiens
  misc_feature: GYAE6OF01B62TZ.53.12.B01.1.454.CMB.1.raw
  modified_base (144)..(144): a, c, t, g, unknown or other
  misc_feature (144)..(144): n is a, c, g, or t
tcagcgcgtatacacacgaccggtgctcgatttagtagtgtagattccgcgggcacgaccggtgctcgatttagtagtgtagattcgcggggatggcctccctcgagtctacagtgctctgagcgggctggcaaggcgcatagn

SEQ ID NO: 10737 - DNA, 105 bp, Homo sapiens
  misc_feature: GYAE6OF01E4B4B.53.12.B01.1.454.CMB.1.raw
tcagcgcgtatacacacgaccggtgctcgatttagtagtgtagattccgcggggatggcctccctcgagtctacagtgctctgagcgggctggcaaggcgcatag

SEQ ID NO: 10738 - DNA, 197 bp, Homo sapiens
  misc_feature: GYAE6OF01BFI68.53.12.B01.1.454.CMB.1.raw
  modified_base (193)..(197): a, c, t, g, unknown or other
  misc_feature (193)..(197): n is a, c, g, or t
tcagcgcgtatacacacgaccggtgctcgatttagtagtgtagattccgcgggcacgaccggtgctcgatttagtagtgtagattccgcgggcgacgaccggtcgctcgatttagttagtgtagattcgtcgggggaggtggccgtccctccgagtctacagtgctctgagcgggcgtggcaagcggcatagnnnnn

SEQ ID NO: 10739 - DNA, 151 bp, Homo sapiens
  misc_feature: GYAE6OF01B80BJ.53.12.B01.1.454.CMB.1.raw
  modified_base (114)..(151): a, c, t, g, unknown or other
  misc_feature (114)..(151): n is a, c, g, or t
tcagcgcgtatacacacgaccggtgctcgatttagtagtgtagattccggacggggggatgggcctcccctcgagtctacagttcgctctgagcgggctggcaaggcgcatagnnnnnnnnnnnnnnnnnnnnnnnnnnnnnnnnnnnnnn

SEQ ID NO: 10740 - DNA, 105 bp, Homo sapiens; identical to SEQ ID NO: 10737
  misc_feature: GYAE6OF01CLEO5.53.12.B01.1.454.CMB.1.raw

SEQ ID NO: 10741 - DNA, 166 bp, Homo sapiens
  misc_feature: GYAE6OF01ELS27.53.12.B01.1.454.CMB.1.raw
  modified_base (144)..(166): a, c, t, g, unknown or other
  misc_feature (144)..(166): n is a, c, g, or t
tcagcgcgtatacacacgaccggtgctcgatttagtagtgtagattccgcgggcaccgaccggtgctcgatttagtagtgtagattcgcggggatggcctcctcgagtctacagtgctctgagcgggctggcaaggcgcatagnnnnnnnnnnnnnnnnnnnnnnn

SEQ ID NO: 10742 - DNA, 106 bp, Homo sapiens
  misc_feature: GYAE6OF01EI9F8.53.12.B01.1.454.CMB.1.raw
  modified_base (106)..(106): a, c, t, g, unknown or other
  misc_feature (106)..(106): n is a, c, g, or t
tcagcgcgtatacacacgaccggtgctcgatttagtagtgtagattccgcggggatggcctccctcgagtctacagtgctctgagcgggctggcaaggcgcatagn

SEQ ID NO: 10743 - DNA, 185 bp, Homo sapiens
  misc_feature: GYAE6OF01CD62W.53.12.B01.1.454.CMB.1.raw
  modified_base (183)..(185): a, c, t, g, unknown or other
  misc_feature (183)..(185): n is a, c, g, or t
tcagcgcgtatacacacgaccggtgctcgatttagtagtgtagattccgcgggcacgaccggtgctcgatttagtagtgtagattccgcgggcacgaccggtgctcgatttagtagtgtagattcgcggggatggcctccctcgagtctacagtgctctgagcgggctggcaaggcgcatagnnn

SEQ ID NO: 10744 - DNA, 147 bp, Homo sapiens
  misc_feature: GYAE6OF01D2T0E.53.12.B01.1.454.CMB.1.raw
  modified_base (146)..(147): a, c, t, g, unknown or other
  misc_feature (146)..(147): n is a, c, g, or t
tcagcgcgtatacacacgaccggtgctcgatttagtagtgtagattccgcgggcacgaccggtgctcgatttagtagtgtagattccgcgggggatggcctccctcgagtctacagtgctctgagcgggctggcaaggcgcatagnn

SEQ ID NO: 10745 - DNA, 145 bp, Homo sapiens
  misc_feature: GYAE6OF01BMV4L.53.12.B01.1.454.CMB.1.raw
  modified_base (145)..(145): a, c, t, g, unknown or other
  misc_feature (145)..(145): n is a, c, g, or t
tcagcgcgtatacacacgaccggtgctcgatttagtagtgtagattccgcgggcacgaccggtgctcgatttagtagtgtagattcgcggtggatggcctccctcgagtctacagtgctctgagcgggctggcaaggcgcatagn

SEQ ID NO: 10746 - DNA, 116 bp, Homo sapiens
  misc_feature: GYAE6OF01ANKYP.53.12.B01.1.454.CMB.1.raw
  modified_base (107)..(116): a, c, t, g, unknown or other
  misc_feature (107)..(116): n is a, c, g, or t
tcagcgcgtatacacacgaccggtgctcgatttagtagtgtagattccgcgggggatggcctccctcgagtctacagtgctctgagcgggctggcaaggcgcatagnnnnnnnnnn

SEQ ID NO: 10747 - DNA, 147 bp, Homo sapiens
  misc_feature: GYAE6OF01BYRJT.53.12.B01.1.454.CMB.1.raw
  modified_base (147)..(147): a, c, t, g, unknown or other
  misc_feature (147)..(147): n is a, c, g, or t
tcagcgcgtatacacacgaccggtgctcgatttagtagtgtagattccgcgggcacgaccggtgctcgatttagtcgagctctctcgcgggcacgaccggtgctcgatttagtctagcgacttcagcgggctggcaaggcgcatagn

SEQ ID NO: 10748 - DNA, 145 bp, Homo sapiens; identical to SEQ ID NO: 10735
  misc_feature: GYAE6OF02IZLO9.53.12.B01.1.454.CMB.1.raw
  modified_base (145)..(145): a, c, t, g, unknown or other
  misc_feature (145)..(145): n is a, c, g, or t

SEQ ID NO: 10749 - DNA, 156 bp, Homo sapiens
  misc_feature: GYAE6OF02HS44X.53.12.B01.1.454.CMB.1.raw
  modified_base (82)..(82): a, c, t, g, unknown or other
  misc_feature (82)..(82): n is a, c, g, or t
  modified_base (131)..(131): a, c, t, g, unknown or other
  misc_feature (131)..(131): n is a, c, g, or t
  modified_base (153)..(156): a, c, t, g, unknown or other
  misc_feature (153)..(156): n is a, c, g, or t
tcagcgcgtatacacacgaccggtgctcgatttagtagtgtagattccgcgggcacgaccggtgctcgatttagtagtgtanattccgcgggcacgaccggtgctcgatttagtatctgatagttgggttnagcggcgtgcgagaggcatagnnnn

SEQ ID NO: 10750 - DNA, 145 bp, Homo sapiens; identical to SEQ ID NO: 10735
  misc_feature: GYAE6OF02HVEGS.53.12.B01.1.454.CMB.1.raw
  modified_base (145)..(145): a, c, t, g, unknown or other
  misc_feature (145)..(145): n is a, c, g, or t

SEQ ID NO: 10751 - DNA, 106 bp, Homo sapiens; identical to SEQ ID NO: 10742
  misc_feature: GYAE6OF02F16XF.53.12.B01.1.454.CMB.1.raw
  modified_base (106)..(106): a, c, t, g, unknown or other
  misc_feature (106)..(106): n is a, c, g, or t

SEQ ID NO: 10752 - DNA, 146 bp, Homo sapiens
  misc_feature: GYAE6OF02F1Q07.53.12.B01.1.454.CMB.1.raw
  modified_base (146)..(146): a, c, t, g, unknown or other
  misc_feature (146)..(146): n is a, c, g, or t
tcagcgcgtatacacacgaccggtgctcgatttagtagtgtagattccgcgggcacgaccggtgctcgatttagtagtgtagattccgcgggggatggcctccctcgagtctacagtgctctgagcgggctggcaaggcgcatagn

SEQ ID NO: 10753 - DNA, 107 bp, Homo sapiens
  misc_feature: GYAE6OF02FSYCI.53.12.B01.1.454.CMB.1.raw
  modified_base (106)..(107): a, c, t, g, unknown or other
  misc_feature (106)..(107): n is a, c, g, or t
tcagcgcgtatacacacgaccggtgctcgattagtagtgtagattccgcggggtatggcctccctcgagtctacagtgctctgagcgggctggcaaggcgcatagnn

SEQ ID NO: 10754 - DNA, 541 bp, Homo sapiens
  misc_feature: GYAE6OF01B6HQW.17.42.D09.1.454.CMB.1.raw
tcagcgtagactagcacgaccggtgctcgatttagacacatacgcagggaaaggggctgggcaccaggggtccctttccaatatcagcaccagtggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctcctcgttgggggcaaagctgccctgaccctttcgggtgcgcagcctgaggatgaggctgagtattactgcttgctctcctatgtggtgttcggtgttcggcggagggaccagctgaccgtcgtaggtcaggcccaaggcctagccccctcgggtccacgttcctcgttccccaccccttccctcctgttcccg

SEQ ID NO: 10755 - DNA, 544 bp, Homo sapiens
  misc_feature: GYAE6OF01BS9TJ.17.42.D09.1.454.CMB.1.raw
  modified_base (456)..(456): a, c, t, g, unknown or other
  misc_feature (456)..(456): n is a, c, g, or t
  modified_base (525)..(525): a, c, t, g, unknown or other
  misc_feature (525)..(525): n is a, c, g, or t
tcagcgtagactagcacgaccggtgctcgatttagacacatacgcagggaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattactccctactggttccaacagaagcctggccaagcccccaggacactgatttatgatacaaacaacaaacactcctgacccctcgcccgttctcacggctccctcgtcggggcaaagctgccctgaccctttcgggtcgcgcacgcctggaggagtggaggcgtgagtattactgtcttggctctctatagtggttgttcggtgttcggnggagggaccaagctgaccgtcgtaggtcagcccgaaggccgtcgcccccgtcggccactctcgtccccncccttcctccgtcgtcccg

SEQ ID NO: 10756 - DNA, 568 bp, Homo sapiens
  misc_feature: GYAE6OF01A0T2A.17.42.D09.1.454.CMB.1.raw
  modified_base (415)..(415): a, c, t, g, unknown or other
  misc_feature (415)..(415): n is a, c, g, or t
  modified_base (477)..(477): a, c, t, g, unknown or other
  misc_feature (477)..(477): n is a, c, g, or t
tcagcgtagactagcacgaccggtgctcgatttagacacatacgcagggaaaggggctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggagctgtcaccaatggtcattactccctactggttaccaacagaacgcctggccaacgcccccaggacactgatttatgatacaaacaacaaacactcctacggacccctcgcccggttctcgacggcctcccgtcggttcggggacaaacgtctcgccctgtaccccgtttcgggtcgcgcacgtccnggaggatggaggtctgagtattactgcttagctctcctagtagtggtgttcgggtgttcggnggacggaccagctgaccgtcgtaggtcacgcccgaaggccgtaccgccccgtcggccactcgtccgttccccgccctcctccgagttcccg

SEQ ID NO: 10757 - DNA, 737 bp, Homo sapiens
  misc_feature: GYAE6OF01C84CY.17.42.D09.1.454.CMB.1.raw
  modified_base (172)..(172): a, c, t, g, unknown or other
  misc_feature (172)..(172): n is a, c, g, or t
  modified_base (228)..(228): a, c, t, g, unknown or other
  misc_feature (228)..(228): n is a, c, g, or t
tcagcgtagactagcacgaccggtgctcgatttagacacatacgcagggaaaggggctggcaccaggggtcccttccaatatcagcaccatggcctggactcctctctttctgttcctcctcacttgctgcccagggtccaattcccaggctgtggtgactcaggagccctnactgactgtgtccccaggagggacagtcactctcacctgtggctccagcactgganctgtcaccatggtcattactccctactggttaccaacagaacgcctcggccaacgccccctaggacctacgtgtacttatagactaacaaacaacaaacactacctcggaacccctcgtccccggttctccgacggtccttcccggtcgggtttacgggggacctaaaacggccgtacgtaccccgttacggtaccccggtttttccggggcgtccggtcccgaacggtcccgtagggtaacgggtacgttacgggaacgggtccgttaggtacgttaactttaacgtcgttacgttcgtccctttccgtaccttaggtttacgggttcggtttacgggtttccgggtcggtttccggggacgggtacgggtaccgaacggtcgtacggtaccgttccggtacggtcgaccggacccgtacgggtcccgtcccggtcccccggttcggtcctacccgttccgttacccggttcccccgtacccgttccccttccgttacgttaccccgg

SEQ ID NO: 10758 - DNA, 715 bp, Homo sapiens
  misc_feature: GYAE6OF01EWMRO.17.42.D09.1.454.CMB.1.raw
tcagcgtagactagcacgaccggtgctcgatttagacacatacgcagggaaaggggctggcaccaggggtcccttccaatatcagcaccatggcctggactcctctctttctgttcctcctcacttgctgcccagggtccaattcccaggctgtggtgactcaggagccctcactgactgtgtccccaggaggacagtcactctcacctgtgctccagcactggagctgtcacatgtcattactcctactcggttccaacagaacgcctggaccaacgcccccaggacactgatttatgataacaaaacaacaaacactcctcggacccctgtcccgttctcgacgtcctcccgtgggtcggggacaagtccgtcgccctcggtaccccgtttcgggtcgcgcgtacgccgtaggacggtagtggacggtcgtaggtaagttaacgttacgtggtctttcgtccttccttacccgtaagtttcggttcgggtttcggtttccggggttgggttaccggggtacggggtaacgggtaacccgtaaacgggtccgtaccgggtacccgtttaccggtcggtaaccggtacccggtaccccgtaaacggggtccccttacccgggccccccgtttccggggtaccctaacccgtttccccgttacccggttacccccctaacccccggtttcccttaccccgtaccgtttaaccccgg

SEQ ID NO: 10759 - DNA, 1002 bp, Homo sapiens
  misc_feature: GYAE6OF01DWMNB.17.42.D09.1.454.CMB.1.raw
tcagcgtagactagcacgaccggtgctcgatttagacacatacgcagggaaaggggctggcaccaggggtcccttccaatatcagcaccatggcctggactcctctctttctgttcctcctcacttgctgccagggtccaattccaggctgtggtgactcaggagccctcactgactgtcgtccccgaggaggacagtcactctcaccgtgtgctccagcacgtggagctgtccacctaagttcggtctaacttacgttcccgttacgttacggttaccaaacgacggtaaacgtccgttacgggacccaaacccggtaccccccgaagggtaccctaaccgtaggttaaactttttaacgtaacggtaaaccttaaaccgtaaaaaccctaaaccgtaaaaacccttaccgttaccccgttaacccggggtaaccccccgtttaccgggtacccccggttttaccgttaaccggtaaccgggttcccgtttcccccgggtttaccgggggtttaccgggggggaacccttaaaacgggtcccgttaacccgggttaccccccggtttaaccggggttaacccccgggtttttttcgggggaccccgggttaccccgggtacggtaacccgggttcccgggttaagggtaaccgggtacggttacggggtaacgggtaccggtttacgggttaacggtttaacgtttacgttccggttcggtttccgttcccgttccgtttaccggtttaaggtttaacgggtttcggggtttcgggttttaccgggggttaacgggtttccgggggtaacggggtaaccggggtaccgaaacgggttccggttaaccgggtcccggttacggtaccgggtaccggtaccggtacccggtaaccggtcccgggttacccggttcccccggttcgggttaacccgttacccgttcccggtttaccccggttcccccgttacccgtttccccgtacccggtttacgttacccgg

SEQ ID NO: 10760 - DNA, 772 bp, Homo sapiens
  misc_feature: GYAE6OF01BSAE5.17.42.D09.1.454.CMB.1.raw
  modified_base (764)..(764): a, c, t, g, unknown or other
  misc_feature (764)..(764): n is a, c, g, or t
tcagcgtagactagcacgaccggtgctcgatttagacacatacgcagggaaaggggctggcaccaggggtcccttccaatatcagcaccatggcctggactcctctctttctgttcctcctcacttgctcgcccgagggtccaacttcccaggctggtggtgactcgaggacgccctcactgacgtggtcgtccccgagggacgggacacgtcactctcaccgtgtcggcctccagtccacgtggacgcgtcgtaccaacctaagttcggtactacttactcccgttagtaccggttaccaacgtaagacgccgtacgaccgaaccgacccgagacctacgtagtattactacgaactaaaccaaacaaactaaacctaccgttacccgtaccggtaccccgttccggtaccccgttcgaccgtaccggtcccgttaccggtcgggttcggggaactaacgtccgtaccggtcccgtccgggttacccggtttcgggccgtacccggacgtccggacggtggtacgggtgtacgggcgtagtagtacgttacgtcgtcgttctcgtcttccgttacgttaggttcgggttcgggttggtttcggggtcgggtacgggtacgggaaccggtacgtacgttccggtccgtaccgggttaccgtacgggaccgtaccggtaccggcccggtcccgtccccggttccccggtctaccccgttacccttcccgtcccccgttacccctaccccgttcctaacccgggtntacccggg

SEQ ID NO: 10761 - DNA, 815 bp, Homo sapiens
  misc_feature: GYAE6OF02I41GS.17.42.D09.1.454.CMB.1.raw
  modified_base (165)..(165): a, c, t, g, unknown or other
  misc_feature (165)..(165): n is a, c, g, or t
  modified_base (276)..(276): a, c, t, g, unknown or other
  misc_feature (276)..(276): n is a, c, g, or t
tcagcgtagactagcacgaccggtgctcgatttagacacatacgcagggaaaggggctggcaccaggggtcccttccaatatcagcaccatggcctggactcctctctttctgttcctcctcacttgctgccagggtccaattcccaggctgtggtgactcaggngccctcactgactgtgtccccaggagggacagtcactctcacctgtggctccagcacgtggagctgtcaccaagtcggtcattactccctactcggttaccaacaggaacnccgtcggacccaacggcccccccgtaaggacctacgtagtacttttagtgaacttaaccgaaaacaaccaaaaacctacccgttccgtaacccgggtaccccctacggttcccccggtttaccgttccgaccgggtcccctttaccccgggttccggggtttacggggggaacctaaaacggtccgttccggtaccccttcgggttacccccggttttcgggggaccgccggtaccgtaaccgtcccggtgggaacggtcggtacgggtacgggtacgtaggtaacgtttacgttaccgtcggttccgttccggttcctaccgttaccggttacgttaggggtttcccgggttgggtttacggggttcgggttacggggaccgggtaacgggaccgtaggtcccggtacggtacccggttacgtacggtaccgacccggaccggtaccggcccgttaccccggtacccggttaccggttccctacccgtttcctacccggttacccccctaccgttccccttaccggtcttaccccggg

SEQ ID NO: 10762 - DNA, 864 bp, Homo sapiens
  misc_feature: GYAE6OF02JY2K7.17.42.D09.1.454.CMB.1.raw
  modified_base (219)..(219): a, c, t, g, unknown or other
  misc_feature (219)..(219): n is a, c, g, or t
  modified_base (302)..(302): a, c, t, g, unknown or other
  misc_feature (302)..(302): n is a, c, g, or t
tcagcgtagactagcacgaccggtgctcgatttagacacatacgcagggaaaggggctggcaccaggggtcccttccaatatcagcaccatggcctggactcctctctttctgttcctcctcacttgctgccagggtccaattcccaggctgtggtgactcaggagccctcactgactgtgtccccaggagggacagtccactctcactgtggctccancacgtgagcgtgtcaaccaagtgtcagttctaccctacgtggttccaagacgaaggcctggacccaacgccccccgaagggtnaaccttacggatttacgtacgaacttaaccaaaacgaaacctaaacaccttacccgtacgggaaccccccttcggtacccccggtttactccggtaacggtaccccttccgggtttacccggggtttacgggggaaccttaaaacggtcccgtttccggtaaccccggttaccggtttaaccccgggttttccgggggttaacggtcccggaccgttacccggtacgtttaccgggaagggtaacctttcggggacgggtaccgttacgttaaagggtttaccgtttaatcccggtacggtttaacttccggttaaccttcccgttaaagggttcgggttttcgggtttcgggtttacggggttttccgttaccggggggaccgttaaacggggttacccacgggttactttacccgggttaacccggtcgtttaaaggtccccggaacttcccggaacggttccccgtaccgttaccccgggttaacgttaccctcccggtttaccgttacccggtccccccgttacccgtttaccccggtccctttaaacggtcccccgg

SEQ ID NO: 10763 - DNA, 291 bp, Homo sapiens
  misc_feature: GYAE6OF01AUSW7.40.16.B05.1.454.CMB.1.raw
  modified_base (288)..(291): a, c, t, g, unknown or other
  misc_feature (288)..(291): n is a, c, g, or t
tcagtctagcgactcacgaccggtgctcgatttagagctcacgtaagggtcaggggtccctgatcgcttctctggctccaagtctggcaacacggcctccctgaccatctctgggctccaggctgaggatgaggctgattattactgctgctcatttgcaggtagtttttgggtgttcggcggagggaccaagctgaccgtcctaggtcagcccaaggctgccccctcggtcactctgttcccaccctcctcagtcgctagactgagcgggctggcaaggcgcatagnnnn

SEQ ID NO: 10764 - DNA, 565 bp, Homo sapiens
  misc_feature: GYAE6OF01D32NV.40.16.B05.1.454.CMB.1.raw
  modified_base (533)..(533): a, c, t, g, unknown or other
  misc_feature (533)..(533): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgcgggcagggactggagtggattgggcgcgtctatcacagtgaaaccagctacactcccctcctcgagagtcgagtcaccatttcactagacacgtccaacaaatcagttgtccctgaggctgagctctgtcgaccgccgcggacacgggctatattactggtgcggagggacgggggggacccgggggaaactccgtagtcggcttccgtttgactacgtggggccacgggaccctggtccaccgtctcctcgacgccctccaccgaacgggcccagttccggtcccttcccccgnggcccgcccctgcctccgacggcgccgacccg

SEQ ID NO: 10765 - DNA, 618 bp, Homo sapiens
  misc_feature: GYAE6OF01DS6GC.40.16.B05.1.454.CMB.1.raw
  modified_base (197)..(197): a, c, t, g, unknown or other
  misc_feature (197)..(197): n is a, c, g, or t
  modified_base (293)..(293): a, c, t, g, unknown or other
  misc_feature (293)..(293): n is a, c, g, or t
  modified_base (578)..(578): a, c, t, g, unknown or other
  misc_feature (578)..(578): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggcccaggactggtgaagccttcggagacccctaaccctcacctgcactgtctctggtnactccatcagccgctactactggagctggactccggctcgccccggccgggcagggactggagtggagttgggcgcgtctatcacagtagaaaccngctacactccccctccgtcgacgacgtcgagtcactatttccactagacacgtaccaacaaactcagtttcgtccctaggacggctgagtcttcgtgtcgacccgccggcggaccgacggggtctaatacgttacgtggtggcggaggggacgggggggaccggggtaactcgtagtcggtcttccgtttgacgttcggcggggccaacgggaccctggtccaccgttctaccctcacgccctaccgaccgaacgggccccagttcccggttccttccccccggnggccccgtccccgtgccctaccgacggtcgccgtaccccg

SEQ ID NO: 10766 - DNA, 788 bp, Homo sapiens
  misc_feature: GYAE6OF01DP0K4.40.16.B05.1.454.CMB.1.raw
  modified_base (196)..(196): a, c, t, g, unknown or other
  misc_feature (196)..(196): n is a, c, g, or t
  modified_base (294)..(294): a, c, t, g, unknown or other
  misc_feature (294)..(294): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagacccctaaccctcacctgcactgtctctggtnactccatcagccgctactacgtggagctggactccggctcggccccggcgggcagggactggagtggattggggcgcgtctatcacagtacgaaaccngctacactccccctccgtcgagacgtcgagtccaacctatttccaacgtacgaaccctaccgtacccaaactaaagttccgtaagttttccggaccccttgggaacgggtccttgggaacgtcctttcgtacgggtccggaacccccgggccgggaccgggaaccggtaccgggggtacttaatttaacgtttacgtcgggtaggaccgggaacgggggggtaacgggggggggtaccccggggggtaaaacctttccggtaagggtccgggtcccgttttaccgttttacggaacccgttaaccgggttcggggggacccctaaacgggggtaacccccttggggtcccacccggttccttaccgtcgaccgtcccctacccgaaacccggaacgggtacccctacggttccccggttacccctttccccccggcgggtccccgtccccccgttcggaccctaccccggaaggggcccctcccgtaaccccgg

SEQ ID NO: 10767 - DNA, 619 bp, Homo sapiens
  misc_feature: GYAE6OF01ENASM.40.16.B05.1.454.CMB.1.raw
  modified_base (285)..(285): a, c, t, g, unknown or other
  misc_feature (285)..(285): n is a, c, g, or t
  modified_base (606)..(606): a, c, t, g, unknown or other
  misc_feature (606)..(606): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgccccgcgggcagggctggagtggattgggcgcgtctatcacagtagaaaccngctacactcccctcctcgagacgtcgagtccaccatttcactagacacgtccaacaaatcagttcgtccctgacggctgagctcgtggtcgacccgccggacggaccgacgggctaattacgttactggtgcggagggacgggggggccggggaaactcgtagtcggcttccgtttgacctcgtcggggccaagggaccctggtacccaccgttctacctcgacgtccctaccgaccgaacgggcccctacgttcccgggttccctttcccccccgtgggccccgtacccccgtggtaccccttacccggacggggtaccncccgtaaccccgg

SEQ ID NO: 10768 - DNA, 676 bp, Homo sapiens
  misc_feature: GYAE6OF01CPJT8.40.16.B05.1.454.CMB.1.raw
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggactccggctcgccccgcgggcagggactggagtggattgggcgcgtctatcacagtcgaaaccngctacactcccctcctgagngtcgagtcacctattcactagacacgtccaanaatcagttgtccctgagctganctctgtcgacccgcggcggacgcgggtacgtatacttactggtgcgggtaaggggacgggggggaccgggggtaaaccttccgtaaggtcgggtcctttaccgtttacggtacgtaccgggtcgggggtacccgaacggggtaaccccgtcgggtacccgtaacccggttccttcccgtaccgtaccgtccccgttacccgaaacccggtaaccggggccccctagttccccgggttaccccctttcccccccgcggggtccccggccccccgttcggtccctaccccgggaacgggccgtcccctaaccccgg

SEQ ID NO: 10769 - DNA, 619 bp, Homo sapiens
  misc_feature: GYAE6OF01C4POL.40.16.B05.1.454.CMB.1.raw
  modified_base (405)..(405): a, c, t, g, unknown or other
  misc_feature (405)..(405): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggagaccctaaccctcacctgcactgtctctggtgactccatcagccgctactactggagctggatccggctcgcccgcgggcaggggactggagtggattgggcgcgtctatcacagtgaaaccagctacatccactccctcgagagtcgagtcacctattcactagacacgtccaacaaatctagttcgtccctgacggctgagctcgtgtcgaccgccgcggacgacgggtctatattacgngtgcggagggacgggggggcccggggtaaactccgtagtcgggcctttccgtttgacttacggtcgggggacccacggggaacccgttgggtacccaccggttctcccgtcgacgccctacccgaccgacgggcccctagttcccgggttcccttccccccggtgggccccgtccccgttcggacccttcccgaacgggcgtccctaaccccgg

SEQ ID NO: 10770 - DNA, 605 bp, Homo sapiens
  misc_feature: GYAE6OF01DN3C5.40.16.B05.1.454.CMB.1.raw
  modified_base (221)..(221): a, c, t, g, unknown or other
  misc_feature (221)..(221): n is a, c, g, or t
  modified_base (287)..(287): a, c, t, g, unknown or other
  misc_feature (287)..(287): n is a, c, g, or t
  modified_base (572)..(572): a, c, t, g, unknown or other
  misc_feature (572)..(572): n is a, c, g, or t
  modified_base (596)..(596): a, c, t, g, unknown or other
  misc_feature (596)..(596): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtgactccatcagccgctactactgganctggatccggctcgcccgcgggcagggactggagtggagttgggcgcgtctatcacagtgaaaccngctacactccccctccgtcgagagtcgagtccacctatttcactagaccacgtaccaacaaatcagttcgtccctggacggctgacgtctctggtcgaccgccgcggacgacgggctatacttacgtgtggcggagggacggggggaccggggaactcgtagtcggtccttccgtttgaccgttacgggcggggaccacggggtaaccctgggtaccctacccggttctcccgtcgaccgccctacccgaccgaacggcccctagttcccggttcccttccccgnggccctcccgtgccctcgacggcnccgtacccg

SEQ ID NO: 10771 - DNA, 580 bp, Homo sapiens
  misc_feature: GYAE6OF01ERIL6.40.16.B05.1.454.CMB.1.raw
  modified_base (341)..(341): a, c, t, g, unknown or other
  misc_feature (341)..(341): n is a, c, g, or t
  modified_base (402)..(402): a, c, t, g, unknown or other
  misc_feature (402)..(402): n is a, c, g, or t
  modified_base (567)..(567): a, c, t, g, unknown or other
  misc_feature (567)..(567): n is a, c, g, or t
tcagtctagcgactcacgaccggtgctcgatttagagctcacgtagggggcacaagaacatgaaacacctgtggttcttcctcctcctggtggcagctcccagacgggtcctgtcccaggtgcagcttcaggagtcgggcccaggactggtgaagccttcggagaccctaaccctcacctgcactgtctctggtgactccatcagccgctactactggagctggatccggctgccccgccgggcaggggactgggagtggagttgggcgcgtctatcacagtgaaaccagctacactcccctcctcgagagtcgagtcaccatttcactagacacgtccanaaatcagttcgtccctgaggctgagctctgtcgaccgccgcggacgacgggctatattacngtgcgagggacggggggaccggggaaactccgtagtggccttcgtttgacttacggtggggccaggggaaccctggtcctaccgtctccgtcacgtcccaccgacccgacgggcccctagtcccggttccttcccccgtggccccgcccgtcgcctaccgaggcnccgcccgtaccgg

SEQ ID NO: 10772 - DNA, 593 bp, Homo sapiens
  misc_feature: GYAE6OF01ERBC6.40.16.B05.1.454.CMB.1.raw
  modified_base (295)..(295): a, c, t, g, unknown or other
  misc_feature (295)..(295): n is a, c, g, or t
  modified_base (531)..(531): a, c, t, g, unknown or other
  misc_feature (531)..(531): n is a, c, g, or t
  modified_base (571)..(571): a, c, t, g, unknown or other
  misc_feature (571)..(571): n is a, c, g, or t
  modified_base (576)..(576): a, c, t, g, unknown or other
  misc_feature (576)..(576): n is a, c, g, or t
  modified_base (585)..(585): a, c, t, g, unknown or other
  misc_feature (585)..(585): n is a, c, g, or t
tcagtctagcgactcacgaccggtgctcgatttagagctcacgtagggggcacaagaacatgaaacacctgtggttcttcctcctcctggtggcagctcccagatggggtcctgtcccaggtgcagcttcagggagtcgggcccagggactggtgaagccttcggacgaccctaaccctcacctgcactgtctctggtgactccatcagccgctactactggagctggatccgggctcggcccggcgggcaggggactgggagtggagttgggcgcgtctatcacagtagaaacngctacactcccctcctcgagcgtcgacgtcacctatttcactacgacacgtaccaacaaactcagttcgtccctggacggctggacgtctcgtgtcggaccggccggacgggaacgacgggtcgttaattacgttacgtggtacggacgggagggggacgggggggaccgggaacttcgtagtcggtcttcgttgactaggtcgggaccaacgggaccctggtaccaccgtctccncgacgcctaccgaccgacggccctagtccgtcctccccgngcccncctgctcgngcgcaccg

SEQ ID NO: 10773 - DNA, 303 bp, Homo sapiens
  misc_feature: GYAE6OF01BK1PB.40.16.B05.1.454.CMB.1.raw
  modified_base (293)..(303): a, c, t, g, unknown or other
  misc_feature (293)..(303): n is a, c, g, or t
tcagtctagcgactcacgaccggtgctcgatttagagctcacgtaagggtcaggggtccctgatcgcttctctggctccaagtctggcaacacggcctccctgaccatctctgggctccaggctgaggatgaggctgattattactgctgctcatttgctaggttagtttttgggtgttcggcggagggaccaagctgaccgtcctaggtcacgcccaaggctcgccccctcggtcactctcgttcccgccctcctcagtcgctagactgagcgggctggcaaggcgcatagnnnnnnnnnnn

SEQ ID NO: 10774 - DNA, 690 bp, Homo sapiens
  misc_feature: GYAE6OF01C2RZ7.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggactccggctcgcccgccgggcagggactggagtggagttgggcgcgtctatcacagtagaaaccagctacactcccctcctcgagtagtcgagtcactatttcactagacacgtccaacaaatcagttcgtccctggacgctgacgtctcgtgtcgacccgccggacgggacgacggggtacgtattacgttacgtggtacggacgggtaaggggtacgggggggggaacccgggggtaaaccttccgtaagggttcgggtacctttcccggttttagaaccgtttacggtacggggggtacccaacggggtaacccttcggggtaccacccggttcctacccgtcgaccgtacccctccgaaaccggtaaccggggtcccctacggtccccgggtttccccttccccccgggtgggtccccgtcccccgtgaccccgtaccggaacgggcgtcccggtaaccccg

SEQ ID NO: 10775 - DNA, 766 bp, Homo sapiens
  misc_feature: GYAE6OF01DX7N6.40.16.B05.1.454.CMB.1.raw
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
  modified_base (398)..(398): a, c, t, g, unknown or other
  misc_feature (398)..(398): n is a, c, g, or t
  modified_base (748)..(748): a, c, t, g, unknown or other
  misc_feature (748)..(748): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtgactccatcagccgctactactggagctggactccggctcggccccggccgggcaggggtactggaggtggagttgggcncgtctatcacagtagaaaccngcctacactccccctcctcgagagtcgagtccacctatttccaactacgacctaacgtccaacaaactctaggttctacccgtaggaggtctaggcgtcctnttggtacggacccgccgggacgggaaccgacggggtccttaattaacgtttcgtagggtcggacggggaagggggaacgggggggggtaccccggggtaaacttccgtaggtcgggtcctttccggttttaggaccgttacgggtcggggacccgtaacggggtaaccccgttcgggtacccgtacccggtttcctacccgtaccgtaccgtaccccccgtacccggaacccggtaaaccggggccccccttaacggtttccccggggtttacccccttttccccccccgggtaggggtcccccccgtacccccgtttgggacccccttacccgggaacgggggttcccnccccggtaaacccccggg

SEQ ID NO: 10776 - DNA, 574 bp, Homo sapiens
  misc_feature: GYAE6OF01DSROV.40.16.B05.1.454.CMB.1.raw
  modified_base (538)..(538): a, c, t, g, unknown or other
  misc_feature (538)..(538): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcgcccgccgggcagggactggagtggattgggcgcgtctatcacagtagaaaccagctacactcccctcctgagagtcgagtcacatttcactagacacgtcaacaatcagttcgtaccctgacggctgagtctctgtcgaccgccgacggacacgggctatattacgtgtgcgagggacggggggccggggaactcgtagtcggcttccgttgactacgtcggggaccacgggaccctggtcctaccgtctcccgtcacgtcccctaccaccgacgggcccctagttcccggtcccttcccccgnggccccgcccgtcgacctccggacggcgcctacccg

SEQ ID NO: 10777 - DNA, 564 bp, Homo sapiens
  misc_feature: GYAE6OF01C4SMZ.40.16.B05.1.454.CMB.1.raw
  modified_base (289)..(289): a, c, t, g, unknown or other
  misc_feature (289)..(289): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
  modified_base (558)..(558): a, c, t, g, unknown or other
  misc_feature (558)..(558): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaacctcacctgcactgtctctggtgactccatcagccgctactactggagctggatccggctcgccccgccgggcagggactgggagtggattgggcgtcgtctatcacagtcgaaaccngctacactcccctcctcgagacgtcgagtccactatttcactagacacgtccaacaaactcgagttcgtaccctgacggctaggagtctcgtgtcgacccggcgcggacgacgggtctatacttcgtgtggacggagggacggggggccggggaactcgtagtcgctcgttgactagcgggcagggtaccctggtaccaccgtctccgtcacgcctaccgaccgacggcccacgtccggtcctccccgnggcccncctcgctcgaggcncgaccg

SEQ ID NO: 10778 - DNA, 589 bp, Homo sapiens
  misc_feature: GYAE6OF01E20EQ.40.16.B05.1.454.CMB.1.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggagaccctaaccctcacctgcactgtctctggtgactccatcagccgctactactggagctggatccggctgccccgcgggcagggactgggagtggattgggcgcgtctatcacagtgaaaccngctacactcccctcctcgagagtcgagtcactatttcactagacacgtccacaaatcagttcgtcccngagctgagctctgtcgaccgccgcggacacggggctatacttactgtgcgaagggacggggggaccggggtaaactccgtagtcggctccgtttgacgtcgtggggaccaggggaaccctggtcctaccgtctcctcgacgccctaccgaccgtaacgggcccctagtcccggttacccttcccccgtggccccgtcccctggccctacccggaggccgtcccgacccgtcccgg

SEQ ID NO: 10779 - DNA, 620 bp, Homo sapiens
  misc_feature: GYAE6OF01BGRA7.40.16.B05.1.454.CMB.1.raw
  modified_base (285)..(285): a, c, t, g, unknown or other
  misc_feature (285)..(285): n is a, c, g, or t
  modified_base (581)..(581): a, c, t, g, unknown or other
  misc_feature (581)..(581): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgccccgcgggcagggactggagtggattgggcgcgtctatcacagtgaaaccngctacactccccctcctcgagacgtcgagtcacctatttcactagacacgtccaacaaatcagttcgtccctggagctgagtctcgtgtcgacccgccgacggacgacgggcgttaatattacgtgtgcggagggacggggggacccggggaactccgtagtcggtccttccgtttagaccgttacggtcgggggacccaacggggtaacccctgggtaccctacccggttccttacccgtcgaccgtcccctacccgaaccgacgggcccctagttcccggtcccttccccccgnggccccgtccctcgccctaccggacggacgccgtacccg

SEQ ID NO: 10780 - DNA, 728 bp, Homo sapiens
  misc_feature: GYAE6OF01DUA1B.40.16.B05.1.454.CMB.1.raw
  modified_base (280)..(280): a, c, t, g, unknown or other
  misc_feature (280)..(280): n is a, c, g, or t
  modified_base (310)..(310): a, c, t, g, unknown or other
  misc_feature (310)..(310): n is a, c, g, or t
  modified_base (380)..(380): a, c, t, g, unknown or other
  misc_feature (380)..(380): n is a, c, g, or t
  modified_base (471)..(471): a, c, t, g, unknown or other
  misc_feature (471)..(471): n is a, c, g, or t
tcagtctagcgactcacgaccggtgctcgatttagagctcacgtagggggcacaagaacatgaaacacctgtggttcttcctcctcctggtgcagctcccagatgggtcctgtcccaggtgcagcttcagggagtcgggcccagggactggtgaacgtccttcggacgacccctaaccctcacctgcactgtctctggtcactccatcacgccgctactacgtggagctggactccggctcggcccggcgggcgagggcgtggaggtggacgttggggcncggttctatccaacgtacgtacgaaaccgngcctacacctacccccctccgtacggagtacgtcgacgtccaacctatttcactagaccaccgtaccaanaaactcctaggttccgccctaggagtctaggactctcgtcggacggacccgccgggacggaacgtaccgggtacttaagttacgtttacgngggtaggacgggacggggggacggggggggtaacccgggaacttccggtaaggtccggctttaccgttcggaacgtccgggacggggtaacccaccggggtacccttcgggtacccacccgggttcttacccgacgacccgtccctacccggaaacccggtaaccgggtcccctacggttccccgttacccgttccccccgggggtacccgtccccgttggacccccgtaacggcccgggtctccccctaaaccggg

SEQ ID NO: 10781 - DNA, 588 bp, Homo sapiens
  misc_feature: GYAE6OF01BUSD7.40.16.B05.1.454.CMB.1.raw
  modified_base (220)..(220): a, c, t, g, unknown or other
  misc_feature (220)..(220): n is a, c, g, or t
  modified_base (556)..(556): a, c, t, g, unknown or other
  misc_feature (556)..(556): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactgganctggatccggctcgcccgcgggcagggactggagtggagttgggcgcgtctatccacagtacgaaaccagctacactccccctcctcgagacgtcgagtccacctatttcactagacacgtaccacaaatcagttcgtccctggacggctgacgtctcgtgtcggacccgccggtacggacgacgggtctatacgttacgtggtgcggaggggacggggggtacccggggaactcgtagtcggccgttcgttacgacgtacgtggggaccacggggtacctggtccaccgtcctctacgcgcctaccgaccgacggccctcgtcgttccctcccgngcccgtccctcgcctacgacggcgcctacccg

SEQ ID NO: 10782 - DNA, 721 bp, Homo sapiens
  misc_feature: GYAE6OF01EBVQ5.40.16.B05.1.454.CMB.1.raw
  modified_base (704)..(704): a, c, t, g, unknown or other
  misc_feature (704)..(704): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggagaccctaaccctcacctgcactgtctctggtgactccatcagccgctactactggagctggactccggctcgcccggccgggcaggggactgggaggtggagttgggcgcgtctatcacagtacgaaaccagcctaccacttccccctcccgtcggacgacgtcggagtccacctattttcaactagacacgtaccaacaaatcgagttcgtccgtgacgctgagtctcgtgtcgacccggccggacgggaccgaccgggggtcttaacgttactttaacggtggttacgggacggggaaagggggaccgggggggggtaacccggggggtaaacttcccggttaaggtcgggtccctttccgtttacggaccgtttacgggtcggggacccgaacggggtaaccccttgggtacccgtacccgttcctccctacgaccgtcccgtacccgaccgaaccggggtcccctacgggttcccggttccccgttccccccggtgggcccccgtccccgttcggcccttacccgggagggtacccnccgtaccccggtaccgg

SEQ ID NO: 10783 - DNA, 754 bp, Homo sapiens
  misc_feature: GYAE6OF01DRRTW.40.16.B05.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (247)..(247): a, c, t, g, unknown or other
  misc_feature (247)..(247): n is a, c, g, or t
  modified_base (293)..(293): a, c, t, g, unknown or other
  misc_feature (293)..(293): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgacccctaaccctcacctgcactgtctctggtnactccatcagccgctactactgganctggactccggctcgcccggcgggnaggggactgggagtggagttgggcgcgtctatcagagtacgaaccngcctacacctccccctcctggacgacgtcgacgtccacctactttacacttacgacctaccgtaccaacaatctagttcgtccctggacgctagacgtctcgtgacgacccgcggacggacgccgggtattagtattacgtggtcggacgggaaggggacgggggggtacccggggtaacttccggtacgttcggtacccgtttaccgtttacggaccgtttaccggggcgggggtaaccccgtaaccgggggtaaccccgtttaggggtacccctacccggtttccccgttcctacccggaccgtaccccgttaccccggaaacccgggtaacccggggtcccccttaaccgggtttccccgggttaccccctttccccccgggacggggtccccccgttccccgtttaccggacccccgtttaaccgggaccggggcccgtaacccccggtaaccccgg

SEQ ID NO: 10784 - DNA, 682 bp, Homo sapiens
  misc_feature: GYAE6OF01B3KG5.40.16.B05.1.454.CMB.1.raw
  modified_base (296)..(296): a, c, t, g, unknown or other
  misc_feature (296)..(296): n is a, c, g, or t
  modified_base (354)..(354): a, c, t, g, unknown or other
  misc_feature (354)..(354): n is a, c, g, or t
  modified_base (671)..(671): a, c, t, g, unknown or other
  misc_feature (671)..(671): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtcgactccatcacgccgctactacgtggagctggactccggctcggccccggcgggcagggactggagtggagttgggcgtcgtctatcacagtacgaaccngctacactccccctcctggagcgtcggatccacctattcaactagaccacgtaccaanaactctagttcgtccctggacgtctgacgtctcgtgtcgacccgccggacggacgacgggtatacttagtctgggtacggcgggtaacgggggacggggggggtaacccgggtaaacttcgtaagggtcggttccctttacgttacggaactttccgggcggggtaacccgaacggggtacccttcgggtcccaccggtttcctacccgtcgacccggtcccacccgaaacccggtaacccgggtccctaccgggttccccgttaccccgttccccccggtggccccgtacccgtccgacgtacccgaacgggtccnccccgtaccgg

SEQ ID NO: 10785 - DNA, 756 bp, Homo sapiens
  misc_feature: GYAE6OF01AFFWR.40.16.B05.1.454.CMB.1.raw
  modified_base (195)..(195): a, c, t, g, unknown or other
  misc_feature (195)..(195): n is a, c, g, or t
  modified_base (316)..(316): a, c, t, g, unknown or other
  misc_feature (316)..(316): n is a, c, g, or t
  modified_base (630)..(630): a, c, t, g, unknown or other
  misc_feature (630)..(630): n is a, c, g, or t
  modified_base (743)..(743): a, c, t, g, unknown or other
  misc_feature (743)..(743): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtnactccatcagccgctactacgtggagcgtggacgtcccggctcggccccggccgggcgaggggaccgtgggacggtggagttcggggccgtcggttctatccaccgtaggtacgaaaaccngacctaccacctcccccctccgtcgagacgtcggagtccacctatttcactagaccaccgtccaataactctagttcgtccctaggacggtctggacgtctcgtggtaccggacccggcccggaccgggaaccggacggggtacttaacttagttccggtggtcgggaccgggaaggggggtaccggggggggtacccggggaaacttcccgttaggccgggttccctttccgttttacggaaccgtttaccggggtcgggggacccctaacgggggtaaccccttgggtaccccgacccgtttcctcccgtanacccggtccctacccgaaaccggtacccgggccccttaacggttccccgggttaccccttccccccgggaggtccccccgtacccctggtccccctacccgggagggtccccnccccgtaccccgg

SEQ ID NO: 10786 - DNA, 803 bp, Homo sapiens
  misc_feature: GYAE6OF01BJTFX.40.16.B05.1.454.CMB.1.raw
  modified_base (740)..(740): a, c, t, g, unknown or other
  misc_feature (740)..(740): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcgaggagtccgggcccaggactggtgaagccgttcggacacccctaaccctcacctgcactgtctcgtggtcgactccatcagccgctactacgtggagcgtggactcccggcgtcggccccggccgggcgagggtacgtgggaggttggacgttcggggccgtcgtacgtactccgaacgtaaggtacgaaaaccacggtacctaaccacccttccccccgtacccgtacggacggtacgttccgaacgtccctaccttattttaccgaacgttaacgacctacccgtaccaaactaacttccgtaacgtttccgtacccgtaggacggtctggacgtcttcgtggtccgacccgccggacggacgtacggggtcttaagtacgttacgtggtacggacgggacggggggaaccgggggggtacccgggtaacttcgtaggtccggtccctttcggtttagaccggttagggccggggaacccgtaacgggtaccccgtcgggtaccccgtacccgttccgtacccgtaccgaacccgtccccctaccggaaacccggacccggggtaccccttacgggttcccccggtttaccccgttccccccccgggnggtccccttaccccccgggtgtaccccccggtaaggacccggggcctccccggtaacccccgg

SEQ ID NO: 10787 - DNA, 855 bp, Homo sapiens
  misc_feature: GYAE6OF01EIPJY.40.16.B05.1.454.CMB.1.raw
  modified_base (304)..(304): a, c, t, g, unknown or other
  misc_feature (304)..(304): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtgactccatcagccgctactacgtggagctgggactcccggctcggccccggccgggcgaggggactgggagtggagttgggccgcgttctatacacgagtacgaaaccngctaacacctccccctccgtacggagtacggtcgacgtccacctatttccaacgttacgacctaaccgtacccaaactaaactcgtaacgtttcgtcccgtaggacgtcctaggaccgtccttcgtggtcccggaccccgggtccggacgggaaccgtacggggtactttaacgttaacgtttaccggtgggtacgggaccgggtaacgggggggaaccgggggggggtacccccggggttaaactttcccgggttaaggtccggggtttccccttttaccggtttacggtaacccggttaccggggttccggggggaaccccgtaaccgggggtaacccccgttggggttaacccccgtaccccggtttccctaccccgtaccgaacccggtccccttaacccggaaacccccggtaacgggggtccccccttaacggggttttcccccggggttacccccctttccccccggggccggggaccccccttcccccgggttacgcccccgttaacccgggaccgggtacccgtaccccgtaacccccgggg

SEQ ID NO: 10788 - DNA, 667 bp, Homo sapiens
  misc_feature: GYAE6OF01DWCNV.40.16.B05.1.454.CMB.1.raw
  modified_base (290)..(290): a, c, t, g, unknown or other
  misc_feature (290)..(290): n is a, c, g, or t
  modified_base (625)..(625): a, c, t, g, unknown or other
  misc_feature (625)..(625): n is a, c, g, or t
tcagtctagcgactcacgaccggtgctcgatttagagctcacgtagggggcacaagaacatgaaacacctgttggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcgcccgccgggcagggactggagtggagttgggcgcgtctatcacagtacgaaaccngctacactcccctccgtcgagacgtcgagtccacctatttacaactacgacaccgtaccaacaaatctagttcgtaccctgaggtctgacgtctcgtcgtcggacccggccggaccgggacgaccggggtacttaattacgtttaccgtgggtacggacgggaacgggggacggggggggacccggggaaacttccgtaggtcggtcctttaccgtttcgacgttacgggtcggggaccgtaacgggtacccttgggtaccctaccggttctacccgtcgaccgtccctaccgacccgtaacgggtcccctacgttcccggttcccttcccccgnggccccgtcccgtcggaccctaccggacggccgccgtacccg

SEQ ID NO: 10789 - DNA, 715 bp, Homo sapiens
  misc_feature: GYAE6OF01C4GFD.40.16.B05.1.454.CMB.1.raw
  modified_base (291)..(291): a, c, t, g, unknown or other
  misc_feature (291)..(291): n is a, c, g, or t
  modified_base (311)..(311): a, c, t, g, unknown or other
  misc_feature (311)..(311): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggactccggctcgcccgccgggcagggactggagtggagttgggcgcgtctagtcacagtacgaaaccngctacactcccctcctaganacgtcgacgtccactattacactagacacgtccaacaaatctagttcgcccgtgaggtctaggacgtctcgtagtcggacccgccggacggacgacgggtctaattacgttcgtggtcggacgggaaggggtaaccggggggaccgggggtaaacttccgtaagtcgggtccttccggttttacgaccgttacgggtcggggaacccgaacggggtaacccccgttggggtaccccgtaacccggttcccttacccgtaccgtacccggtaccccgtacccgaaacccgggaaccgggtcccccgtaacggttccccggggttacccccttccccccgggtgggtacccccgtccccgttggacccccgttaccgggaacggtcccggaccccgtaaccccggg

SEQ ID NO: 10790 - DNA, 638 bp, Homo sapiens
  misc_feature: GYAE6OF01D063T.40.16.B05.1.454.CMB.1.raw
  modified_base (374)..(374): a, c, t, g, unknown or other
  misc_feature (374)..(374): n is a, c, g, or t
  modified_base (416)..(416): a, c, t, g, unknown or other
  misc_feature (416)..(416): n is a, c, g, or t
  modified_base (590)..(590): a, c, t, g, unknown or other
  misc_feature (590)..(590): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcggggcccaggactggtgaagccttcggagaccctaaccctcacctgcactgtctctggtgactccatcagccgctactactggagctggatccggctcgcccggccgggcaggggactggagtggattgggcgcgtctatcacagtagaaaccagctacactccccctcctcgagagtcgacgtcacctatttccaactagacaccgtccaactaaatcagttcgtccctggagctgngtctcgtgtcgacccgcgacggacgcggggtcttatattacnggtcgcggaaggggacgggggggaccgggaactccgtagtcggtcttccgtttgaccttacgggcggggacccgtacggggtaacccttgggtacctacccggttcttccctcgaccgtcccctacccgaaccgaacggggtccccctacggtttcccggtccccttcccccgngggccccgccccgttcgggcccctacggaacggccgccccgtacccgg

SEQ ID NO: 10791 - DNA, 692 bp, Homo sapiens
  misc_feature: GYAE6OF01AC8LF.40.16.B05.1.454.CMB.1.raw
  modified_base (236)..(236): a, c, t, g, unknown or other
  misc_feature (236)..(236): n is a, c, g, or t
  modified_base (299)..(299): a, c, t, g, unknown or other
  misc_feature (299)..(299): n is a, c, g, or t
  modified_base (374)..(374): a, c, t, g, unknown or other
  misc_feature (374)..(374): n is a, c, g, or t
  modified_base (628)..(628): a, c, t, g, unknown or other
  misc_feature (628)..(628): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccagggactggtgaagccttcggagaccctaaccctcacctgcactgtctctggtgactccatcagccgctactacgtggagctgggactcccggntcggccccggcgggcaggggactgggagtggagttgggcgcgttctatcacagtacgaaaccngctacactccccctcctcgagacgtcgagtccacctatttcactagacacgtaccaacaatcacgttcgtcccgnggacggtctgacgtctcgtggtcgaccggccggacggtacgacggggtcttaattacgttacgtggtgggcgggaaggggacggggggggtacccgggtaaactccgtagtcggtaccttcgtttacgacgttcggcgggaccgtacgggtaacccgttcggtacccgtaccgttcctcccggtacaccggtaccccgtcccgaaccggtaaccgggcccccttaggttccccggtttaccccgttcccccggnggttccccccggtccccttttaccggaccgacgggtaccctccccgttaacccggccggtacgg

SEQ ID NO: 10792 - DNA, 670 bp, Homo sapiens
  misc_feature: GYAE6OF01DWSEP.40.16.B05.1.454.CMB.1.raw
  modified_base (198)..(198): a, c, t, g, unknown or other
  misc_feature (198)..(198): n is a, c, g, or t
  modified_base (250)..(250): a, c, t, g, unknown or other
  misc_feature (250)..(250): n is a, c, g, or t
  modified_base (576)..(576): a, c, t, g, unknown or other
  misc_feature (576)..(576): n is a, c, g, or t
  modified_base (581)..(581): a, c, t, g, unknown or other
  misc_feature (581)..(581): n is a, c, g, or t
tcagtctagcgactcacgaccggtgctcgatttagagctcacgtaggggggcacaagaacatgaaacacctgtggttcttcctcctcctggtggcagctcccagatgggtcctgtcccaggtgcagcttcagggagtcgggcccaggactggtgaagccttcggacgaccctaaccctcacctgcactgtctctggtnactccatcagccgctactactggagctggactccggctcgccccggccgggnagggactggagtggagttgggcgcgtctagtcacgagtacgaaaccagcctacacctccccctcccgtacggacgtacgtcgacgtccaacctatttaccaacttaacgaccaccgtaccaaactaaacttccgtaagtttccgtcccctaggacgtcgtaggacgtctcgtggtccgacccggccggaccgggacgaccgggtcgttatactttacgtgggtcggacgggtagggggaaccgggggggacccggggtaacttcgtagtcggcctttcgttcggacgttcggcgggaccgacggggtaccctgggtcctaccgtcncctcncgtccctaccgaccgacggtccctcggtcccggttccccttccccgcgggccctcccgtcggccctaccggacggccgtccgtacccgg

SEQ ID NO: 10793 - DNA, 667 bp, Homo sapiens
  misc_feature: GYAE6OF01CE85Y.40.16.B05.1.454.CMB.1.raw
  modified_base (290)..(290): a, c, t, g, unknown or other
  misc_feature (290)..(290): n is a, c, g, or t
  modified_base (434)..(434): a, c, t, g, unknown or other
  misc_feature (434)..(434): n is a, c, g, or t
  modified_base (621)..(621): a, c, t, g, unknown or other
  misc_feature (621)..(621): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcggggcccaggactgggtgaagccttcggagaccctaaccctcacctgcactgtctctggtgactccatcagccgctactactggagctggactccggctcgcccgcgggcagggactggagtggattgggcgcgtctatcacagtacgaaaccngactacactccccctcctcgagtacgtcgagtccacctatttccactagaccacgtaccaacaaatcagttcgtccctggacgctgacgtctcgtggcgaccggcccggcgggtaaccgacggggtacttaagttactttacgnggtacggacgggaacgggggtacgggggggggacccggggtaaactcccggtaagtcgggtaccttccgtttggaaccgttacggtcggggcctaacggggtacccctgggtcctacccggttctccgtccgacgtcccctacgaacccggtaaggcccctaggttccccggttcccttcccccggnggaccccgtcccttcggccctaccgaacgggcctcccgaaccccgg

SEQ ID NO: 10794 - DNA, 879 bp, Homo sapiens
  misc_feature: GYAE6OF01BWYU8.40.16.B05.1.454.CMB.1.raw
  modified_base (211)..(211): a, c, t, g, unknown or other
  misc_feature (211)..(211): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggacgacccctaaccctcacctgcactgtctctggtgactccatcacgccnctactacgtggagctggactccggctcggcccggcgggcgagggactgggagtggagttcggggcgtcgtactagtcacgtagtacgaaaccagtacctaccaccgtccccctccgtacggacgtacggtccgagtccaccttatttaccaacgtacgacctaccgtaccaactaaactccgtaacggttcgtcccgtaggacggtctcggacgtccttcgtcggtaccgaccccggccggaccggtaaccgggtacggggtacttaacgtttacgttacgggtcggtacggggtacggggaaacgggggggtaccgggggggggtaacccggggtaaacctttcccgggttaagggtcccgggttacccttttacccggtttacgggaacccggtttacggggtacccggggggtaaccccggtaaacccgggggttaaccccggttccggggtaccccttaccccgggtttccctttccccggacccgtaacccggttcccccctaaacccgggaaaccccggtaaccgggggtaccccccttacgggtttcccccccggggttccccccgtttaccccccgggccgggtccccccgttacccccgtcgggtaccccgttaccgggaacccgggtcccctaaccccggtaccccggtaacccgggg

SEQ ID NO: 10795 - DNA, 684 bp, Homo sapiens
  misc_feature: GYAE6OF01B8LXL.40.16.B05.1.454.CMB.1.raw
  modified_base (195)..(195): a, c, t, g, unknown or other
  misc_feature (195)..(195): n is a, c, g, or t
  modified_base (304)..(304): a, c, t, g, unknown or other
  misc_feature (304)..(304): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtnactccatcagccgctactacgtggagctgggactccgggctcggccccggcgggctaggggactggggagtggagttggggcgtcgtctatcactaggtacgaaaaccngcctaacaccttccccctcctacgagacgtcgagtcacctagtttcaactagacacgtccaataaatcagttcgaccctgaggtctggatctntgcgaccgccgacggacncgggctatacttacgtgtagcgggtaggggacgggggggtaccggggaaactccgtaagtcggtcttccgttagacgtacggtcggggccaacgggtaccctgggtacctaccggttcctcccgtacaccggtccctacccgaaacccggtaaccggggcccctaacggttccccgggttaccccgttcccccccggtcggggtacccccgtacccccgttcgggaccccgtacccgggtaacgggacccgtccccgtaaacccccggg

SEQ ID NO: 10796 - DNA, 845 bp, Homo sapiens
  misc_feature: GYAE6OF01EW9Y8.40.16.B05.1.454.CMB.1.raw
  modified_base (198)..(198): a, c, t, g, unknown or other
  misc_feature (198)..(198): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggcccaggactggtgaagccttcggacgacccctaaccctcacctgcactgtctctggtnactccatcgacgccgctactacgtggagtctggactcccggctccggccccggccggggacgacggggtactggggaggttcgggagttcggggcgtcggtctatccgacgtaaggtacgaaacctcgactaccgtaccctccccctccgtacggagtacggtaccgtacgtcccaacctatttaccaacttaggaaccctacgtacccaactaaacttcgtaacggtttccgtcccgtaggaaccggtcttacggacgtccttacgtcggtaccggacccgaccgggtacgggaacccggtacggggtactttaaacgtagttaccggtcgggtacgggaacgggtacgggggacgggggggggtaaccccgggtaacttccggttaacggtcggtacctttcccggtttaggacccgttaccggggtaccgggtaccgggtaaccgggttaacccccggttgggtaaccccgtcccggttacccttacccggaccgtaccggtacccccgtaccccggtaaacccgggaacccgggtcccccgtaccggtttacccccggttacccccggtttccccggacccgggtcccctccccggttcgggaccccttaaccggaccggggtaccgccccgtaacccccggg

SEQ ID NO: 10797 - DNA, 607 bp, Homo sapiens
  misc_feature: GYAE6OF01A3Q8F.40.16.B05.1.454.CMB.1.raw
  modified_base (297)..(297): a, c, t, g, unknown or other
  misc_feature (297)..(297): n is a, c, g, or t
  modified_base (425)..(425): a, c, t, g, unknown or other
  misc_feature (425)..(425): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcggccccggccgggcagggacgtgggaggtggagttggggccgcgtctatcacagtacgaaaccngactacactccccctcctcgagagtcgactccacctatttcaactacgaccacgtaccaactaaatctagttcgtccctggacggctgacgctcgtgtcggacccgccggcggacgcgggtactattnttacgtgtggcggaggggacgggggggaccgggtaactcgtagtcgtcttccgttgacgtcggtcggggaccgacgggtacccgtggtccaccgtcctcctcgaccgtcccaccgaccgaccgggccctacgttccgttcccctccccgtggcccctccgtcgccacgcggcgccctaaccg

SEQ ID NO: 10798 - DNA, 631 bp, Homo sapiens
  misc_feature: GYAE6OF01DPL9T.40.16.B05.1.454.CMB.1.raw
  modified_base (287)..(287): a, c, t, g, unknown or other
  misc_feature (287)..(287): n is a, c, g, or t
  modified_base (578)..(578): a, c, t, g, unknown or other
  misc_feature (578)..(578): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtacgaaaccngctacactcccctcctgagagtcgagtcacatttcactagacacgtcaacaaatcagttcgtccctgacggcttgacgtctcgtcgtcgacccgtccggacgggaccgacggggtcttaattaacgtttaccgtggtcggacggtaaggggaacgggggggacccgggggtaaactccgtagtcggtccttccgtttgacttcgtggggaccacgggaaccctggtcctaccgtctccgtcgacgtccctccgaccgacgggccctaagtcccgggttcccttcccccggngggtcccctaccccgttcgacccgtacccgaacgggccgtcccgtaaccccgg

SEQ ID NO: 10799 - DNA, 778 bp, Homo sapiens
  misc_feature: GYAE6OF01D23FT.40.16.B05.1.454.CMB.1.raw
  modified_base (424)..(424): a, c, t, g, unknown or other
  misc_feature (424)..(424): n is a, c, g, or t
  modified_base (758)..(758): a, c, t, g, unknown or other
  misc_feature (758)..(758): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgccccggccgggcagggactggagtggattcgggcgcgtctatcacagtacgaaaccagctacactccccctcctggacgagtccgagtccacctattttccactaacgacctacgtcccaactaaaactcgtaagtttcgtcccctggacggtctggacgtcctcgtgtcggacccggccggccgggaacncggggtacttattacgttacgtggtaggcgggaaggggacggggggggtacccggggtaaactcccgttaaggtcgggtcctttaccggttgaaccgttacgggtcgggggacccgtaaccggggtaaccccgttgggtacccgtaacccggttccgttacccgtaccggtaaccgtcccccgttaaccccggaaaccccggaaaccgggggtccccccctaaacgggtttccccggggtttaacccccccgtttccccccccgggtcgggggtacccccccgtcccccccggtttacgggaccccccgttaccccggaaacgggggtaccccnccccgggtaaaccccccggg

SEQ ID NO: 10800 - DNA, 807 bp, Homo sapiens
  misc_feature: GYAE6OF01D4Y8E.40.16.B05.1.454.CMB.1.raw
  modified_base (197)..(197): a, c, t, g, unknown or other
  misc_feature (197)..(197): n is a, c, g, or t
  modified_base (756)..(756): a, c, t, g, unknown or other
  misc_feature (756)..(756): n is a, c, g, or t
  modified_base (781)..(781): a, c, t, g, unknown or other
  misc_feature (781)..(781): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctcgtggtnactccatcacgccgctactacgtggacgcgtggacgtcccggctccggccccggccgggacgaggggaccgtggggtagtgggtagttcggggccgtcgttactataccgacgagtaacgaaaccacgtacctaacctacccttcccccctaccgtacggaaggtacggttaccggaacgtccctaaccttactttaccaacgtaacgaccaccgtaccaaactaaacttcgtacggttccgtcccgtaggacggtctaggtacgtctacgtcggtaccggacccggtccgggaccgggaacggtaccggggtctttaacgttacgtttacggtgggtacgggacggggaacgggggggtaccgggggggggtaaccccgggtaaacttccggtagtccgggttccctttccggtttaggacccggtacgggtaccgggggaccctaaccgggggtaccccttcgggtaccctacccggttccctccgtaccgaccgttccccctaacggaacccggtaccgggtccctaccggttccccgggtcccctttccccgggnggtacccccgtcccgtcgtaccccncgggaacgtcccgtccctaacccggg

SEQ ID NO: 10801 - DNA, 981 bp, Homo sapiens
  misc_feature: GYAE6OF01B5V3Y.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcgaggagtcgggcccaggactggtgaacgtccttcggacgacccctaaccctcacctgcactgtctcgtggtacactccatcacgccgtctactacgtggagctggactccggcaccggccccggccgggcgaaggggtacgtggggtagggtaggagttcggggcctacggtacttaacgccgaacgtaaggtaaccgaaaacccgtcggtacctaaaccgacccttcccccccgtccgtacggaacgtaccggttaccgaacgtaccctaaaccttactttaccgaaaccgttacgaaacccgtacccgtaaccctaaaagtaaaaccttcggttaaccggttttccggaccccgtaggggtaacgtccgttaacggaacgttcccgttacggtacgggtacccggaacccccggggcccgggtaaccgggaaccgggtaccgggtcgtttaaaacctttacggtttacggtagggccggggtaaccgggggaaacggggggggtaaaccgggggggggtaaccccggggtaaaacctttccggggttaacggtccgggttacccttttaccgggtttacgggaaacccgggtttaccggggttacccggggggaacccgtttaaacccggggggcccccgttttaggggtacccccttaacccccggtttccggtttaacccccacggtaaacccccggtccccgttaaacccccgggaaccgggttaaacccggggtcccccttaacccgggttcccccgggtttcccccctttacccccggggccgggtccccttaccccgttcggaccccgttaccgggacggaccccgtcccccgtaaacccgggg

SEQ ID NO: 10802 - DNA, 797 bp, Homo sapiens
  misc_feature: GYAE6OF01DDS27.40.16.B05.1.454.CMB.1.raw
  modified_base (233)..(233): a, c, t, g, unknown or other
  misc_feature (233)..(233): n is a, c, g, or t
  modified_base (353)..(353): a, c, t, g, unknown or other
  misc_feature (353)..(353): n is a, c, g, or t
  modified_base (366)..(366): a, c, t, g, unknown or other
  misc_feature (366)..(366): n is a, c, g, or t
  modified_base (549)..(549): a, c, t, g, unknown or other
  misc_feature (549)..(549): n is a, c, g, or t
  modified_base (785)..(785): a, c, t, g, unknown or other
  misc_feature (785)..(785): n is a, c, g, or t
tcagtctagcgactcacgaccggtgctcgatttagagctcacgtaggggcacaagaacatgaaacacctgtgttccttcctcctcctggtggcagctcccagatggtcctgtcccaggtgcagcttcaggagtcgggcccaggacctggtgaacgccttcgggaacgacccctaaaccctcacctgctactgtcctcgtggtacacctccattccacgccgtctaccgttagngggacgcgttagggactcccggtctccggaccccgggcgggacctagggggaccgtgggaaggttgggtaagttcggggacctcggttactaactccgaacgtacgtacgaaaaccccgngtaccgtaaaccncccgttacccccgtcccgtacggtaacgacgttccggaactacctaaccttactttacccaaacgtaccgtaacctaaccggtaccctaaaacaattccgtaacgtttccgtccccgtaggacggtcctgtcgaccttcggtgtacggacccgtcgcggaaccgcgggttactatacgttcgnggtacggtaccgggaagggggccggggggtaacccggtaaactccggttcgggtaacgtccctttacggtttacgaacccttagggggtaccggtacccgtaacggggtacccgttcgggtaacccctaccggtcccttcgaccgtaccggccctaccggaaaacccggtcccggccttacggttccccggtcccttaaccccggcggacccctaccgttcgacctacggaccggntaccccgacccg

SEQ ID NO: 10803 - DNA, 868 bp, Homo sapiens
  misc_feature: GYAE6OF01C1J4D.40.16.B05.1.454.CMB.1.raw
  modified_base (219)..(219): a, c, t, g, unknown or other
  misc_feature (219)..(219): n is a, c, g, or t
  modified_base (299)..(299): a, c, t, g, unknown or other
  misc_feature (299)..(299): n is a, c, g, or t
  modified_base (346)..(346): a, c, t, g, unknown or other
  misc_feature (346)..(346): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaacctcacctgcactgtctctggtcgactcatcagccgctactactggancgtgacgtccggctcggcccgcgggcgagggactggagtggagttcgggcgtcgtactatcgtaacgaggtacgaaaccngcctaacaccgttccccctccgtagacgtacgtcgacgtacaccttntttaccgaactacgaccaccgtaccaaacgtaaacttccgtaacggttttccgtaccccgtagggtaaccggtacgttacggacgttcccgtttcgtacgggtacccggaacccccgggtcccggggaacgggtaacccggggtaacccgggggttacgttttaaactttaaacccggttttacgggtacggggttaccggggacgggggtaaacggggggggtaaaccccggggggggggggtaacccggggttaaaaccctttcccgggttaaacgggttcgggttaaccccgttttccggttttaacgggaacccgtttaccggggtcgggggaaaccccgtaaccggggtaaccccgtttcggggtaccctaccccggtttcctacccgtacgacccggtaccccttaaccggacccggtaaaccggccccttacggttacccccggttccccgttcccccggcgggtaccccgccccgttggaccccttacgggaccggccgtccccgtaaaccggg

SEQ ID NO: 10804 - DNA, 770 bp, Homo sapiens
  misc_feature: GYAE6OF01A0L60.40.16.B05.1.454.CMB.1.raw
  modified_base (287)..(287): a, c, t, g, unknown or other
  misc_feature (287)..(287): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcgcccgccgggcagggactggagtggattgggcgcgtctatcacagtagaaaccngctacactccccctcctcgagacgtcgagtcacctatttcactagacaccgtaccaactaaatcagttcgtaccctggacggctaggagtccttcgtggtcgaccccggtcccggaccgggaaccgtacggggtacttaattacgtttaacgtgggtacggacggggaagggggtaaccgggggggggtaccccggggggtaaaccttcccggtaagttcgggtaccctttcccgttttacggaaccttaccgggtcggggggacccgtaaacgggggtaacccccgttggggtacccctaacccgggtttccctaccccgtaccgaaccggtccccgtaccccgaaaccccggtaacgggggtcccccctacggttacccccggggttccccctttccccccccgggttcggggccccccgttacccccgttcggtccccccgttacccgggaaccgggtaccgtcccccgtaaacccccgg

SEQ ID NO: 10805 - DNA, 947 bp, Homo sapiens
  misc_feature: GYAE6OF01CZ8X7.40.16.B05.1.454.CMB.1.raw
  modified_base (72)..(72): a, c, t, g, unknown or other
  misc_feature (72)..(72): n is a, c, g, or t
  modified_base (489)..(489): a, c, t, g, unknown or other
  misc_feature (489)..(489): n is a, c, g, or t
tcagtctagcgactcacgaccggtgctcgatttagagctcacgtaggggtcgtacggaagtaacatgaaacncctgtggttcttcctctctggtgcagactccagactggtctgtcccagtcgcagtcgttcgaggacgtccggaccaggtcgttggtgaacgtccgttacggacgaacccgttaaccgtcgaccgtgaccgtacgtgtctcgtaggtacgtaccgtcctatccagtccgtcttacttacgcggtacgcgttagtaccgtccggtcgtaccggcccggcggtacgacgggtaccgtgggtacggtggtaggtccggcgaccgtaccgtaccgacggtaaccgtacgtaaccgaacgtcgtacctaaccgtaccttccccgtccgtaacgacgttacgtaccggtaccgtacctaccttaccgtaacgacgtaacgaccgtacccgtaccgaactaacgttcgtaccgttccgtacccgngtaccgtacgtcgacgtaccgtacgtaccggacccggtacccgtacccggtcggtaacccggtaccggttacttaccgttaagtccgtcggggtaacggtacccggggaaaccgggggtaccgggggaaccccggtaactttccgggtaacggtttcccggtttaccgtttaaaccggttttaccggtaccggtttacccggggtaccggggttaaacccccggtaaaccgggttttccccggttacccgggtttaacccgtttaccccgggttttaaccccgttacgggtttacccgaacccggttttccccccgaaacccggggttaaaccccggttaccggttacccccgttacccggttccccggtttaacccccggttcggtaccccggtacccgttaccctacccgggtccgggttaccggaacccgggttcccgtaacccccggttacccg

SEQ ID NO: 10806 - DNA, 750 bp, Homo sapiens
  misc_feature: GYAE6OF01DWRXY.40.16.B05.1.454.CMB.1.raw
  modified_base (615)..(615): a, c, t, g, unknown or other
  misc_feature (615)..(615): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggaggtcgggcccaggactggtgaagccttcggacgaccctaaccctcacctgcactgtctcgtggtgactccatcagcccgctactacgtggagcgtggactccggctcggccccggccgggcgagggtacgtgggacgtggagttgggcgtcgtctactaccaacgtagtacgaaaccacgctaaccaccttccccctcccgtacggacgtacggtacgacgtccctaaccttattaccaacgtacaactaccgtaccaactaaatcctagttcgccgtaggagtctgactctcgtacgccggaccggtccggacggacgtacggggtaccttaatacggtttacgtggtacgggacgggaagggggtacccggggggggaacgggtaaacccttcgtaacggttcggtacctttaccgttagaccgttacggccggggtaacccgaaccggggttaacccgttcggtaccctacccgttccnccgtaccacgtccccaaaccgcccgggaacccgcccttaccggtccccggtttacccccgtcccccggtcgggcccccgtaccccgttcggtaccccgaacggtaccgggcccctacccgtaacccgggtaccgg

SEQ ID NO: 10807 - DNA, 759 bp, Homo sapiens
  misc_feature: GYAE6OF01BA3LH.40.16.B05.1.454.CMB.1.raw
  modified_base (534)..(534): a, c, t, g, unknown or other
  misc_feature (534)..(534): n is a, c, g, or t
  modified_base (663)..(663): a, c, t, g, unknown or other
  misc_feature (663)..(663): n is a, c, g, or t
  modified_base (715)..(715): a, c, t, g, unknown or other
  misc_feature (715)..(715): n is a, c, g, or t
  modified_base (748)..(748): a, c, t, g, unknown or other
  misc_feature (748)..(748): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggccaggactggtgaagccttcggacgacccctaaccctcacctgcactgtctctggtgactccatcacgccgtctactacgtggagtcgtggacgtcccggctccggccccgggccgggcgacggggactggggaggtcgggaggttcggggccgtcgttactacgtcaacgtaaggtaccgaaaacctcgtacctaacctacccttacccccctcccgtacggaaggtaccggttccggacgttcccaaccgttactttaccgaacttacgacctaccgttacccaaactaacttcgtacgtttccgtccgtggacgtcgtaggacgtccgttacgtcggtacccggacccggccggacgggaccgtacgggtacgttaattacgtttaccggngggtccggaacgggtaacggggggaccgggggggtaacccgggtaacttccggtaggtccggtccttaccgttggaaccgtacggggtcgggaccgtaaccgggtaccctcgggtacctcccgtctccngacccgtccaacccgaccggacggtccctacggttcccgtccccgttcccgngggcccctccgtcgtaccccgacggacggtccncccgtaacccg

SEQ ID NO: 10808 - DNA, 955 bp, Homo sapiens
  misc_feature: GYAE6OF01BTRWD.40.16.B05.1.454.CMB.1.raw
tcagtctagcgactcacgaccggtgctcgatttagagctcacgtagggggcacaagaacatgaaacacctgtggttcttcctcctctggtggcagctcccagatgggtcctgtcccaggtgcagcttcgaggagtcgggcccaggactggtgaacgccgttacggacgacccctaaccctcaccgtgcactgtcctcgtggtacgacctccatcgacgcccgctacgtacgtggacgtcgtggactccggctccggccccggccgggcgagggacgtggggacgttggtacggttcgggccgtcgttactacgccgaagacgtacgaaaacccgtgccttaaccacccgttccccctacgtacggagtacgtaccgattacccaccgtactttacgaacgtaccgaccgttaaccgtacccaaaattaacgtaccgttaggttacccgtccgtacggtaacgtcgtacgaccggtctttcgggtacgccccggaacccggtcccgggacgggaacccggttagggtacccgtttaaagtttaaccgttacgggcccgggttaggggaacccgggggtaacggggggggaaccccgggggggggtttaaacccgggtaacccttccgttttaaggggtccccgggtttccttttaaccggggttacccgtaacgggtttacccgggggttaaccggggacccccgttaaaccgggggtaccccctttccggggtaaaccctcccccgggtttcccttacccggaccgttaccccgaccccgtttaaacccccggaaacccggggttaacccggttacccccgttacccggggtttccccccgggttaccccccccggttttccccccgggagggttaccccccccgttcccgggttaacccggtccccggtaaacccggtaccccgggggtaccctcccccggggtaaaccccggg

SEQ ID NO: 10809 - DNA, 804 bp, Homo sapiens
  misc_feature: GYAE6OF01AHS9A.40.16.B05.1.454.CMB.1.raw
  modified_base (522)..(522): a, c, t, g, unknown or other
  misc_feature (522)..(522): n is a, c, g, or t
  modified_base (747)..(747): a, c, t, g, unknown or other
  misc_feature (747)..(747): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggacgaccctaaccctcacctacactgtctctggtgacctccatcacgccgtctactactggacgcgtggacgtccggcgtccggccccggccggggcgacggggacgtgggagggggtttttttttttttaggcggggccggtccggttctactcaactaggtacgaaaccacgcctaaccaccttacccccctcccgtaccgtaggtaacgtcggacgtcgtaaccctactttacaacctaacgaccaaccgtaccaaccaaatctacgtttcgtcccgttagagggcctagacgtccttcgtcggtccgacccgggtaccggccggacggaccggggtacctaagttacgtttaaccgngggttcggacggggtaacggggggtacggggggggaacccggggttaaacctccgtagggttcggccctttacgttcgtaaccgtccgggtcgggacccggaacgggtacccgttaggacccgtaccgttccgtacccgactacccggccccttaaccggaaccccggtaccgggtaccccctacgggttccccggtttcccctcccccggtacggggtcccccnccccggtacgtaccccgtccggaaaccggtccgccccgtacccggtcccgggaaacg

SEQ ID NO: 10810 - DNA, 741 bp, Homo sapiens
  misc_feature: GYAE6OF01A83RB.40.16.B05.1.454.CMB.1.raw
  modified_base (214)..(214): a, c, t, g, unknown or other
  misc_feature (214)..(214): n is a, c, g, or t
  modified_base (225)..(225): a, c, t, g, unknown or other
  misc_feature (225)..(225): n is a, c, g, or t
  modified_base (301)..(301): a, c, t, g, unknown or other
  misc_feature (301)..(301): n is a, c, g, or t
  modified_base (671)..(671): a, c, t, g, unknown or other
  misc_feature (671)..(671): n is a, c, g, or t
  modified_base (722)..(722): a, c, t, g, unknown or other
  misc_feature (722)..(722): n is a, c, g, or t
tcagtctagcgactcacgaccggtgctcgatttagagctcacgtagggggcacgaagaacatgaaacacctgtggttcttcctcctcctggtggtagctcccagatgggtcctgtcccaggtgcagcttcaggagtcgggcccagggactggtgaaagtccttcggagacccctaaccctcacctgcactgtctctggtgactccatcagccgntactactgganctggactccggctcggcccgccgggcagggactgggagtgggattcgggcgcgtctagtcaacgagtacgaaaccngctacactccccctccgtcgagacgtcgagtcacctatttcaacgtacgacaccgtccaacgaaatcgtaacgttctcccgtggacgtctaggacgtctcgttacggcggacccggccggacggacgtacgggggtcttaagttaagttctggtacgggacgggtaacggggggacggggggggtaccggggtaaaccttccggtagtcgggtacctttcgtttaggacccgtacggtcggggcccaaccgggtaacccgtgggttacccctacccggttcctacccggtacgacccggtacccctaccggaaccccggtacgggtcccgtaacggtttcccccggggtttacccctttcccccccgggnggggtcccccccgccgttacgggtacccctaccggaagggggtaacccccnccccgtaaccccgggtacg

SEQ ID NO: 10811 - DNA, 899 bp, Homo sapiens
  misc_feature: GYAE6OF01DVQE8.40.16.B05.1.454.CMB.1.raw
  modified_base (182)..(182): a, c, t, g, unknown or other
  misc_feature (182)..(182): n is a, c, g, or t
  modified_base (187)..(187): a, c, t, g, unknown or other
  misc_feature (187)..(187): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
tcagtctagcgactcacgaccggtgctcgatttagagctcacgtagggggcacaagaacatgaaacacctgtggttcttcctcctcctggtggcagctcccagatggactctcgtaccgagcacagtctaggaggcggtccggaccgagtcgtggagacgttccgtagaccgtaccctaccncactnactctntcgtgtggtcncctcatcgcgcctactacgtaggtgctcgtagtaccgtccgtccgcccggcccgggacggtacggacggttcggtagggtaggtacggttcgggttccgggaccgttccgttaactacaccgtaggtaacgaaccgaaccgtcgtaaccctacccgtaccccttccccggtacgaggtacgtcggtacgctaactacttataccagacaccgtaccaacaatacgtccgttacggtccacggtaggcgttacgacggtctccgttaggtaccggaccccggtaccccggaacgggtccggaaaccgggtaccggttaccttaacgtttacggttcgggtacggtaccgggggtaaacggggggaccgggggggggaaaccccgggggttaccggttaaacccttcggttaacccgggttcctttaccggttttacccgggttaagggttaacccccgggtcggggtaacccgggtaaacccgggttaacccgggttacccgggttaccggttaccccgtacccgttttcccgtaccgaaccccggtcccgttaacccgaaaccccgggtaaccggggtaccccgtaccccggttacccgggttaccccggttccccgttaccccgggtcccgggttacccttacccgggtacccgttaccccggaccgggtaaacccgtccgggtaacccccggg

SEQ ID NO: 10812 - DNA, 827 bp, Homo sapiens
  misc_feature: GYAE6OF01EI6C9.40.16.B05.1.454.CMB.1.raw
  modified_base (198)..(198): a, c, t, g, unknown or other
  misc_feature (198)..(198): n is a, c, g, or t
  modified_base (787)..(787): a, c, t, g, unknown or other
  misc_feature (787)..(787): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccgttcggacgacccctaaccctcacctgcactgtctctggtnactcatcacgccgctactacgtggagcgtggactcccggctccggcccccggccgggcgacggggtacgtgggtaggtcgggtagttcgggggcctccggttactaacttccgaacgtacggtaacgaaaaccgtcggtacctaacccacccgttccccccctacccgtacgggtaacgtaccgggtccggtaaccgttaccctaacctttaattttaccgaaacgttaacgacccgttaccgtaacccaaaacgtaaacgttcgtacggttttccgacccgtaggacgtcgtacggtactcttcggtacggtacccggacccggccggaccgggaacccggtacggggttacttacgtttaaccgtttcggtacggggtacgggaccgggggtaacgggggggaccgggggggggtaaaccccgggtaactttccggtaagggttccgttccgtttaccgtttacgaaccgggtttcgggaccggggtaccggtaaccgggtaccgtggttcccctaccggttccttcccacgtaccgtccctaaccggaccgaccggtccctacggtttccccgccccttccccggngtccccgtccgtcgtccgaccggaagcccaccgtacccgg

SEQ ID NO: 10813 - DNA, 793 bp, Homo sapiens
  misc_feature: GYAE6OF01EQWVH.40.16.B05.1.454.CMB.1.raw
  modified_base (304)..(304): a, c, t, g, unknown or other
  misc_feature (304)..(304): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgacccctaaccctcacctgcactgtctcgtggtgactccatcacgccgctactacgtggagctggactccggctcggccccggcgggcgaggggtactgggagtggtagttgggcgtcgtctatcgacagtacgaaaccncgtctacctacctccccctccgtcgagtacgtccgagtccacctatttaccactagacacgtacaactaaatcagtttcgtaccctggacggtctaggacgtctacgtcgtccggacccgccggacggtacgacgggtacttaagtacttacgtggtcgggacgggaacgggggtaccggggggggtaacccgggtaaacctccggttaggtccggttaccctttaccggtttagaaccgggttacgggtccggggggtacccgtaaacccgggggtaaccccgttggggggtaaccccttacccccggtttaccgtccccgtaacggtacccgacccccgttaaccccgaaaccccggggtacccggtcccccgttaaccggttttcccccggggttccccccttaccccccggggttccgggtcccccgtccccggttcgtacccccggtaccgggtaacggggaccccgtccccctaaaccccggg

SEQ ID NO: 10814 - DNA, 818 bp, Homo sapiens
  misc_feature: GYAE6OF01AYBE9.40.16.B05.1.454.CMB.1.raw
  modified_base (152)..(152): a, c, t, g, unknown or other
  misc_feature (152)..(152): n is a, c, g, or t
  modified_base (198)..(198): a, c, t, g, unknown or other
  misc_feature (198)..(198): n is a, c, g, or t
tcagtctagcgactcacgaccggtgctcgatttagagctcacgtagggggcacaagaacatgaaacacctgtggttcttcctcctctggtgcagctcccagatgggtcctgtcccaggtgcagcttcgaggagtccgggcccaggactgggngaagccttcggacgacccctaacctcacctgcactgtctcgtggtnactccatcacgcccgctactacgtggacgtcgtggacgtccggcctccggccccggccgggacgacggggtacgtggaggtggtagtcgggccgtcggttctactacgaacgagtacgaaaaccgcgtacctacccgtaccttcccccgtcccgtacgacggtacgtaccggtacgtaccctaccctagtttacccaacgtacgaccctaccgtaccaacgtaaactcgtacgttcgtcccgtaggacgtcgtagacgtctaccgtggtaccgacccgggccgggtacccggtaacggaccgggttacgttaacgttaacgttaccggttgggccggtaaccgggaggggggtaacgggggggtaacccggggtaaacttcccggttaaggttccgtccgtttacccgttttagggaccgttaacccggggtccggggtaacccggtaaacccggggttacccgttaacggggttcccccgtaaacgtttccctaccggtccgaccggttccccgtaaaccccgaccggtaaccccggtcccgttaaccgttcccggttaccccgttcccgccggtacccgcccgttccgacccgtaccgacgggccgtcccgaacccgg

SEQ ID NO: 10815 - DNA, 843 bp, Homo sapiens
  misc_feature: GYAE6OF01EQXAF.40.16.B05.1.454.CMB.1.raw
  modified_base (196)..(196): a, c, t, g, unknown or other
  misc_feature (196)..(196): n is a, c, g, or t
  modified_base (253)..(253): a, c, t, g, unknown or other
  misc_feature (253)..(253): n is a, c, g, or t
  modified_base (308)..(308): a, c, t, g, unknown or other
  misc_feature (308)..(308): n is a, c, g, or t
  modified_base (815)..(815): a, c, t, g, unknown or other
  misc_feature (815)..(815): n is a, c, g, or t
  modified_base (827)..(827): a, c, t, g, unknown or other
  misc_feature (827)..(827): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccagggtactggtgaagccttcggagaccctaacctcacctgcactgtctctggtnactccatcagccgctactacgtggacgtctggactccggctcggccccggacgggtnaggggtactgggagtcggacgttgggcgtacgtctactcacaggtacaaaaccgngtcctaacctacttcccccctaccgtcggtaacggcggttcgaacggttcccaacccgtttattttccaacgttaaggaccctaaccggttcccaaactaaactcgtaacggtttccgcccgttaaggcgtcgttaggacctcgtttaacgtcggtaccggacccggcccggacgggaaccggtcggggtactttaatacgtttacgtgggtacggacgggacgggggtaacggggggggtaacccgggtaatttccgggtaacgttcgggccttttacccggtttaagggaacccttacgggggtcccggggtaaaccccgtaacgggggggtaacccctttcgggttaaaccccgttcccgggtttacccgttaccccttacgggaacccgtaccccccgtttaaccggaaaccccggggaacccgggtcccctttacgggtttccccggttccccccggtttaccccgtcgggccccgtccccgtcggtaccccgaaccccggnggggttaacccncccgtaacccccgggg

SEQ ID NO: 10816 - DNA, 745 bp, Homo sapiens
  misc_feature: GYAE6OF01C11ZB.40.16.B05.1.454.CMB.1.raw
  modified_base (127)..(127): a, c, t, g, unknown or other
  misc_feature (127)..(127): n is a, c, g, or t
  modified_base (229)..(229): a, c, t, g, unknown or other
  misc_feature (229)..(229): n is a, c, g, or t
  modified_base (245)..(245): a, c, t, g, unknown or other
  misc_feature (245)..(245): n is a, c, g, or t
  modified_base (336)..(336): a, c, t, g, unknown or other
  misc_feature (336)..(336): n is a, c, g, or t
  modified_base (654)..(654): a, c, t, g, unknown or other
  misc_feature (654)..(654): n is a, c, g, or t
tcagtctagcgactcacgaccggtgctcgatttagagctcacgtagggggcacaagaacatgaaacacctgtggttcttcctcctcctggtgcagctccagatgggtcctgtcccaggtgcagcttnaggacgtcgggcccaggactggtgaagccttacggacgtacccttaaccctcacctgacactcgtctcgtggtcacctcatcgagccactacgtacgtggancgtggtacgtccggcnccggccccggcgggacgacgggtacgtggggtacggtggtacggttggggccgtacgttactactaaccgtagaacggttacggaaaaccnggtaaccctaccgtaacccttccccccgtaccgtacgggtaactcggtacgtaaccgtccaacttacgtttaccaacgttacgaccctaccgaacctaataaaccgttgtaacgttccgtacccaggaggtacgtacgacgtcccgtaggtcggaccggacctcccgggacggtaacccggacgggttactaccgtttaattcgggtacggttacgggaaccgggggacggggggtaaccggtaaaccggtcgttacgtcggtctacgtttgaacggttcgaacgggccgtaacggtaccgtcggtacctccgtaccncgtacgtccgacctaccgaccgtacccgctacccggtccgtcccgtcccggtcgcccgtacccgtcgtccgaccgacgaccgcgccggacg

SEQ ID NO: 10817 - DNA, 674 bp, Homo sapiens
  misc_feature: GYAE6OF01CAA9X.40.16.B05.1.454.CMB.1.raw
  modified_base (633)..(633): a, c, t, g, unknown or other
  misc_feature (633)..(633): n is a, c, g, or t
tcagtctagcgactcacgaccggtgctcgatttagagctcacgtagggggcacaagaacatgaaacacctgtggttcttcctctcctggtggcagctcccagatgggtccctgtcccaggtgcagcttcaggagtcgggcccaggactggtgaagccttacggacgtacccctaaccctcacctgcactgtctcgtggtgacctccatcacgccgtctaacgtacgtggacgctaggacgtccggctcggccccggcgggcacggggtacgtgggaggttggacgttcgggcgtcgtactactcactagtacgaaaccgacgctaacacctccccctccgtacgacggacgtcgacgtccaacctactttacacgtaacgacaccgtaccaactaactctacgttcgtaccctgacggctagacgtctcgtgtcggaccgcggcggaccgacgggtacttatacgttctggtacgacggacggggacgggggacccgggtaactcgtgcggtccttcgtcgacgtcggcgggacctacgggaccgtggacctccgtctccgtcaccgtacccgtacccaccggtaacggcccgtaccggtttccccggtccccttaccccggcgggtaccccncccgtacggccccgtaacggaaccggccgaaccggtcccgg

SEQ ID NO: 10818 - DNA, 954 bp, Homo sapiens
  misc_feature: GYAE6OF01DMVO6.40.16.B05.1.454.CMB.1.raw
  modified_base (305)..(305): a, c, t, g, unknown or other
  misc_feature (305)..(305): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaacctcacctgcactgtctcgtggtcgactccatcagccgactactactggagctggactccggctcggccccggcgggcagggactgggagtggagttcggggcgccgtcgtaactcgacaggtacaaacccgngacctacaccttcccccctaccgtacgacggtaacggttccggaacgttcccaaccttacttttacccgaacgttaacggaaccctacccggttaacccaaacgttaaaacgttcccgtaaagggtttcccgttaccccgtagggaccggtaccgttagggaaccgtttccctccggttacggttacccggaaccccggggtcccgggtaaccgggtaacccgggtaaccggggggtaccttaacgtttaacggtttaccggttaggggtacgggtaccggggtaaacggggggacccgggggggggggtaaacccggggggttaaaccctttcccgggttaacggtttcccgggggtacctttttaccccgggtttacggtaacccggtttaacccggggtccggggggtaaacccgggaacccgggggttaaacccccggttcggggttacccggttaccccggttaccgttccccggtaccgaacccggttacccccttaccccggaaaccccggtaaccggggtcccccttaaacccgggttcccccggttacccccggtttccccccgggtcggggtcccccgtacccccggttcggtacccgtaacccccggtaacggggccctccccggtaaaccccccggg

SEQ ID NO: 10819 - DNA, 207 bp, Homo sapiens
  misc_feature: GYAE6OF01D6JCJ.40.16.B05.1.454.CMB.1.raw
  modified_base (127)..(127): a, c, t, g, unknown or other
  misc_feature (127)..(127): n is a, c, g, or t
  modified_base (131)..(131): a, c, t, g, unknown or other
  misc_feature (131)..(131): n is a, c, g, or t
  modified_base (159)..(159): a, c, t, g, unknown or other
  misc_feature (159)..(159): n is a, c, g, or t
  modified_base (171)..(207): a, c, t, g, unknown or other
  misc_feature (171)..(207): n is a, c, g, or t
tcagtctagcgactcacgaccggtgctcgatttagagctcacgtaggggcacaagaacatgaaacacctgtggttcttcctcctcctggtggcagctcccagatgggtcctgtcccaggtgcagctnaggngtcgggccaggctggtgaagccttgganaccctaaccctnnnnnnnnnnnnnnnnnnnnnnnnnnnnnnnnnnnnn

SEQ ID NO: 10820 - DNA, 807 bp, Homo sapiens
  misc_feature: GYAE6OF01A2Q6W.40.16.B05.1.454.CMB.1.raw
  modified_base (180)..(180): a, c, t, g, unknown or other
  misc_feature (180)..(180): n is a, c, g, or t
  modified_base (716)..(716): a, c, t, g, unknown or other
  misc_feature (716)..(716): n is a, c, g, or t
  modified_base (723)..(723): a, c, t, g, unknown or other
  misc_feature (723)..(723): n is a, c, g, or t
  modified_base (770)..(770): a, c, t, g, unknown or other
  misc_feature (770)..(770): n is a, c, g, or t
  modified_base (792)..(792): a, c, t, g, unknown or other
  misc_feature (792)..(792): n is a, c, g, or t
  modified_base (799)..(799): a, c, t, g, unknown or other
  misc_feature (799)..(799): n is a, c, g, or t
tcagtctagcgactcacgaccggtgctcgatttagagctcacgtaggggcacaagaacatgaaacacctgtggttcttcctcctcctggtggcagctcccagatgggtcctgtcccaggtgcagcttcgaggagtccgggcccaggactggtagaacgccttacggacaccctaaccctnacctgcactgtctctggtcacctcatcacgccgtactactacgtggatcgtacggactcccggctccggccccggccgggctacggggacgttggaggtggtaggttcgggccgtcgttactacgtaccgtaacgaacggttaaccgaaaaccgtacgtaccttaaccgaccccgtttacccccccgtccgtacgggtaacggtaccggttacccggtaacggtaccctaaccgtttacttttacccgaaacgttaaccgtaccctaacccgggttaccaaaacgttaacgtaccgttacggtttccgtaccccggttaggacggtaccgttacggaccgttccgtacgttccgggtaaccgacccggccggtaacggacggtaccgggtcttaataccgtcgttcggtcgggaagggaccgggggtaccggggggaacccgtaacttcggtaacggttccgtacccgtttacgttacggaccgttaccggggacgggacccttaaccgggtaccgtcggttaccctacgttcccncgtaccncggtccctacggacggtaccgtccgtcggttcccggtccctcccggnggccctccgtcgcccgtacggnggtaccncccgtacg

SEQ ID NO: 10821 - DNA, 593 bp, Homo sapiens
  misc_feature: GYAE6OF01BENMV.40.16.B05.1.454.CMB.1.raw
  modified_base (288)..(288): a, c, t, g, unknown or other
  misc_feature (288)..(288): n is a, c, g, or t
  modified_base (555)..(555): a, c, t, g, unknown or other
  misc_feature (555)..(555): n is a, c, g, or t
  modified_base (563)..(563): a, c, t, g, unknown or other
  misc_feature (563)..(563): n is a, c, g, or t
tcagtctagcgactcacgaccggtgctcgatttagagctcacgtagggggcacaaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattggggcgcgtctatcacagtagaaaccngctacactccccctcctcgagagtcgagtcacctatttcactagacacgtccaacaatcagttcgtccctggagctgagctctgtcgacccgcgcggacgcgggctatattacgtgtgcggagggacgggggggacccggggaactcgtagtcggtcttccgtttgaccttacggtcgggggacccacggggtaaccctgggtacctaccgttctccgtcacgccctaccaacccgacgggcccctagttccggtcccttcccccgngggtcccncccgtgccctccgacggtcgcccgtacccg

SEQ ID NO: 10822 - DNA, 670 bp, Homo sapiens
  misc_feature: GYAE6OF01EDV7P.40.16.B05.1.454.CMB.1.raw
  modified_base (289)..(289): a, c, t, g, unknown or other
  misc_feature (289)..(289): n is a, c, g, or t
  modified_base (327)..(327): a, c, t, g, unknown or other
  misc_feature (327)..(327): n is a, c, g, or t
  modified_base (348)..(348): a, c, t, g, unknown or other
  misc_feature (348)..(348): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcggggcccaggactggtgaagccttcggagaccctaaccctcacctgcactgtctctggtgactccatcagccgctactactggagctggatccggctgccccggcgggcgagggactggagtggattgggcgcgtctatcacagtcgaaaccngctacactccccctcctcggagacgtcgagtccacctnttttacactagacacgtccanaactcagttcgtccctgagctgagctctgtcgccgccgcggacgacgggcgtatatacgtgtgcggagggagggggggaccggggaactccgtagtcggtacgttcctttaggacgttaccggtgggggtccccaaggggtaccccttggggtacccgtaccccggtcgtttacccgtaccggaacggtccccgtacccgtaccccggaaacggggttccccccgtaacgtttcccggggttacccctttcccccccggtggggtcccccggtacccccgtttcggccccgttacccgaccggggtcgccccgtaaccccgg

SEQ ID NO: 10823 - DNA, 830 bp, Homo sapiens
  misc_feature: GYAE6OF01CUMCR.40.16.B05.1.454.CMB.1.raw
  modified_base (298)..(298): a, c, t, g, unknown or other
  misc_feature (298)..(298): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagtccttcggacgacccctaaccctcacctgcactgtctcgtggtcgacctccatcacgccgactactacgtggacgcgtggacgtccggcgtcggccccggccgggcgacgggactggaggtggagttcgggcgtctcgtaacncgaacaggtaacgaaaccgtacgcctaacccgtaccttccccccgtccgtaacgacggtacgtccggaacggtacctaaccgttattttaccgaactaaccggaactaaccggtaccaaactaaagtccgtacgtttacgtcccgtaggacgtctaggaccgtcgtccgttagggaccggtaccggcccgggtaccggtaacggaccggggttacttattacgttacgtgggacggacgggaacggggggtaaccgggggggaaccgggttaactccgggtaagttcgggtacccttttccggttacggtaccgttaaccggggtccggggtacccggtaaccggggttaaacccgtttccgggtacccgtacccgtcccgtttaccgcgtaaccccgtacccggtacccaaacccgggttaaccggccccgttaacggtccccggtttaccccggtccccggttcccgggcccccgggtttcccaacggttcccccacgggtaaccgggtacctccccgtaaaccccgggg

SEQ ID NO: 10824 - DNA, 915 bp, Homo sapiens
  misc_feature: GYAE6OF01BFNFD.40.16.B05.1.454.CMB.1.raw
  modified_base (225)..(225): a, c, t, g, unknown or other
  misc_feature (225)..(225): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcgaggaggtcgggcccaggactggtgaacgccttcggacgacccctaaccctcacctgcactgtctctggtcactcatcagccgctactacgtggancgtggactcccggcgtccggccccggccgggacgacggggtacgtggggtaggtgggtaggttcggggcctcggttctaactaccgaacggtaggtaaccgaaaacccctggtacccttaaacctacccttcccccccgtaccggttaccgggaaaggtccggttaccgaaacgttccctaaccttaacttttccgaaaaccgttacgaaccctacccggtaccaaaacgtaaaccttccggtacgtttcccgtacccgtagggtaacccgtcgtttaaggacgtcccttgtaccggtcggaacccccggtccgggacgggacccgttacgggggactttacgtaacgtttacggcggtagggtaaccggggaacggggggaaaccggggggggggacccgggtaaactttcccgggttagggtaccgttccctttaccggttttacggaacggtttaacccgggcgggggtaccccggtaaccggggtaccccgtttacggggtaaccccctaccggttccccttaaccccgaggtaccctaccccgttaaccccggaaccgggtaaacccggggtcccctttaccgggttacccccgtttcccccggttcccccggacggggtaacccccttccccggtaccgtacccccggtaacggacccggggtaccgtacccccggtaacccgg

SEQ ID NO: 10825 - DNA, 953 bp, Homo sapiens
  misc_feature: GYAE6OF01DCYVS.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcgagggagtccggggcccaggacttgggtgaacgtcccgtttacgggaacgaacccccttaaccctcacctgcactgtctcgtaggtgacctccagtcacgcccgctaaccttacgagggacgtccgttagggaaccgttcccgggcgttccggcccccgggccggggtaccggaacgggggtaacctgggggtaggtcgggtaagttcgggggaccgtcgttacttaacgtaccgaacgtaacggtaaccgaaaaccctgtacctacctacccttaccccccgtccgtaggacgtacggtacgtaacgttcccaaactttctttaacgaactaacggaccctaaccgttaaccaactaaacgtcgttaacggttcctacccgtggacgtctaggactccgttacgtcggtaccggaacccggccggacgggtaaccgggtaaccggggttaactttacgttaaccgtttaacggtcgggtacggggacccggggaaagggggggtaacccggggggggtaaccccggggttaaacttcccgggtttaacggttccgggtaccccgtttttacggtttacgggtaacccggttaccgggtaaccggggggtaccgtaacccgggggtaccccgttacgggttaccccttacccgggttcctttaccgtaccggaaccccggttccccctaaacccgggacccgggtaaaccggtccccgttaacccgggttcccccggtttacccccggttcccccgggtcggggtaccccccttaccccggtcggtaaccccgtccggaaaccggtccgtacccccgtaaccgg

SEQ ID NO: 10826 - DNA, 704 bp, Homo sapiens
  misc_feature: GYAE6OF01EMUL2.40.16.B05.1.454.CMB.1.raw
  modified_base (196)..(196): a, c, t, g, unknown or other
  misc_feature (196)..(196): n is a, c, g, or t
  modified_base (222)..(222): a, c, t, g, unknown or other
  misc_feature (222)..(222): n is a, c, g, or t
  modified_base (612)..(612): a, c, t, g, unknown or other
  misc_feature (612)..(612): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtnactccatcagccgctactacgtggancgtggactccggctcggccccggccgggcagggacgtggagtggagttcgggcgtcgtctatcacgagtacgaaacacgacctactacctccccctccgtcggacgtacgtcgacgtacctacctatttccactacgaccaccgtaccaacgtaaatcgtacgttcgtcccgtaggacggtctacggacgtcgttacgtcggtaccggacccgccgggaccggaccggtacgggtacttaacgttacttacggttcgggtagacgggggaaggggggaaccgggggggtaaccccggggttaactcggttaacggtcggttcctttacgttacggcgttacgggccgggtaccgaacgggtaccctggtccctaccgttcctaccgtacncgtcccaacccgacggaacccgcccgtcttcccggtccccttcccgcggtcccgccttacgcccgttaaccgcgggtacccccggtaacccg

SEQ ID NO: 10827 - DNA, 852 bp, Homo sapiens
  misc_feature: GYAE6OF01AHLSN.40.16.B05.1.454.CMB.1.raw
  modified_base (200)..(200): a, c, t, g, unknown or other
  misc_feature (200)..(200): n is a, c, g, or t
  modified_base (339)..(339): a, c, t, g, unknown or other
  misc_feature (339)..(339): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaacccctaaccctcacctgctactgtctcgtggtnactccatcacgccgtactacgtacgtggacgtcgtacggactccggcgtccggccccgccgggacgacgggtaccgtaggggacggtaggtacgttcggggacgtcgttactaatacgaaccgtagtaaccgaaaccgngtacctaaccgacccgttcccccgttacccgaggaacgttacggtaccgtacgtacctactactttacgactacggaccacgtaccaactaattcgtacgtttcggtcccaggtaacgtctacgacgtaccttcgtcggtaccgacccggtcgaaccgggtaccggtacggtacgtaatttacgttacgttagggcggaacgggacggggaccgggggggtaacccggaaccgttccgtacggttaccgtaccgtttaccgttacggtaaccggttccgggtaacccggggtacccgtaaacccgggttacccggttacgggtaaccccgttccggttacccgttcccggtaaccaacccggttcccctaaccgggtaaaacccggtccccgggtaacccttccgggtttacccccggtacccccggtttccccggtacccggcccggttacccccggttacccgtaaccggtaccccggttaccgggaaccccggtcccgtaaacccccggg

SEQ ID NO: 10828 - DNA, 922 bp, Homo sapiens
  misc_feature: GYAE6OF01CICWB.40.16.B05.1.454.CMB.1.raw
  modified_base (190)..(190): a, c, t, g, unknown or other
  misc_feature (190)..(190): n is a, c, g, or t
  modified_base (287)..(287): a, c, t, g, unknown or other
  misc_feature (287)..(287): n is a, c, g, or t
tcagtctagcgactcacgaccggtgctcgatttagagctcacgtagggggcacaagaacatgaaacacctgtggttcttcctcctcctggtggcagctcccagatcgggtcctgtcccaggtgcagcttcgagggacggtcgggccaggctggtgaacgccgttacggacgacccctaaccctcaccgtncactctcgtcgtggtactacctcatccgacgccgtactacgtacgtggacgccgtggaccgtccggcgtccgggacccggccgggacgcgggtacgnggaggttggtacggtcgggcgtcgtatacgtcgaaccgtacggtacgaaaccgtaccgaccttaaccaccccgttccccccgaccgtaccggaaggtaccgtcggtaaccgttaccctaccttaaccgttttacaacccgtacgaaacctacccgtaacccaaaagttaaactcccgttaacggtttcccgtaacccggttaggaccggtaccgtacgtcggtccctttaggtccgggtaccggacccgggcccgggtaccacggggggggggggggggtacctacggttaacgttacgtttacgtcgggtacgggtacgggggtaacggggggaaccgggggggtaaccgggtaccggttaccggtacgggtaaccggttccgttaccggttaccggtaccgggttaccgggtaccggggtaccgggtaacccgggggttacccggttaccgggtacccgttacccggttccccgttacccggtcccgtaacccgtacccggtaacccggtaacccggtaacccggggtaccccgtacccgggttccccggttccccgggtttacccccgggtcccggtacccggtccccgtcccggtacccgtaccggacggaccggtacccggtaccccggg

SEQ ID NO: 10829 - DNA, 850 bp, Homo sapiens
  misc_feature: GYAE6OF01BXYUC.40.16.B05.1.454.CMB.1.raw
tcagtctagcgactcacgaccggtgctcgatttagagctcacgtaggggcacaagaacatgaaacacctgtgttcttcctcctcctggtggcagctcccagatgggtcctgtcccaggtgcagcttcgaggagtcgggcccaggactggtcgaagccgttcggacgaccctaacctcacctgctactgtctcgtggtgactccatcgacgccgctactacgtggacgtcgtggactccggtctccggccccggacgggtacgacggggtacgtagggaggtcggtagttcggggccgtccgttactacgtccgaacgtaaggtaccgaaaaccgtacgtaccctaacctacccttccccccgtacccgtaggaacggtacgttccgacgttccaaccttagtttaccaacgttacgacccaaccgtaccaaacgtaaactccgtaggttccgtacccgtaggcggtacctggacgtcttcggtacgtaccggacccgccgggaccggaaccgggtacgggtaccgtttaattacgttacggtcgtacgggaacggggtaacggggggaacccgggggggtaacccgggttaacctacccggttaaggtccggttacccgtttaccgttacggtaacccgtacggggtaccggggaacccgttaaccgggggtaccccgttcggtaaccccgttaccgttcccgtaccgtacccggaacccgtccccgttaaacccggaccccgggtaaccggttcccccgtacggtttccccggttaccccgttcccccggagggtccccctcccggtaccgacccgttacggaaaccggtcccgaacccgtaaccccgg

SEQ ID NO: 10830 - DNA, 721 bp, Homo sapiens
  misc_feature: GYAE6OF01CG91B.40.16.B05.1.454.CMB.1.raw
  modified_base (210)..(210): a, c, t, g, unknown or other
  misc_feature (210)..(210): n is a, c, g, or t
  modified_base (222)..(222): a, c, t, g, unknown or other
  misc_feature (222)..(222): n is a, c, g, or t
  modified_base (296)..(296): a, c, t, g, unknown or other
  misc_feature (296)..(296): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgacccctaaccctcacctgcactgtctctggtgactccatcagccnctactactgganctggactccggctcggcccggcgggcagggactgggagtggtagttgggctcgtctatcacgagtacgaaaccngacctacacctccccctccgtcgaacgtcgtcgacgtccaaccttatttaccaacgtacgacctaccgtaccaaactaaacgttcgtaacgtttcgtcccctaggacgtctaggactcgttccgtaggtaccggaccccggtccggaccgggaccgtacggggtacttaattacgttaccgtgggtcggaacggggagggggtaccgggggggaccggtaaccttcgtaggtcggtcccttacgttacgccgttacgggtcggggaccgtaaccgggtacccgtcggtaccctaccgttcctacccgcgtacccgccctacccgaccggtaacccgggccctacggttccccggttccccttccccggcggtaccccgtccccgtccggacccggtcccgaacgggccctcccgtaaaccccggg

SEQ ID NO: 10831 - DNA, 882 bp, Homo sapiens
  misc_feature: GYAE6OF01B1TQE.40.16.B05.1.454.CMB.1.raw
tcagtctagcgactcacgaccggtgctcgatttagagctcacgtagggggcacaagaacatgaaacacctgtggttcttcctcctcctggtggcagcctcccagagtgggtcctcgtcccagggtcgcgacgcttcgaagggacggtccggggccccagggtaccgtgggtaggtaacgtcccgttaccgggaccgtaacccccttaacccctccacctcgacctaccgtgttcctcgtggtcacctccatccgacgcccgccttaacgtacgtgggacgtcgtacgggtacgtcccgggccgtcccgggcccccggggccggggacggacggggtaccggtggggtaggtgggtaggttcggggcgtccgtactactaccgaacgtacggtaaccgaaaccgacgtaccctaaccctacccttcccccccgtaccggtaacgacggtacggttacgaccgtacctaaccttaactttacgaaccgtacgaacctaccgtaaccaaactaacgtcgtagtccgtaccgtggacgtcgaggactcgtcgtacgaccggcccggaccggtacggaccgggtaccggttacttaacttcgttacggtgggtacgggaaccggggggtaacgggggggacccgggggggtaacccgggtaacttcccgggttaggtccggttccctttaccggttacggacgtttaccggggaccgggacccgggtaaccggtacccggttccggtccctacccggttccgtacccgtcggaccccgtacccaccgaaccccgggtacggcccgttcccggtttcccggtccccccgttcggcccggacccctttcccggcgtaccccggtacggcggccccgtaccgtacccggg

SEQ ID NO: 10832 - DNA, 885 bp, Homo sapiens
  misc_feature: GYAE6OF01BBXTJ.40.16.B05.1.454.CMB.1.raw
  modified_base (324)..(324): a, c, t, g, unknown or other
  misc_feature (324)..(324): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcgaggagtcgggcccaggactggtgaagccgttcggacgacccctaaccctcacctgcactgtctcgtggtcgacctccatcacgccgcttactacgtggagcgtggactccggctccggccccgggccgggcgacggggctggggaggtggtaggttcggggcgtccgtctacgtccgacgtaggtacgaaaccncgtacctaccacccttcccccctccgtcgacggacgtacgacgtaccaccttacttaccactacgaccctaaccgacctaacgaattcgtagtttccgtacccgtaggaccggtctagaccgttcgttaccgtcgggtacccggacccgggcccgggtaccgggtaaccggggtaccggggttactttaacgtttaaccggttacggtacggggtacggggtaacgggggtaacggggggggggtaaccccggggggggggtaaccccggggttaaacttccgggttaacgggttccggttacccgttttaccggttacggtaacccggtacgggggttccccggggaaccgtaacccgggggttaccccttcggggtaaccccgttcccggttcctcccggtacccgaccccggtaccccacccggaaacccgggtaccgggtccccctttacgggttcccccccgggttccccgtttacccccgggccgggtccccccgttaccccggtacgtcccccggaacccggtaacggggtcccccgtaacccgtaaccccggg

SEQ ID NO: 10833 - DNA, 867 bp, Homo sapiens
  misc_feature: GYAE6OF01A4XQD.40.16.B05.1.454.CMB.1.raw
  modified_base (333)..(333): a, c, t, g, unknown or other
  misc_feature (333)..(333): n is a, c, g, or t
  modified_base (798)..(798): a, c, t, g, unknown or other
  misc_feature (798)..(798): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtagaacgccttcggacgaccctaacctcacctgcactgtctctggtcactccatcgacgccgactactacgtggactcgtaggactccggctcggccccggaccgggacgtacggggccttaggggacggtcgggacgtttcggggcgtccgtactagtaccgaacgagttaacggaaaaccnggtaccttaaccaccgttcccccgtccgtacggaacgtacgtaccggtactaccaaccgttaactttccgaacgttaacgaccgtaaccgtacaaaccgtaaacgttacgtacgtttaccgtaccctagggacgtccttaggaaccgtaccttcgttacggcccggaaccggtccggaccgggtaacgacgggttactttaaattccggtttaagtcgggtacggaaaccgggtaggggggaaccggggggggttaaccgggtaacccctgtttacgggcccggtttacccgtttccgttaaggtaccccggttaacggggtcccggggaaccgttaaacccggtaccccgtttgggaccccttaccgttcccgttaccaaccgggttcgtaaccccctccgggaaaacccggtaaccgggttccccttcgggttaacccccgttcccctttacccccccggggngggtaccccgtttccccgaaaggggttaccccctaccggggtaacccaggttcccccccaaaccggggg

SEQ ID NO: 10834 - DNA, 755 bp, Homo sapiens
  misc_feature: GYAE6OF01CX5MC.40.16.B05.1.454.CMB.1.raw
  modified_base (213)..(213): a, c, t, g, unknown or other
  misc_feature (213)..(213): n is a, c, g, or t
  modified_base (325)..(325): a, c, t, g, unknown or other
  misc_feature (325)..(325): n is a, c, g, or t
  modified_base (414)..(414): a, c, t, g, unknown or other
  misc_feature (414)..(414): n is a, c, g, or t
tcagtctagcgactcacgaccggtgctcgatttagagctcacgtagggggcacaagaacatgaaacactgtgttcttcctcctcctggtggcagctcccagatgggtcctgtcccaggtgcagcttcagggagtcgggcccaggactgggtgaacgccttcggacgacccctaacctcacctgcactgtctcgtaggtcactcatcacgccgntactactgggatcgtggacgtccggctcggaccccggcgggacaaggggacctggggtacgtggtaggttcgggccgttacgtactacgtcaacgtacggtaacgaaaaccncgtacctaacctaccctccccctcgtcgaagtcggtgacgtaccctactatttaccgacgttacgaacaccgtaaccaaacgttaaacncgtaacggtttaccgtcccttagggaactcgtagcggtccttacgtggtaaccgacccgggccgggaaccgggtaccggtaccggggactttaagtacgtttaaccggtgggtacgggacgggacggggggtaaccggggggggaaccgggtaaaccgtccgtaaggtccgggtaccgttacctttacggaacgtccgggtaccgggtccggaaacgggtcccgtacgggtacctacccgtccgttaccgtcgaccggtcctacccggaccgtaacgggcccgtacgttcccgggtcccttccccggaggtccccgcctcggtccacgtcgacgcctaccg

SEQ ID NO: 10835 - DNA, 955 bp, Homo sapiens
  misc_feature: GYAE6OF01E5845.40.16.B05.1.454.CMB.1.raw
  modified_base (473)..(473): a, c, t, g, unknown or other
  misc_feature (473)..(473): n is a, c, g, or t
tcagtctagcgactcacgaccggtgctcgatttagagctcacgtagggggcacaagaacatgaaacacctgtggttcttcctcctctggtggcagctcccagatcgggtcctgtcccaggtgcagcttcgaggacgtcgggcccaggacgtggtagacgtccttacggaccgtacccctaacctcacctgctactcgtctcgtggtcacctcctacgtcacgcctacttactcgtaggacgtcgtcggacgtccggtccgtccggcccgggcgggaggacgggtacggtgggtacggtcggtacggtcggggaccttcgtactaactaccggaacgtaaccggtaaaccgaccgtcctacctaccctccccgttcccgtcggacgtacggtacgccgtactacctaaccgttacgtactaaccgtaacgtaccgaaccttaaccaagtaccttacggtcgttaccgtaccggnggtacgtccgtacggttcctcgtttacccgggacggtaccccgggacccgggtaccgggaaacggccgggtttaagggtaccctttaaagttaccgggttacgggtcggggtaaacccgggggaaccgggggggtaaggggggtaaaccccgggggggttaccgtaacccttttagggtccggtttacccgggtttacccgttttaccggaaacggggttacccggttacccgggggtaacccgggtaccgggaacccgttttacccgaccgggtacccccttaccgttcccgtaaccctacggtaccccccggtaacccgtaacccgggtaacccggaaccccgggtttcccgttaccccggggttttcccccctaaccccccgggggttccccggaccccgggtttaaacccctccccgggtaaccgttaacccccggagggttaaaaccccccgccccggttaccccgtaaaccggggg

SEQ ID NO: 10836 - DNA, 1199 bp, Homo sapiens
  misc_feature: GYAE6OF01EML66.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcgaggaggtccgggcccaggacgtggtaggaacgtccgttcggacgtaacccctaaccctcaccgtgccactcgtccgtcgtggtacgacctccactcgacgccgtactacgtacgtggacgtcgtacggacgtccccggtcgtccggcccccgggccggggaccggtaaggggtaccgttagggggtagggtacggtacggttcggggaccgttaccgttaaccgtacgtaccgaaccgtaaggtaacgaaacccggtaacgtacccgtaaccctaaccccgttccccccgttaccgacggtacggtaccgttacggtaaccgttacctacctttactttaaccgaaccggttaacgaaaccccgttacccgaaacctaaactaaaccggttaccgttaacgggtttacccgaccgggttaacgggtacggtaaccggttaaggttcccgtaacgtttccgggtttacgggaccccggtacccccgggggacccggggggtaaaccgtacccggggtaacccggggggttaacttttaaacggtttaaccggtttaacccggtaacgggggttaccgggggtaaccgggggggttaaacccgggggggggggaaacccgggggggggggtttaaacccccgggggtaaacccgtttttaacccgggggtaacccgggtttacccggggttttaaccccggttttaaccccggggttttaaacccggggaacccgggttttaacccgggggggtaacccccgggggtttaaccccggggggttaaaaccccgggttaaccccggggtttaacccggggaaccccccggtttttaccccgggttacccccttaacccccgggtaacccggtttaaaacccccgtcccccccgggttaaaaccccgggaaacccccggggtttaaacccccggggaacccccgtttttcccgggttttaaacccccccccgggggttttcccccccggtcccccccggggttacccccggggtaacccccgggttcccccccgggtttaccccggaccccgggttttaaaacccggggcccgg

SEQ ID NO: 10837 - DNA, 733 bp, Homo sapiens
  misc_feature: GYAE6OF01AV38X.40.16.B05.1.454.CMB.1.raw
  modified_base (296)..(296): a, c, t, g, unknown or other
  misc_feature (296)..(296): n is a, c, g, or t
  modified_base (323)..(323): a, c, t, g, unknown or other
  misc_feature (323)..(323): n is a, c, g, or t
  modified_base (502)..(502): a, c, t, g, unknown or other
  misc_feature (502)..(502): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtccgggcccagggactggtgaacgtccctttcgggacgacccctaaaccctcacccttgcacgttgtcctcgtggtgacctccatccgagcccgctacgtacgtggactcgtggactccggctcgccccggcgggcacggggctgggagtggagttgggccncggtactactcacgtagacgaaaccgngtaccctacgtacctccccgttcccgtacggacgtcggtaccggtacgttccaacccttagttttaccaccgttaaggaccctaccgtaccaaactaaacgttcgtacgtttccgacccgttggacggtctagacgtccttcgacgtccggaccgtccgggccggaacgaccggggttntaacttacgttcggtgtaccggacgggagggggtaaccggggggtacccgggtaactccgtacgtacggtcctttacgtagaccggttaacggtccggggactaccgggaccctttcggacctacccggtctaccgacgtacctcccgaccacggacccggtcccaggtttccccgtccttaccccggcggtccgccccgtagtccctacggagacctccgcccgtaccgg

SEQ ID NO: 10838 - DNA, 840 bp, Homo sapiens
  misc_feature: GYAE6OF01B0CCL.40.16.B05.1.454.CMB.1.raw
  modified_base (195)..(195): a, c, t, g, unknown or other
  misc_feature (195)..(195): n is a, c, g, or t
  modified_base (220)..(220): a, c, t, g, unknown or other
  misc_feature (220)..(220): n is a, c, g, or t
  modified_base (302)..(302): a, c, t, g, unknown or other
  misc_feature (302)..(302): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagacccctaacctcacctgcactgtctctggtnactccatcagccgctactactggancgtaggactccggctcggaccccggccgggcagggtactgggagtggagttgggcgtcgtctatccaacaggtacgaaaccnggtctaaccacctccccctccgtacggagtcgtcggaactccacctatttaccgaacgtacgactaccgtccaaactaaagttcctaaggtttccgtcccctaggacgtcgtggagtccttacgtggtaccggacccgtccggacggtaaccgacggggtacttaattaacgtttaccgtagggtcggaaccgggaaggggggaaccggggggggtacccgggggtaaaaccttcccggttaacggtccggttccgtttaccggttttacggacccgtttaccgggtacgggggacccccgtaaacgggggttacccccgttacggggtaccccgttaacccgggttcccttacccgttacccggaacccggttacccccttaaccccgggaaaccccggaacccgggggtcccccccttaacggtttccccccggggtttacccccttccccccgggttcggggtaccccccttccccggtaaccgggtcccccgtaacccggaacccggggtccgtaaccccccgtaacccccggg

SEQ ID NO: 10839 - DNA, 782 bp, Homo sapiens
  misc_feature: GYAE6OF01D4MDE.40.16.B05.1.454.CMB.1.raw
  modified_base (254)..(254): a, c, t, g, unknown or other
  misc_feature (254)..(254): n is a, c, g, or t
  modified_base (355)..(355): a, c, t, g, unknown or other
  misc_feature (355)..(355): n is a, c, g, or t
tcagtctagcgactcacgaccggtgctcgatttagagctcacgtaggggcacaagaacatgaaacacctgtggttcttcctcctcctggtggcagctcccagatcgggtcctgtccccgaggtcgcagccttcgagggacgtccgggccccaggactggtagaacgccttcggacaacccctaaccctcaccctgcctactgtcctcgtggtcgacctcctataccgacgtcccgtactaaccgtacgtggacncgtggtaccgtcccggctcccggcccggccggacgacgggtacgtggtacgtggtagttcgggccgtacttaccgtactacgaagtacgtaaccgaaaccncgtaccctaaccgtccctccccctccgagggtaagtccgtccggaacctaccgtaacgtttcttaccgacgtaacgacctaccgaacctaaactaagtccgtacgttccgtacgtggtcgtctaggcttcgtcggtcgaccggtccccgcgggaccgtacggtacggtacttaattaccgttgacgggtggaacggggaacgggggtaacgggggaacccgttaactccggttaacggtcctttcggttcgttaacggaccggtttacgggtaccgggaccgtaaccgggttcccgtacgggtacccgtccgtacctaccgtctaaccgtccccgaagtacccggaccgtcccggtaccccttccggtccccctcccggaccgtcccgtcccgtaccgacccgtacggaccggactcccgtaacccg

SEQ ID NO: 10840 - DNA, 862 bp, Homo sapiens
  misc_feature: GYAE6OF01EHOZ3.40.16.B05.1.454.CMB.1.raw
  modified_base (850)..(850): a, c, t, g, unknown or other
  misc_feature (850)..(850): n is a, c, g, or t
tcagtctagcgactcacgaccggtgctcgattttagagctcacgtagggggcacaagaacatgaaacacctgtggttcttcctcctcctggtggcagctcccagatgggtcctcgtcccaggtgcagcttcaggagtcgggcccaggactggtgaagccttcggacgacccctaaccctcaccgtgacctacgttgtcctcgtggtcgaacctccgatcacggcccgtactaaccgtacgtggacgcgttggacgtcccgggacttccgggccccccgggccgggacgtaacgggggtaaccgttaggggaacggttcgggtaagtttccgggggaccgtccggttactaacgttaccgaaccggtaaggtaacgaaaaccccgaggtcccttaacctaccccgttccccccgttaccggtacggtacggacggtaccgttacgaccctaaccgttactttaccgaacgttaccgactaccggtaccaaactaatccggttagttccgtacccgtaggacgtcgtaggtacctcgttacgtcgggtaccgaccccggtaccggacgggtaaccgcggggttacttaacgttaccgttacgtcggggtacggacggggaacggggggtacgggggggtaaccccggaacgttccggttacggtcggttacccttacggttccgaacgtacgggtccgggaacccgtaacgggtacccgtcgttacccgtacccgttcgtacccgtaccgaccgtaccccgtacccgaaccgggtaaccgtccccgttacggtccccggtttaccccttcccggaccggtccgtcccggtacgcccaacgggcccgtaaccnccgtaaccccgg

SEQ ID NO: 10841 - DNA, 798 bp, Homo sapiens
  misc_feature: GYAE6OF01AMTDE.40.16.B05.1.454.CMB.1.raw
  modified_base (67)..(67): a, c, t, g, unknown or other
  misc_feature (67)..(67): n is a, c, g, or t
  modified_base (228)..(228): a, c, t, g, unknown or other
  misc_feature (228)..(228): n is a, c, g, or t
  modified_base (704)..(704): a, c, t, g, unknown or other
  misc_feature (704)..(704): n is a, c, g, or t
  modified_base (766)..(766): a, c, t, g, unknown or other
  misc_feature (766)..(766): n is a, c, g, or t
  modified_base (783)..(783): a, c, t, g, unknown or other
  misc_feature (783)..(783): n is a, c, g, or t
tcagtctagcgactcacgaccggtgctcgatttagagctcacgtagggggcacaagaacatgaaacncctgtggttcttcctcctcctggtggcagctcccagatgggtcctgtcccaggtgcagccttcgaggagtccgggcccaggactggtgagtccgttcggacgacccctaaccctcacctgccactgtctctggtcactccatcacgcccgtctacctacgnggacgcgtggactcccggcctacggccccggccgggacgacggggtaccgttggggaggttgggaggtttcggggcctcggttaccgtaatcccgaacgtacgtaccggaaaaccccggtaccctaaccccacccttcccccccgtaccgtacggaaggtaccggtaccgaacgtcccgaaccctttagtttaccccgaacgtaccgaaccctaccggttaacccaaaacttaacgtccgtagtttcccgcccgtaggacgtcccgagtcgtaccgttgaccggtacccggcccggacccgacggtaaccggtcgggtaccttaagtcgtacgtggggaccggtaacggggacggggggtaacccgggggggtaacccggtaacttaccccggttggtaccgttcccgtttaccgtacggtaccggtccgggtccggggtaacccaaccgggttccgtccgtaccctaccgttccnccgttcgacctccccaaccggtaccgaccggtccctacggtccctcccgttccgccgtcccnccgtccgactacccggntcccgcccgtacccg

SEQ ID NO: 10842 - DNA, 559 bp, Homo sapiens
  misc_feature: GYAE6OF02IN0J4.40.16.B05.1.454.CMB.1.raw
  modified_base (349)..(349): a, c, t, g, unknown or other
  misc_feature (349)..(349): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgccccgccgggcagggactgggagtggattgggcgcgtctatcacagtgaaaccagctacactcccctcctcgagagtcgagtcaccatttcactagacacgtccacaaatcagttntccctgaggctgagctctgtcgaccgcgcggacacgggctatatactgtgcgagggaggggggccggggaaactcgtagtcggcttccttgactacgtcggggccagggaccctggtccaccgtctcctcacgcctccaccgaacgggcccagttcccggtccttcccccgtgggcccgcccgttcggcctaccgaggtacgcctacccg

SEQ ID NO: 10843 - DNA, 622 bp, Homo sapiens
  misc_feature: GYAE6OF02IJCVZ.40.16.B05.1.454.CMB.1.raw
  modified_base (285)..(285): a, c, t, g, unknown or other
  misc_feature (285)..(285): n is a, c, g, or t
  modified_base (400)..(400): a, c, t, g, unknown or other
  misc_feature (400)..(400): n is a, c, g, or t
  modified_base (610)..(610): a, c, t, g, unknown or other
  misc_feature (610)..(610): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccngctacatcccctcctcgagagtcgagtccaccatttcactagacacgtccaacaaatcagttgtccctgaggctgagctctgcgacccgccggcggacacggggctaatattacngtgcggaggacgggggggaccggggaaactccgtagtcgggccttccgtttagaccttacgtgggggcccaacgggggtaacccctgggtccctacccggtccttcccgtacgaacgtccctacccgacccgaacggggtcccctaaggttcccgggttcccttccccccgtgggcccgtcccccgttggccccttacccggagggtacncccgaaccccgg

SEQ ID NO: 10844 - DNA, 569 bp, Homo sapiens
  misc_feature: GYAE6OF02GPRKS.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatcccctcctcgagagtcgagtcaccatttcactagacacgtccacaaatcagttgtccctgaggctgagctctgtgacccgccgcggacacgggctatattactgtgcgagggagggggggcccgggggaaactccgtagtcgggtcttccgtttagaccttacgtggggcccaaggggaaccctgggtccaccgttcctcctcgacgccctaccgaccgaacgggcccaagtccggtccttcccccgtggccgccctgcctccgaggcgcctacccg

SEQ ID NO: 10845 - DNA, 559 bp, Homo sapiens
  misc_feature: GYAE6OF02H8GH1.40.16.B05.1.454.CMB.1.raw
  modified_base (291)..(291): a, c, t, g, unknown or other
  misc_feature (291)..(291): n is a, c, g, or t
  modified_base (529)..(529): a, c, t, g, unknown or other
  misc_feature (529)..(529): n is a, c, g, or t
  modified_base (535)..(535): a, c, t, g, unknown or other
  misc_feature (535)..(535): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcgccccgccggggcaggggactgggagtggattggggcgcgtctatcacagtgaaaccngctacactccccctcctcgagagtcgagtccacctatttcactagacacgtccaacaaatcagttcgtccctgaggctgacgctctgtcgaccgcgcggacacgggctatattctggtgcggagggacgggggggccggggaaactcgtagtcggcttcgttgactacgtggggccagggaccctggtccaccgtctcctcacgcctcaccgacggccctagtccggtccttccccgnggcccncccgtgcctccgaggccgccaccg

SEQ ID NO: 10846 - DNA, 569 bp, Homo sapiens
  misc_feature: GYAE6OF02IERNY.40.16.B05.1.454.CMB.1.raw
  modified_base (287)..(287): a, c, t, g, unknown or other
  misc_feature (287)..(287): n is a, c, g, or t
  modified_base (492)..(492): a, c, t, g, unknown or other
  misc_feature (492)..(492): n is a, c, g, or t
  modified_base (518)..(518): a, c, t, g, unknown or other
  misc_feature (518)..(518): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgccccgccgggcagggactggagtggagttgggcgcgtctatcacagtgaaaccngctacatccccctcctcgagagtcgagtcacctatttcactagacacgtccaacaaatcagttcgtccctgagctgagctctgtcgacccgccgcggacacgggcgtaatattactgtgcggagggacgggggggccggggaaactccgtagtcggcttccgtttgactacgtggggccagggaccctgggtccaccgtcctccncgacgccctaccaccgaacgggcccngtccggtccctccccgtggcccgtcccgtgcccgtccgaggccgctacccg

SEQ ID NO: 10847 - DNA, 657 bp, Homo sapiens
  misc_feature: GYAE6OF02I9HNG.40.16.B05.1.454.CMB.1.raw
  modified_base (284)..(284): a, c, t, g, unknown or other
  misc_feature (284)..(284): n is a, c, g, or t
  modified_base (424)..(424): a, c, t, g, unknown or other
  misc_feature (424)..(424): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggctggagtggattgggcgcgtctatcacagtgaaaccngctacactccccctcctcgagagtcgagtcaccatttcactagaccacgtccaacaaatcagttcgtcccctaggacggtctaggagtcttcgtggtcgacccggccggaccggacgacggggccgttatacgtttacgngtggcggaagggacggggggggacccgggggaaactcgttaagtcgggtccttccgtttgacctacggtcgggggacccaacggggtacccctgggtccctaccggttcctcccgtacgaccgcccttccgaacccgtaaccggggcccctaaggttccccggttcccgttccccccgtgggccccgtccccgtcggtccccgttcccgaagggtacccgtccctaaccccgg

SEQ ID NO: 10848 - DNA, 596 bp, Homo sapiens
  misc_feature: GYAE6OF02GGGVY.40.16.B05.1.454.CMB.1.raw
  modified_base (286)..(286): a, c, t, g, unknown or other
  misc_feature (286)..(286): n is a, c, g, or t
  modified_base (386)..(386): a, c, t, g, unknown or other
  misc_feature (386)..(386): n is a, c, g, or t
  modified_base (400)..(400): a, c, t, g, unknown or other
  misc_feature (400)..(400): n is a, c, g, or t
  modified_base (551)..(551): a, c, t, g, unknown or other
  misc_feature (551)..(551): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattggggcgcgtctatcacagtgaaaccngctacactccccctcctcgagagtcgagtccacctatttcactagaccacgtccaacaaatcagttgccctgagctgagctctgtcgaccgccgcggacncgggctatattacngtgcggagggacgggggggccggggaaactccgtagtcggccttccgttgacctacggtggggacccaggggtaccctgggtccaccgttcctcctcgacgtcccctacccgaccgacgggcccctaaggttcccggtcccttccccccgngggcccctccccgtggcccttcccggagggtccgcctaaccccgg

SEQ ID NO: 10849 - DNA, 699 bp, Homo sapiens
  misc_feature: GYAE6OF02HVBUI.40.16.B05.1.454.CMB.1.raw
  modified_base (290)..(290): a, c, t, g, unknown or other
  misc_feature (290)..(290): n is a, c, g, or t
  modified_base (311)..(311): a, c, t, g, unknown or other
  misc_feature (311)..(311): n is a, c, g, or t
  modified_base (356)..(356): a, c, t, g, unknown or other
  misc_feature (356)..(356): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcggcccgcgggcagggactgggagtggagttgggcgcgtctatcacgagtagaaaccngctacactcccctcctcgagngtcgagtcactatttcactagacacgtccaactaaatctagttcnccctgacggctagacgtctcgtgtcggacccgtccggcggaccgacggggtcttaatacgttacgtggtgacgggaggggtacggggggggacccgggggaaaacttccggttaaggtcgggtcctttccgtttaggaaccgttacgggtcgggggtacccctaacgggggtaaccccttggggtaaccctacccggttctacccgtacgaaccgtccccttaacccgacccgtaaccggggccccctaaggttccccgggttacccctttcccccccggagggtcccccgtacccccgttacggcccgttaccccggaacggggcctacccgtaacccccgg

SEQ ID NO: 10850 - DNA, 569 bp, Homo sapiens
  misc_feature: GYAE6OF02FN4VN.40.16.B05.1.454.CMB.1.raw
  modified_base (286)..(286): a, c, t, g, unknown or other
  misc_feature (286)..(286): n is a, c, g, or t
  modified_base (538)..(538): a, c, t, g, unknown or other
  misc_feature (538)..(538): n is a, c, g, or t
  modified_base (544)..(544): a, c, t, g, unknown or other
  misc_feature (544)..(544): n is a, c, g, or t
  modified_base (563)..(563): a, c, t, g, unknown or other
  misc_feature (563)..(563): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgccccgccgggcagggactggagtggattgggcgcgtctatcacagtgaaaccngctacactcccctcctcgagacgtcgagtcacctatttcactagacacgtccacaaatcagttcgtccctgaggctgacgctctgtcgaccgccgcggacacgggctatattactgtgcgagggacgggggggaccggggaaactccgtagtcggcttccgtttgacctacggtcggggacctacggggaccctggtccaccgttctccctcgacgcctaccgaccgacggccctagtccgtccttccccgnggcccncccgtcgcctccgaggacnccaccg

SEQ ID NO: 10851 - DNA, 776 bp, Homo sapiens
  misc_feature: GYAE6OF02JGML8.40.16.B05.1.454.CMB.1.raw
  modified_base (308)..(308): a, c, t, g, unknown or other
  misc_feature (308)..(308): n is a, c, g, or t
  modified_base (348)..(348): a, c, t, g, unknown or other
  misc_feature (348)..(348): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
tcagtctagcgactcacgaccggtgctcgatttagagctcacgtagggggcgacaaggaacatgaaaccacctggtcggttcttcctcctcctggtggcagctcccagatgggtcctgtcccaggtgcagcttcaggagttcggggcccagggactggtggtaacgtcctttcgggagtacccttaaacccgtcaccctgcactgtctctggtgacgtccgatcaggccgctacgtactggagcgtggatccggctgcccgcgggcagggactggacgtggattgggctcgtctatcacagtgaaccngctacgactcccctcctcgacgaggtcggacgtcaacctntttcactagaccacgtaccaanaactcacgttntaccctagacggtcttacggagcctactcgtcggacccggcggcggaaccgacgggtcctaattacgtttaccgtggtacggacggacggggaacggggggggacccgggggaaaaccttccgttacgtacgggttccttaccgttttacggaaccgtttaccgggtcgggggacccctaacgggggtaacccccgttggggttacccacccggtttccgttacccgtaccgtacccggtcccgttaacccgaccccgggttaaacggggcccccgtaagggttccccggggtttacccgtttaccccccccggtggggtaaccccggttcccccggttacgggtacccgtttaccccggggaacgggggtacccgggtccccgtaacccccggg

SEQ ID NO: 10852 - DNA, 650 bp, Homo sapiens
  misc_feature: GYAE6OF02I3O4D.40.16.B05.1.454.CMB.1.raw
  modified_base (194)..(194): a, c, t, g, unknown or other
  misc_feature (194)..(194): n is a, c, g, or t
  modified_base (289)..(289): a, c, t, g, unknown or other
  misc_feature (289)..(289): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaacctcacctgcactgtctctggtnactccatcagccgctactactggagctggactccggctcgcccgcgggcagggactgggagtggagttgggcgcgtctatcacagtacgaaaccngctacactccccctcctcgagacgtcgacgtcacctatttcactagacacgtccaacaaatcagttcgtcctgacggtctagacgtctcgtgtcgacccgccgacggacgacgggtcttaatacgttacgtggtacgacggaggggacggggggggtacccggggtaaacttccgtagtccggtcctttccgttagaccgtacgggtcggggacccgaacggggtaacccctggtacccgtaccgttccttaccgtaccgtacgccctaccgaccggaaccgggtcccctaacggttcccggttcccttcccccggaggtcccgtcccgtacgcccgtccgaacggtcgcccgtaacccgg

SEQ ID NO: 10853 - DNA, 730 bp, Homo sapiens
  misc_feature: GYAE6OF02IB6WX.40.16.B05.1.454.CMB.1.raw
  modified_base (305)..(305): a, c, t, g, unknown or other
  misc_feature (305)..(305): n is a, c, g, or t
  modified_base (478)..(478): a, c, t, g, unknown or other
  misc_feature (478)..(478): n is a, c, g, or t
  modified_base (681)..(681): a, c, t, g, unknown or other
  misc_feature (681)..(681): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactgggagctggactccggctcggccccggccgggcgaggggactgggacgtgggagttcgggggcgtcgttctatcacgagtacgaaaccngctaaccactcccccctcctacggagtacgtcgacgtccaaccgtatttccaactagacctacgtccaactaaatccgtagttccgtacccgtggacggtctaggacgtccttcgtcggtaccgacccggccgggaccgggaaccgaccggggtcgttaacttacgtttacgngggtacggaccggggtaagggggaccgggggggggtacccggggtaaacttcccggttaaggttcgggtacctttaccgtttaggaccgttacgggtcgggggaccctaacggggtaccccgtgggtacccaccggtttcctccgtacgaccgtcccctaccgaccgtaccgggccctaacggttcccggtcccttcccccgngggtccccgtccgtacggtccctaccgggacggtaccgcccgtacccgg

SEQ ID NO: 10854 - DNA, 625 bp, Homo sapiens
  misc_feature: GYAE6OF02IETKH.40.16.B05.1.454.CMB.1.raw
  modified_base (220)..(220): a, c, t, g, unknown or other
  misc_feature (220)..(220): n is a, c, g, or t
  modified_base (292)..(292): a, c, t, g, unknown or other
  misc_feature (292)..(292): n is a, c, g, or t
  modified_base (312)..(312): a, c, t, g, unknown or other
  misc_feature (312)..(312): n is a, c, g, or t
  modified_base (354)..(354): a, c, t, g, unknown or other
  misc_feature (354)..(354): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactgganctggactccggctcggcccgcgggcagggactgggagtggattggggcgcgtctagtcacgagtagaaaccngctacactcccctctcgagngtcgagtcactatttcaactagacacgtcaacaatcagttcncctagacgctagacgctcgtgcgacccgcgcggacgacgggtctaatacgttactggtgaccggaggggacgggggggtaccggggtaaactccgtagtcggtcttccgttagaccgtacggtcggggaccgacgggtacccgtggtccgacccgttcgtccgtacgaccgtcctaccgaccgaaccgggtccctaacggttcccggttcccgttacccccgtgggaccccgtcccgtcgccgttacccggacgggacctaccgtacccgg

SEQ ID NO: 10855 - DNA, 582 bp, Homo sapiens
  misc_feature: GYAE6OF02FTMDC.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgccgggcagggactggagtggattgggcgcgtctatcacagtgaaaccagctacatcccctccctcgagacgtcgagtcaccatttcactagacacgtccacaaatcagttgtccctgaggctgagctctgtgacccgccgcggacgacgggcgtatacttacgtgtgcggagggacgggggggccggggaaactcgtagtcggcttccgttgactcgtggggccagggtacccgtggtccaccgttctcctcgacgccctccacgaacggccctacgtccggttcccttccccccgtggcccgtccccgtcgtcccgttacccgagggtaccgcccgtaaccccg

SEQ ID NO: 10856 - DNA, 564 bp, Homo sapiens
  misc_feature: GYAE6OF02HB65E.40.16.B05.1.454.CMB.1.raw
  modified_base (287)..(287): a, c, t, g, unknown or other
  misc_feature (287)..(287): n is a, c, g, or t
  modified_base (539)..(539): a, c, t, g, unknown or other
  misc_feature (539)..(539): n is a, c, g, or t
  modified_base (543)..(543): a, c, t, g, unknown or other
  misc_feature (543)..(543): n is a, c, g, or t
  modified_base (558)..(558): a, c, t, g, unknown or other
  misc_feature (558)..(558): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggcccaggactggtgaagccttcggagaccctaaccctcacctgcactgtctctggtgactccatcagccgctactactggagctggatccggctgcccgccgggcagggactgggagtggattgggcgcgtctatcacagtgaaaccngctacactcccctcctcgagagtcgagtcacctatttcactagacacgtccaacaaatcagttcgtccctggacggtctagacgtctctggtcgaccgccgcggacacgggcttatattactggtgcggagggacgggggggaccgggaaactcgtagtcggcttcgttgactcgcggggaccacgggtaccctggtccaccgttctccgtcgacgtccctaccgacgacggcccagtccggtcctccccgngccnccctgcctcgaggcnctaccg

SEQ ID NO: 10857 - DNA, 616 bp, Homo sapiens
  misc_feature: GYAE6OF02HS9HL.40.16.B05.1.454.CMB.1.raw
  modified_base (290)..(290): a, c, t, g, unknown or other
  misc_feature (290)..(290): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggactccggctcggccccgcgggcagggactgggagtggagttgggcgcgtctatcacagtgaaaccngctacactccccctcctgagagtcgagtccacctatttccactagaccacgtccaacaaatcagttcgtccctaggacggtctgacgtctcgtgtcgacccgccggcggacacggggcttaatacgttacgtggtcggcggaggggacggggggggacccggggtaaactcgtagtcggtcctttcgttagacgtacgcggggaccaacggggtaccctggtaccaccgttctacccgtgaccgtccctaccgaccgaacgggcccctaggttcccgtcccttccccgnggtcccncccgtgtccctccggaggtcgcctacccgg

SEQ ID NO: 10858 - DNA, 605 bp, Homo sapiens
  misc_feature: GYAE6OF02F6B55.40.16.B05.1.454.CMB.1.raw
  modified_base (284)..(284): a, c, t, g, unknown or other
  misc_feature (284)..(284): n is a, c, g, or t
  modified_base (464)..(464): a, c, t, g, unknown or other
  misc_feature (464)..(464): n is a, c, g, or t
  modified_base (595)..(595): a, c, t, g, unknown or other
  misc_feature (595)..(595): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgcgggcagggactggagtggattgggcgcgtctatcacagtgaaaccngctacactcccctcctcgagagtcgagtcacctatttcactagacacgtccaacaaatcagttcgtccctgagctgagctctgtcgacccgcgcggacgacgggctatacttacgtggtagcggaggggacggggggggaccggggaaactccgtagtcggcttccgttgacgttacggnggggaccaaggggtaccctgggtacccaccggttcctcccgtcacgcccctaccgacccgaacgggcccctaaggttcccggttcccttcccccgtgggccccgtcccttggcccttccggacgggtaccnccctacccgg

SEQ ID NO: 10859 - DNA, 639 bp, Homo sapiens
  misc_feature: GYAE6OF02G3T8E.40.16.B05.1.454.CMB.1.raw
  modified_base (197)..(197): a, c, t, g, unknown or other
  misc_feature (197)..(197): n is a, c, g, or t
  modified_base (222)..(222): a, c, t, g, unknown or other
  misc_feature (222)..(222): n is a, c, g, or t
  modified_base (275)..(275): a, c, t, g, unknown or other
  misc_feature (275)..(275): n is a, c, g, or t
  modified_base (353)..(353): a, c, t, g, unknown or other
  misc_feature (353)..(353): n is a, c, g, or t
  modified_base (363)..(363): a, c, t, g, unknown or other
  misc_feature (363)..(363): n is a, c, g, or t
  modified_base (370)..(370): a, c, t, g, unknown or other
  misc_feature (370)..(370): n is a, c, g, or t
  modified_base (377)..(377): a, c, t, g, unknown or other
  misc_feature (377)..(377): n is a, c, g, or t
  modified_base (403)..(403): a, c, t, g, unknown or other
  misc_feature (403)..(403): n is a, c, g, or t
tcagtctagcgactcacgaccggtgctcgatttagagctcacgtagggggcgacaagaacatgaaacacctgtggttcttcctcctcctggtggcagctcccagatgggtcctgtcccaggtgcagcttcaggagtcgggcccaggactggtgaagccttcggagaccctaaccctcaccctgcactgtctctggtnactccatcagccgctactactgganctggattccggctgcccgcgggacaggggacctggagtggagttggcgcggtntatcacagtagaaaccagctaacactcccctacctcgagtagtcgagtccactatttcactagacacgtccaacaaanctagtgtccngagctgngctctgngaccgccgcgaacgcgggtcgtaatntacgtgtgcggaagggcggggggaaccgggggtaaactccgtaaggtcggtacgttccgtttcgaacgtaccggttacggggacccgagggttaaacccgtcgggttacgacccgttcgacccttcgacgtcccctcccgaccggaacccggtccccgtaacggtcccggttcccgttcccccggttaggccccgttcccgcctccggtacccggacgacggtcccgtaaccccgg

SEQ ID NO: 10860 - DNA, 658 bp, Homo sapiens
  misc_feature: GYAE6OF02FQZQ7.40.16.B05.1.454.CMB.1.raw
  modified_base (284)..(284): a, c, t, g, unknown or other
  misc_feature (284)..(284): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctgcccgcgggcagggactggagtggattgggcgcgtctatcacagtgaaaccngctacactcccctcctcgagagtcgagtcacctattcactagacaccgtcacaaactcagttcgtccctgacggctgacgctcgtgtcgaccgccgcggacgacgggctatacttacgtggtgacggagggacggggggggacccgggggtaaactccgtagtcgggtcctttccgtttaggaccgttacggtcggggggacccaaacggggggtaaccccttcggggtacccgtacccggttctaccccgtcgacgtccccttacccgacccgaacggggtcccctaacggttcccgggttaccccttccccccggtggtccccgtccccgttccggtcccgttacccggacgggtaccgcccgtaaccccgg

SEQ ID NO: 10861 - DNA, 736 bp, Homo sapiens
  misc_feature: GYAE6OF02H5UBD.40.16.B05.1.454.CMB.1.raw
  modified_base (196)..(196): a, c, t, g, unknown or other
  misc_feature (196)..(196): n is a, c, g, or t
  modified_base (303)..(303): a, c, t, g, unknown or other
  misc_feature (303)..(303): n is a, c, g, or t
  modified_base (363)..(363): a, c, t, g, unknown or other
  misc_feature (363)..(363): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactgggtgaagccttcggagaccctaaccctcacctgcactgtctctggtnactccatccagccgctactactggagctggatccggctcggccccggccgggcacgggacttgggagtgggagttggggccgtcgtactagtcacagtacgaaaccngactacacctccccctccgtcgagagtcgagtcacctactttcactagacacgtaccaanaaatcagttcgtcctagagctggactcttcgtcgtcggacccgtccggacggtaacgaccggggtacttagttaagttaacgtcggtacggacggtaacgggggaacggggggggaaccccgggggtaaaacttcccggttaaggttccgggtccctttacccggtttacggaaccgttttaaccgggcgggggtaaccccgtaaccgggggtaaccccttggggtaccctacccggtccgtttacccgtccgaccgtcccgttaacccaacccgggtaaccgggtcccctaaggttcccgggtttaccccttcccccggtcggcccgtccccgtaggtcccttaacccggaacggtacccgccctaacccgg

SEQ ID NO: 10862 - DNA, 786 bp, Homo sapiens
  misc_feature: GYAE6OF02JOM6E.40.16.B05.1.454.CMB.1.raw
  modified_base (274)..(274): a, c, t, g, unknown or other
  misc_feature (274)..(274): n is a, c, g, or t
  modified_base (289)..(289): a, c, t, g, unknown or other
  misc_feature (289)..(289): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggactccggctcggccccgccgggacaggggactgggagtgggattggggcncgtctatcacaggtnaaaccagctaacactcccctcctcgagacgcgacgtccaacctatttccaactacgacctacgtaccaactaaactcaagtttccgccctaggacggtctacggacgtccgttcgtacggtacggaaccccggtccggaccgggtaaccgaccgggggtacttaaagtttacgtttaaccgtgggttaccgggagggaacgggggaacggggggggggtaccccggggaaaactttcccggtaaagtcgggtccttacccgttttagggaaccttaaccgggtcggggacccggttaacggggtaaccccttggggttacccgtaacccgggttctaccccgttaggacccggtaccccttaaccgggaacccgttaaaccgggtcccccgtaacgggttcccggtttacccccgtttcccccccggaaggggttcccctacccccgtttcgggtaccccgttacccgggaacgggttaccctcccccgtaacccgg

SEQ ID NO: 10863 - DNA, 726 bp, Homo sapiens
  misc_feature: GYAE6OF02IPQGG.40.16.B05.1.454.CMB.1.raw
  modified_base (717)..(717): a, c, t, g, unknown or other
  misc_feature (717)..(717): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaacctcacctgcactgtctctggtgactcatcagccgctactactggagctggactccggctcgccccggcgggcagggactgggagtggagttcggggcgtcgtctagtcacgaggtacgaaaccgtagacctacaccttccccctcccgtacggaacgtacggtccggtacgtacctaaccttagttttaccaacgtacggaaccaccggttaccaaacgtaaacttcgtaacgtttcgtaccccgtaggtacggtactggaacgtccgtacgttcggtacggaaccccggcggaccggaccggtaccggggtacgtttaattacgtttacgtgggttacggacggagggggaaccgggggggggaccgggtaaacttccggtagtcggacctttcgttagacctcgggtcgggaccgtaacgggtaccctggtacccgaccgtttccaccggtcaccgtaccctaccgaacggaccggcctccgttacccggttccccttaccccggtggccccgttcccgtcgcccgtccggaagggtacccnccgtacccg

SEQ ID NO: 10864 - DNA, 609 bp, Homo sapiens
  misc_feature: GYAE6OF02IHZF9.40.16.B05.1.454.CMB.1.raw
  modified_base (221)..(221): a, c, t, g, unknown or other
  misc_feature (221)..(221): n is a, c, g, or t
  modified_base (286)..(286): a, c, t, g, unknown or other
  misc_feature (286)..(286): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggcccaggactggtgaagccttcggagaccctaaccctcacctgcactgtctctggtgactccatcagccgctactactgganctggactccggctgcccgcgggcagggactggagtggattgggcgcgtctatcacagtgaaaccngctacactcccctcctcgagagtcgagtcacatttcactagacacgtcaacaaatcagttctcctgacgctgacgtctctgtcgaccgcgcgacacgggtactatattactgtgcggagggacggggggaccggggaactcgtagtcggtcttcgttgacgtacgtcgggaccgaagggaaccctgggtaccaccgttcctcccgtcgacgtacccttaccgacccgtaaacgggcccctaaggttcccggttcccttcccccggtgggaccccgttccccgtaggtccccgtacccggaacggacccgtaccgtaaccccgg

SEQ ID NO: 10865 - DNA, 919 bp, Homo sapiens
  misc_feature: GYAE6OF02JW984.40.16.B05.1.454.CMB.1.raw
  modified_base (438)..(438): a, c, t, g, unknown or other
  misc_feature (438)..(438): n is a, c, g, or t
tcagtctagcgactcacgaccggtgctcgatttagagctcacgtagggggcgacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtgacctccatcagccgctactactggagctggactccggctcggccccggccgggacaggggactgggaggtggagttgggggccgcggtactatccgacgaggtacgaaaacccgagcctaaccgtacctcccccccgttaccgccggaaggtaacggtccggaacgttccaacctaacgttttccaacgttaacggaacctacccggtaccaaaacctaagttccaagtttccgtacccgnggtaacgggccttaggctccgttcgttcgggtacgaccccggtaccgggacgggaacccggacggggtaccgttaacgttaacgttttaccgtagggttaccgggtacgggtaacgggggggaaccgggggggggtaacccgggggggtaaaacccttcccggggttacggttaccggggttaccgtttaccccggtttttagggaacccggtttaaccgggtaccggggggaaccccgggttaaaccgggggtaaaccccccggttttcggggttaaccccggtacccgggtttcccgttacccccggttacggtaccccggttaccccgttaacccccgaaccgggtaacccgggttacccccgtaaccggtttccccggggtttaaccccctttccccccgggttcgggtacccccgtccccgttccggggaccccttaccccggggaccggggtacccgtaccccgttaaccccggg

SEQ ID NO: 10866 - DNA, 744 bp, Homo sapiens
  misc_feature: GYAE6OF02GRCR1.40.16.B05.1.454.CMB.1.raw
  modified_base (295)..(295): a, c, t, g, unknown or other
  misc_feature (295)..(295): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactacgtggagtctggactccggctcggcccggccgggcagggactggagtggagttgggcgcgtctatcacgagtacgaaaccngctacactcccctccgtcgagacgtcgacgtccactatttccactagaacctaccgtaccaaactaaaactctacggtttccgtaccctagggacggggtctaggacgtcttcgtcggtacgaccccggtccgggaccggtaaccggaccggggtaccgttaattacgtttacgtggtcgggacgggtaggggggaaccgggggggggacccggggtaaacttcccggttaaggtcgggtacctttaccgtttacgaccgttacgggtcgggggacccggtaaccggggtaaccccgttgggtaacccgtacccgttcccgtacccgtccgaacgtcccctacccgacccgggaaccgggcccgtaccgttacccgggtttccccttacccccggtcgggtcccctccccgtcggacccgtaccggacggtacccgcccgtaaccccgg

SEQ ID NO: 10867 - DNA, 657 bp, Homo sapiens
  misc_feature: GYAE6OF02IWD2U.40.16.B05.1.454.CMB.1.raw
  modified_base (289)..(289): a, c, t, g, unknown or other
  misc_feature (289)..(289): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcgcccgccgggcaggggactggagtggattggggcgcgtctatcacagtagaaaccngctacactcccctcctcgagacgtcgagtccacctatttcactagacacgtccaacaaatcagttcgtccctggaggtcctagagtacgtctcggtcgacccggtccggacggaccgacgggtacgttaataacgttaacgtggttggacggtagggggacggggggggaccgggggtaaactccggtagtcggtcttccgtttgacgtacgtcggggtccgtacggggtaccctcgggtccgtaccggttcctcccgtcgacgtccctaccgaccgtacgggcccgtaacggttcccggttacccttcccccggtccggtacccgtccccgttcggtccctacccggacggtaccgaccctacccgg

SEQ ID NO: 10868 - DNA, 695 bp, Homo sapiens
  misc_feature: GYAE6OF02IRU3X.40.16.B05.1.454.CMB.1.raw
  modified_base (345)..(345): a, c, t, g, unknown or other
  misc_feature (345)..(345): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcgccccgccgggcagggactggagtggattgggcgcgtctatcacagtcgaaaccagctacactcccctcctcgagacgtcgagtcacctatttccactagactacgtccaanaatcagttcgtcctggacgctggactctcgtgtacgacccgccggacggaccacggggcttaatacttacgtggtgacgggtaggggacgggggggacccgggggaaacttccggtaagtcgggtccttccgtttacgtaaccgttaccgggtcggggacccgtaacggggtaaccccgtttgggtacccgtacccggtttccgtacccgtaccgacgtccccttacccgacccgtaacgggtcccccgttaaggttccccggtttaccctttccccccggtacgggacccccgttccccggttaccggcccccgttaccggaaccggggtccgtaccccgtaaccccgg

SEQ ID NO: 10869 - DNA, 705 bp, Homo sapiens
  misc_feature: GYAE6OF02H4UK3.40.16.B05.1.454.CMB.1.raw
  modified_base (196)..(196): a, c, t, g, unknown or other
  misc_feature (196)..(196): n is a, c, g, or t
  modified_base (208)..(208): a, c, t, g, unknown or other
  misc_feature (208)..(208): n is a, c, g, or t
  modified_base (220)..(220): a, c, t, g, unknown or other
  misc_feature (220)..(220): n is a, c, g, or t
  modified_base (291)..(291): a, c, t, g, unknown or other
  misc_feature (291)..(291): n is a, c, g, or t
  modified_base (345)..(345): a, c, t, g, unknown or other
  misc_feature (345)..(345): n is a, c, g, or t
  modified_base (361)..(361): a, c, t, g, unknown or other
  misc_feature (361)..(361): n is a, c, g, or t
  modified_base (398)..(398): a, c, t, g, unknown or other
  misc_feature (398)..(398): n is a, c, g, or t
  modified_base (691)..(691): a, c, t, g, unknown or other
  misc_feature (691)..(691): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgccactgtctctggtnactcatcagccnctactactgganctggactccggctcggcccggcgggcagggctggagtggagttgggcgcgtctatcaacgagtagaaaccngctaacactcccccctctacggagtacgtcgagtccaacctatttccacgttanaccacgttacccaaanaaacttcgagttcgtccctggacggtctggatccttntcggtacggacccgcggaccggaacgacggggtaccttagttaacttcgtggtcggacggaggggacgggggggtacccgggggaaacttccggtaggttcgacctttccgttagaccgtacgggtcggggaccgtaacggggaaccccgttggtacccgtaccgttcttaccccgtcgaaccgtccctaacccgacccggacgggccccgttaacggttccccgggttaccccttccccccggtgggaccccccgttcccgttccgtaccccgttacccggacgggttaccnccccgtaacccggg

SEQ ID NO: 10870 - DNA, 711 bp, Homo sapiens
  misc_feature: GYAE6OF02INWW1.40.16.B05.1.454.CMB.1.raw
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggagaccctaaccctcacctgcactgtctctggtgactcatcagccgctactactggagctggactccggctcggcccgccggggcaggggactgggagtggagttggggcgcgtctatcacagtacgaaaccagctacacttcccctcctcgacgagtcgagtcactattcactagacacgtacaacaatctagttcgcctgacggtctagacgtctacgtgtacggacccggtccggccgggacgtacggggtctttaactaattccgtggtcgacgggaacggggacgggggggggtacccggggaaactccggtaagtcgggtacccttcgtttacgaccgttacggtcggggaccgaacggggtacccgtcggtaccgacccggtttcctacccgttacgaccgggtaccccttaaccgaacccggtaaccggggaccccttaggttcccccgggtttccccgttaccccccgggtggacccccgggtcccctttacgggaccccgttaaccccggacgggaccccgtacccgtacccggtaccgg

SEQ ID NO: 10871 - DNA, 656 bp, Homo sapiens
  misc_feature: GYAE6OF02JCAMP.40.16.B05.1.454.CMB.1.raw
  modified_base (222)..(222): a, c, t, g, unknown or other
  misc_feature (222)..(222): n is a, c, g, or t
  modified_base (267)..(267): a, c, t, g, unknown or other
  misc_feature (267)..(267): n is a, c, g, or t
  modified_base (274)..(274): a, c, t, g, unknown or other
  misc_feature (274)..(274): n is a, c, g, or t
  modified_base (287)..(287): a, c, t, g, unknown or other
  misc_feature (287)..(287): n is a, c, g, or t
  modified_base (303)..(303): a, c, t, g, unknown or other
  misc_feature (303)..(303): n is a, c, g, or t
  modified_base (321)..(321): a, c, t, g, unknown or other
  misc_feature (321)..(321): n is a, c, g, or t
  modified_base (349)..(349): a, c, t, g, unknown or other
  misc_feature (349)..(349): n is a, c, g, or t
  modified_base (366)..(366): a, c, t, g, unknown or other
  misc_feature (366)..(366): n is a, c, g, or t
  modified_base (409)..(409): a, c, t, g, unknown or other
  misc_feature (409)..(409): n is a, c, g, or t
  modified_base (645)..(645): a, c, t, g, unknown or other
  misc_feature (645)..(645): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggatcggggcccaggactggtgaagtccttcggagaccctaaccctcacctgcactgtctctggtgacctccatcagccgctactactgganctggactccggctcgcccgcgggcagggctggagtggattgggcncgtctancacagtgaaaccngctacactcccctccncgagacgtcgagtcaccntttcactgacacgtccacaatcagttcncctgacgctgagcctangtacgacccgcgaccggacgtacgggtcgtaattacgttacgnggtacgccggtaggggaacgggggggtacccggggaaacttcccgggttagttaccggggtctttacccgtttgggaacccgtttacggtcgggggtaccctaaggggtaacccctgggtacccgtacccggttccttccgtacgacgtccgtaacccgacgtaaccgggtcctacggttcccggttccttcccccggtggaccccggtccttcgggcccttaccggacggtaccnccgtaccccgg

SEQ ID NO: 10872 - DNA, 670 bp, Homo sapiens
  misc_feature: GYAE6OF02G8YT3.40.16.B05.1.454.CMB.1.raw
  modified_base (203)..(203): a, c, t, g, unknown or other
  misc_feature (203)..(203): n is a, c, g, or t
  modified_base (318)..(318): a, c, t, g, unknown or other
  misc_feature (318)..(318): n is a, c, g, or t
  modified_base (474)..(474): a, c, t, g, unknown or other
  misc_feature (474)..(474): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtccgggcccagggactgggtgaagtccttcgggacgacccctaaccctcacctgcactgtctctggtanactccatcacgccgtctaactacgtgggagcctggactccggctcggccccgcggggcaggggactgggagtggtacgttggggccgtacgtctagtccaacgagtacgaaaccngcctaacgaccctccccctaccgtgaacgtacgtccgacgtccacctatttaccgacttagaccaccgtaccaacaaatcgtaacgttcgtcccgagtaggctagacgtcctgtcgtacgcccgcggacgaccggacgggtactattacgttacgnggtacggacggggacgggggaccggggggaaccgtacttcgtagtcgttcccttcgtagaccgtcgggcgggacccggtacggtaccgtcgtcccgtacgtccgtctaccgaccgtcccgaccgacggacccgtcctcggttcccgtcccgtcccgcgtcccgccgtcgacccgtacggacggcctacccgtacgg

SEQ ID NO: 10873 - DNA, 666 bp, Homo sapiens
  misc_feature: GYAE6OF02F55JB.40.16.B05.1.454.CMB.1.raw
  modified_base (290)..(290): a, c, t, g, unknown or other
  misc_feature (290)..(290): n is a, c, g, or t
  modified_base (617)..(617): a, c, t, g, unknown or other
  misc_feature (617)..(617): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggactccggctcgcccggccgggcagggactggagtggagttgggcgcgtctatcacagtagaaaccngctacacctcccctccctacggagacgtcgagtccacctatttcactacgaccacgtaccaacaaatctagttcgtccctggacggctgacgcttcgtggtaccgacccgccggacggacgacgggtactatacgttcgtggtgcggaggggacgggggggaccgggtaaactcggttagcggtccttccgtttagaccgttacgggcggggtacccgaacggggtacccgtttgggtaccctacccggttccttcccgtaccgacgtcccctacccggaacgaacccggggtcccctaacgggttcccggttccccttccccccgngggtcccctccccgttcggccccgtaccggacggaccgcccgtaacccg

SEQ ID NO: 10874 - DNA, 715 bp, Homo sapiens
  misc_feature: GYAE6OF02I9334.40.16.B05.1.454.CMB.1.raw
tcagtctagcgactcacgaccggtgctcgatttagagctcacgtagggggcacgaagaacatgaaacacctgtggttcttcctccttcctggtggcagctcccagatgggtcctgtcccaggtgcagcttcaggagtcgggcccaggactggtgaagtcctttcggagaccctaacccttcacctgcactgtctctggtgactccatcaggccgcttactactggacgcgtggatccggctcgccccgcgggcagggactgggagtggattgggcgtcgtctatcacgagtacgaaaccagctacactcccctcctcgagagtcgagtcacctatttccactagactacgtccaactaaatcgtaagttcgtaccctaggaacggcttaggacgtcgttaccgtggttaccgaacccggtccggaccggacgaccggggtctttaaatacgtttacgtggtacgaacggaagggggtaccggggggggacccggggtaaacttccggttaaagtcggtcctttaccgtttggaaccttcgggtcggggacctaacgggggtaaccccttggggtaccctacccggttccttccgtaccgtacgtacccttaccgacggtaaccggggtcccttaacgttccccgggttccctttcccccggtgggacccttcccgttcgggacccgttccggacggtaccggtccctaaccccgg

SEQ ID NO: 10875 - DNA, 700 bp, Homo sapiens
  misc_feature: GYAE6OF02HNOZC.40.16.B05.1.454.CMB.1.raw
  modified_base (304)..(304): a, c, t, g, unknown or other
  misc_feature (304)..(304): n is a, c, g, or t
  modified_base (464)..(464): a, c, t, g, unknown or other
  misc_feature (464)..(464): n is a, c, g, or t
  modified_base (688)..(688): a, c, t, g, unknown or other
  misc_feature (688)..(688): n is a, c, g, or t
tcagtctagcgactcacgaccggtgctcgatttagagctcacgtaggggggcacaagaacatgaaacacctgtggttcttcctcctcctggtggcagctcccagatgggtcctgtcccaggtgcagcttcagggagtcgggcccaggactggtgaacgccttcggacgaccctaaccctcacctgcactgtctctggtgactccatcagccgctactacgtggagcgtggactccggctcggcccggcgggcgagggactgggagtggagttggggcgcgtctatccacgtaggtacgaaaccngtacctaaccaccttcccccctcctacggaacggtacgtcgacgtccaaccgttactttccaacttagaccaccgtacaactaaatcgtagttccgcctaggacgtctggactctcgtgtaccgaccggcgacggacgacgggtcttaactacgttacgnggtacgacgggaggggggacgggggggtaacccggggtaaactccggttaaggtccgtaccgttcgttaggactccgggtcgggacccgaacgggtacccgtggtacccgaccgttcctaccgacgtaccgtccctaccgaccggtaacccggccctaacggttcccggtccccgttacccccggcgggtaccctccccgtcggtacccgaccggtacggaccncccgtaacccgg

SEQ ID NO: 10876 - DNA, 570 bp, Homo sapiens
  misc_feature: GYAE6OF02HTT2H.40.16.B05.1.454.CMB.1.raw
  modified_base (286)..(286): a, c, t, g, unknown or other
  misc_feature (286)..(286): n is a, c, g, or t
  modified_base (348)..(348): a, c, t, g, unknown or other
  misc_feature (348)..(348): n is a, c, g, or t
  modified_base (399)..(399): a, c, t, g, unknown or other
  misc_feature (399)..(399): n is a, c, g, or t
  modified_base (485)..(485): a, c, t, g, unknown or other
  misc_feature (485)..(485): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactcatcagccgctactactggagctggatccggctgcccgcgggcagggactgggagtggattggggcgcgtctatcacagtgaaaaccngctacatccccctcctcgagagtcgagtcaccatttcactagacacgtccacaaatcagttnccctgaggctgacgctcgtgtcgaccgcgcggacacgggcgtatagttacngtgacgaggcggggggaccggggaaactccgtaagtcggcttccgttgactacgtggggccagggaccctggtcaccgttctcctnacgtcctaccaccgaagggccctaagtcccggtccttcccccgtggcccgtcccgttcgccttcccggaggaccgcctaaccccg

SEQ ID NO: 10877 - DNA, 674 bp, Homo sapiens
  misc_feature: GYAE6OF02HB5RL.40.16.B05.1.454.CMB.1.raw
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (313)..(313): a, c, t, g, unknown or other
  misc_feature (313)..(313): n is a, c, g, or t
  modified_base (366)..(366): a, c, t, g, unknown or other
  misc_feature (366)..(366): n is a, c, g, or t
  modified_base (421)..(421): a, c, t, g, unknown or other
  misc_feature (421)..(421): n is a, c, g, or t
  modified_base (502)..(502): a, c, t, g, unknown or other
  misc_feature (502)..(502): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctcgtggtgactccatcacggccgctactactgggagctggactccgctcggccccgcgggcaggggactggagtggattggggcgtcgtctatcanagtcgaaacccngctacactccccctccncgaggcgtcgagtcacctatttcaactagacaccgtccaacaaatcaagttcncctgacgtctgactctagtcgacggcccgccgacgggtaccacgggtcttaagtnttacgtggtaggcgggaagggggacgggggggaacccggggtaaactccggttgtcgggtcttcgtttgacctttacgggngggaccacggggtaccccttgggacccgtacccgttcctacccgtacgccgtaccctacccgacccgggtaacgggcccccttaaggttccccgggttaccccttcccccgggcgggttaccccctccccggttgaccccggttaccgaacggtcccggacccctacccggg

SEQ ID NO: 10878 - DNA, 676 bp, Homo sapiens
  misc_feature: GYAE6OF02I1I75.40.16.B05.1.454.CMB.1.raw
  modified_base (587)..(587): a, c, t, g, unknown or other
  misc_feature (587)..(587): n is a, c, g, or t
  modified_base (653)..(653): a, c, t, g, unknown or other
  misc_feature (653)..(653): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggactccggctcggccccgcgggcagggactgggagtggattgggcgcgtctatcacagtgaaaccagctacactcccctcctcgagagtcgagtccacctatttcactagaccacgtccaactaaactctagttcgtcctgacggctgacgtctcgtgtcgacccggtccgcggacgaccggggtcttaagttacgttactggtcggcggaggggacggggggggacccggggtaaactccggttaagtcgggtccttcgttcgacgttacggcggggaccgtaacggggtaacccgttgggtaccctacccggttcctacccgtacgtaacgtccccgttaccgaccgtaaccggggtccccncggtttacccgggttccccttacccccggttcgggaccccgtcccggttcggccccgttacccggngggtaccccgtcccgaaccccgg

SEQ ID NO: 10879 - DNA, 739 bp, Homo sapiens
  misc_feature: GYAE6OF02IUQIU.40.16.B05.1.454.CMB.1.raw
  modified_base (235)..(235): a, c, t, g, unknown or other
  misc_feature (235)..(235): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaacgccttcggacgaccctaaccctcacctgcactgtctctggtgactccatcacgccgctactactggagctggactccggntcggccccgcgggcgacgggacgtgggaggtggtagttcggggcgcgtcttagccaacgagtacgaaaccagacctacaccttccccctccgtacggaggtacgtcgaacgttaccaacccttattttcccaacgtaaccgactaacccgtacaaactaaatcgtaacgttcgtcccaggtacggtctaggacgtcctcgtcgtaccggacccggaccgggacgggaccggacgggtacgttagttaacttacggtggtaggacgggtaacgggggaacggggggtaaccggggtaactcggttaaggtcggtccttcgtttacgacgtacggttacgggaccgtaccggggtacctacggtccgaacccgttccgtacctaccgtaccgtcccaccgaccggaaccgggtaccctacggttcccggtttaccccgttccccggttggacccccgtccccgttacggtccccgtaacggtacccggtaccgtccccgtaaccgg

SEQ ID NO: 10880 - DNA, 736 bp, Homo sapiens
  misc_feature: GYAE6OF02I7QFF.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactgggtgaagccttcggacgacccctaaccctcacctgcactgtctctggtgactccatcagcccgctactactggagctggactccggctcggccccgccgggacgagggctgggacggtggagttgggccgtcgtctataccacgagtacgaaaccgagcctaacaccttccccctccctcgaggtacgtccggatccaacctactttaccaactacgacgtaccgaccaactaaactcgtagttcgtccctggaggtctgactcgtcgtcgtcgaccccggcggaccggaccggacgggtacgttaacttacgttacgtggtccggagggacgggggtaccgggggggggaacccggggaaaccgtttccggtacggttaccgggttcctttaccgggtttacgtacgttaccggggtccggggacccgtaacggggtaccccgttcgggtaccccgtaccgttcctcccgtcgtaccgcccttacccgaaccggtaccggtcccgtaaccggtcccggttcccttcccccggtcggaccccgttcccgtccggtacccgtaccgccgggaccgtccccgtaaccgg

SEQ ID NO: 10881 - DNA, 712 bp, Homo sapiens
  misc_feature: GYAE6OF02GWNDY.40.16.B05.1.454.CMB.1.raw
  modified_base (306)..(306): a, c, t, g, unknown or other
  misc_feature (306)..(306): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggcccaggactggtgaagccttcggagaccctaaccctcacctgcactgtctctggtgactccatcagccgctactactggagctggactccggctcggcccgccgggcacgggactgggaggtggtagttcgggggccgtcggtctagtcacgtaggtacgaaaccngtacctacacctccccctccgtacgacgacgttcgacgtacactactttacactacgaccaccgttaccaactaaacgtctaacgttccgtaccctagggacggtctcggacgtccgttacgtacggtaccggtaccccggcggacggaacggaccgggtgttaactacgtttacgtggtcgggacggaacggggggtacggggggggacccgggtaaacttcggtaacggtggtacccttcgttacgaccttcgggacgggccgtaaccggggtaccttcgggtacccgtacccgttcgtccccttcgaaccgtcccgtaccaccggaaccgggtccctaacggtcccggttcccctcccgccgggcccttccgcctacggccccgaggtacccgacctacccgg

SEQ ID NO: 10882 - DNA, 774 bp, Homo sapiens
  misc_feature: GYAE6OF02GUFQQ.40.16.B05.1.454.CMB.1.raw
  modified_base (300)..(300): a, c, t, g, unknown or other
  misc_feature (300)..(300): n is a, c, g, or t
tcagtctagcgactcacgaccggtgctcgatttagagctcacgtagggggcacaagaacatgaaacacctgtggttcttcctcctcctggtggcagctcccagatggggtcctgtcccaggtgcagcttcaggagtcgggcccaggactgggtgaagccttcggagacccctaaccctcacctgcactgtctctggtgactccatcagccgctactacgtggagctggactccggctcggcccgccggggcaggggactgggagtggagttggggcgtcgtctatcacgagtacgaaacngtcctacacctccccctccgtcgaagaggtcgagtccactatttcactagaccacgtaccaacaaatcgtaagtttcgtccctaggacggtctgacgtccttcgtggtccgacccggccgggaccggaaccggaccgggggtactaatttacgttaccggttgggtacggacggggtaacggggggaccgggggggggtaacccgggggtaaaccttcggttaacggttcgggtcccgtttaccgttttacgggaacccgtttaaccggggtccgggggggaaccccgtaaccggggggtaacccccgtttggggtaccccgttacccggttcccttcccgtaaccgcccggtcccctaccccggaacccggaacccgggtccccgtaaccgtttccccgggttccccttcccccggtcggggcccctccccggtttcggcccccgttacggaccggtacccgcccgtacccgg

SEQ ID NO: 10883 - DNA, 701 bp, Homo sapiens
  misc_feature: GYAE6OF02GIAQ1.40.16.B05.1.454.CMB.1.raw
  modified_base (67)..(67): a, c, t, g, unknown or other
  misc_feature (67)..(67): n is a, c, g, or t
  modified_base (300)..(300): a, c, t, g, unknown or other
  misc_feature (300)..(300): n is a, c, g, or t
  modified_base (307)..(307): a, c, t, g, unknown or other
  misc_feature (307)..(307): n is a, c, g, or t
  modified_base (314)..(314): a, c, t, g, unknown or other
  misc_feature (314)..(314): n is a, c, g, or t
tcagtctagcgactcacgaccggtgctcgatttagagctcacgtagggggcgacaagaacatgaaanacctgtggttcttcctcctcctggtggcagcctcccagatgggtcctgtcccaggtgcagcttcaggagtcgggcccaggactgggtgaagccttcggagaccctaaccctcacctgcactgtctctggtgactccatcagccgctactactggagctggacgtcccggctacggccccgcgggcaggggactgggagttggagttcgggcgcgtctatcacagtcgaaaccngactacnctccccnccgtacgacgacgtcgagtcacctatttcacgtagacctacgtaccaacaaactcagttcgaccctaggacggtctaggacgtcttcgtggtccgacccggccggacggacgaccgggacgttacttacgttacgtggtaggcgggaaggggacggggggggacccgggtaaactccggttagcggtccttcgttacgacgttacggccggggtaccacggggtacccctgggtacccgtacccgttccgtaccctaccgtacgaccccttaccgaacccggtacgggccccgtaacggttaccccgggtttcccttccccccgggagggtccccctcccgggttccgtcccgtacccggacggtacccggaccccgtaaccccggg

SEQ ID NO: 10884 - DNA, 688 bp, Homo sapiens
  misc_feature: GYAE6OF02FWN3Y.40.16.B05.1.454.CMB.1.raw
  modified_base (271)..(271): a, c, t, g, unknown or other
  misc_feature (271)..(271): n is a, c, g, or t
  modified_base (275)..(275): a, c, t, g, unknown or other
  misc_feature (275)..(275): n is a, c, g, or t
  modified_base (294)..(294): a, c, t, g, unknown or other
  misc_feature (294)..(294): n is a, c, g, or t
  modified_base (585)..(585): a, c, t, g, unknown or other
  misc_feature (585)..(585): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggacgaccctaaccctcacctgccactgtctctggtgactccatcagccgctactactggagctggactccggctcgccccggcgggcagggactggagtggagttgggcncgtntatcacgagtacgaaaccngctacactcccctcctcgagacgtcgatccactacttcactacgacacgtcaactaaactctacgttccgtcctaggacgtcgtgacgtccttcgtgtccggacccggccggtaccgggaacgtacggggtccttaattacgtttacggtggtacgggcggggaaagggggtaccgggggggggacccggggtaaacttccggtaggttcggtcctttccgttaggaccgttcgggccggggaccgtaaccggggtaacccttcggggtaccctacccggtcctccgtacnccggtccctaccgaaccgtaccgggccctacggttccccggttcctcccccgggtgccccgttaccgctccggtaccgacggtacccgtcccacccggtacgg

SEQ ID NO: 10885 - DNA, 718 bp, Homo sapiens
  misc_feature: GYAE6OF02H0VZK.40.16.B05.1.454.CMB.1.raw
  modified_base (299)..(299): a, c, t, g, unknown or other
  misc_feature (299)..(299): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggcccaggactggtgaagccttcggagaccctaacctcacctgcactgtctctggtgactccatcagccgctactactgggagctggactccggctcggccccggcgggcaggggctgggaggtggagttcggggcgtcgtctatcacgagtacgaaaccngctaacacctccccctccgtacgagtacggtcgagtaccacctacgtttccaacgtacgacctaccgtaccaaactaaacttccgtaggttccgtcccgtaggacggtctaggaactccttacgtcggtacccggaccccggccgggaccgggtaaccggtaccggggtacttaacgtttaacgttacggtggtcggaacggggacggggggaccggggggggtaacccggggtaaacttccgttaagggtccggtaccttcggttacgacgtacgggtgggacccgtacgggtaccctggtacccacgttacctccgatacccgccctaccggaaccgaccgggtcctacgggttcccgttaccgtcccccgtgggccccttccgcggcccgtaccggaggtcccgtccgtaacccgg

SEQ ID NO: 10886 - DNA, 678 bp, Homo sapiens
  misc_feature: GYAE6OF02H3VJO.40.16.B05.1.454.CMB.1.raw
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtcgggcccaggactggtgaagccttcggagaccctaaccctcacctgcactgtctctggtgactccatcagccgctactactggagctggactccggctgccccggccgggcagggctggagtggagttgggcgcgtctatcacagtacgaaaccagctacactcccctccctgagcgtcgagtccacctatttcactacgactacgtaccaacaaatctagttcgtcccgtagacggctagacgtctcgtgtcgacccggccgcggaaccgacggggtacttaattaacgtttacgtggtcggacgggtacgggggaacgggggggggacccggggtaaacttccggttaagtcgggtaccctttcgtttagaccgttacggcggggtaccgaacggggtaccctggtacccaccggttctaccgtcgacgtcccctaccgaaccgaccgggccctacggttcccggttaccccttccccggtggccccgtcccgttcggtaccccgtaccggaacgggtaccgtccccgtacccgtacccgg

SEQ ID NO: 10887 - DNA, 778 bp, Homo sapiens
  misc_feature: GYAE6OF02IG7Q2.40.16.B05.1.454.CMB.1.raw
  modified_base (196)..(196): a, c, t, g, unknown or other
  misc_feature (196)..(196): n is a, c, g, or t
  modified_base (487)..(487): a, c, t, g, unknown or other
  misc_feature (487)..(487): n is a, c, g, or t
tcagtctagcgactcacgaccggtgctcgatttagagctcacgtagggggcacaagaacatgaaacacctgtggttcttcctcctcctggtggcagctcccagactgggtcctgtcccaggtgcagcttcagggagtcgggcccaggactggtgaagccttcggagaccctaacctcacctgcactgtctctggtnactccatcagccgctactactggacgctggactccgggctcggccccgcgggcaggggctgggagtggagttgggcgcgtctatcacgaaggtacgaaaccacgtactaacctacctcccccgtaccgtacggacggtacggtcgacgtccacctactttcaacgtacgtacctaccgtacctaacaaacttcgtacgttcgtcccgtaggtacggcgtagacgtctacgtcggtacggacccggacgggccgggaccgtaaccggggtcgttaacttacggtttaaccgngggttaggtaccgggaggggggtaaccggggggggtaccggggtaaaacttccggttaaggtccgggtacctttcgtttacggacgttaccgggcggggtaccgtaacgggtacccgtggttaaccctacccggttcctacccgtacgtaccgtaccccgttaccgaacccggtaaccgggtcccctaacgggtttccccggttaccccgtttcccccgggacgggtacccccgttccccgttaacgggttcccctaacccgggaaccgggtccctacccggtaaccccgg

SEQ ID NO: 10888 - DNA, 647 bp, Homo sapiens
  misc_feature: GYAE6OF02JJU8Z.40.16.B05.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (341)..(341): a, c, t, g, unknown or other
  misc_feature (341)..(341): n is a, c, g, or t
  modified_base (380)..(380): a, c, t, g, unknown or other
  misc_feature (380)..(380): n is a, c, g, or t
  modified_base (387)..(387): a, c, t, g, unknown or other
  misc_feature (387)..(387): n is a, c, g, or t
  modified_base (397)..(397): a, c, t, g, unknown or other
  misc_feature (397)..(397): n is a, c, g, or t
  modified_base (415)..(415): a, c, t, g, unknown or other
  misc_feature (415)..(415): n is a, c, g, or t
  modified_base (530)..(530): a, c, t, g, unknown or other
  misc_feature (530)..(530): n is a, c, g, or t
  modified_base (544)..(544): a, c, t, g, unknown or other
  misc_feature (544)..(544): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtnactccatcagccgctactactgganctggactccggctcggccccgcgggcaggggtactgggagtggagttgggccgcgtctatcacgagtgaaacccgagcctaaccactccccccgtcctacggagacgtcgaatccaactntttccaagtagaccacgtaccaacaaatcagttctcccngaggtcngagtctcgtntccggccgccgaggaccncgggacttacgttattcgtgtcgcggaggggacgggggggtaccgggaaaccttcgtaaggtcggtccttcgttgaccgttaagggtcgggaccgaacgggtaccctggggtccnccggttctcccgtntaccgccctaaccggaccgaaccgggccctaaggtttcccggttcccttccccggtcgggcccttccccggtactcccgtaccggacggtcgaccctacccgg

SEQ ID NO: 10889 - DNA, 825 bp, Homo sapiens
  misc_feature: GYAE6OF02HQGQ7.40.16.B05.1.454.CMB.1.raw
  modified_base (220)..(220): a, c, t, g, unknown or other
  misc_feature (220)..(220): n is a, c, g, or t
  modified_base (287)..(287): a, c, t, g, unknown or other
  misc_feature (287)..(287): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactgganctggatccggctcgcccgcgggcagggctggagtggagttgggcgcgtctatcacagtacgaaaccngacctacacctccccctcccgtcgagtacgtccggagtccaacctatttcaactacgacctaccgtaccaactaaatctacgttcgtcccgtggacggtctaggacgtcttacgtcggtaccggaccccggccgggacccgggtaaccggaccggggtaccgtttaaacgttaacgtttaacgtgggttcgggaccgggtaaaggggggaccggggggggggtaacccggggggtaaaaccttcccgggttaaaggttccggggacccttttcccggtttaacgggtacccgtttaaccggggtcgggggggtaaacccgtaaccggggggttaaacccccgttgggggttcccctaacccgggtttcccgttaccccgtaccgaaccggtcccccttaaccccggaacccggtaacccgggggtaccccctaagggtttccccccgggtttccccttaccccccggttccgggggccccgttaccccgtcggtccccgttaacccgggacgggttacccgaccccgttaaccccggg

SEQ ID NO: 10890 - DNA, 699 bp, Homo sapiens
  misc_feature: GYAE6OF02GJ5CK.40.16.B05.1.454.CMB.1.raw
  modified_base (345)..(345): a, c, t, g, unknown or other
  misc_feature (345)..(345): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagacccctaaccctcacctgcactgtctctggtgactccatcagccgctactactggagctggatccggctggcccgcgggcagggctggagtggattgggcgcgtctatcacagtagaaaccagctaacactccccctcctcggacgagtcgagtcaccatttccactagaccacgtccaanaaatcagttcgtcctaggagctgacgctctgtcgaccggccgacgggacacgggggcttaatacttacgtggtgaccggaaggggcgggggggggtaacccgggggtaaacttccggtaagtcggggtcttcccgtttaggaccttacgggttcggggggaccctaacggggggtaaccccttggggtcccaacccggtttccgtcccttaccgaaccggtccccttaccgaaccccgaacgggggtcccccctaaggtttccccggggttacccctttccccccggtcgggacccccggttccccggttaccggccccgttacccgggacgggacccgtccccgtaaccccgg

SEQ ID NO: 10891 - DNA, 798 bp, Homo sapiens
  misc_feature: GYAE6OF02GGJIP.40.16.B05.1.454.CMB.1.raw
  modified_base (227)..(227): a, c, t, g, unknown or other
  misc_feature (227)..(227): n is a, c, g, or t
  modified_base (307)..(307): a, c, t, g, unknown or other
  misc_feature (307)..(307): n is a, c, g, or t
  modified_base (420)..(420): a, c, t, g, unknown or other
  misc_feature (420)..(420): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgacccctaaccctcacctgcactgtctcgtggtgactccatcgagccgctactacgtgggacnctgggactccggctcggccccggccgggcagggactggacgtggagttgggcgtcggtctactcacgagtacgaaaccgngtacctacgactccccctccgtacgagtacgtcgacgtcaccgtatttccacgtacgactaacgtaccaacgtaaactcgtaagttccgacccgttaggacggtctaggtacncgttaccgtcggttaccgggaccccggtcccggaacgggaacccgtaccgggggtacttaacgtttaacgtttcgtcggtacgggaccgggtacgggggaaccgggggggggtacccgggtaaacttccggtaacgtccggggttaccttaccggtttacggaaccggttaccgggttcgggggacccgtacgggggtaacccctttcggggtaccctacccggtttccgtacccgtacgacccgtacccgttacccgaacgggtacccgggtacccctaacgggtttccccggtttaccccgttccccggtaccggggtaccccttcccggtaccgggttccctaacccggacgggtaacccgtcccgttaacccgg

SEQ ID NO: 10892 - DNA, 833 bp, Homo sapiens
  misc_feature: GYAE6OF02G0KNL.40.16.B05.1.454.CMB.1.raw
  modified_base (293)..(293): a, c, t, g, unknown or other
  misc_feature (293)..(293): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcggcccgcgggcagggactggagtcggattcggggcgcgttctatcgactagtcgaaaccngctaacgactccccctccgcgaggacgtcgtacgtccaccgtatttccgaacgtacgaccgtaccggttacccaaaactaaacgttccgtaagggttttccgtaccccgtagggtaacgggtcccgttaaggaccgttccgtttaccgtgggtaccgggtaacccccgggtcccgggaaccggggtaaccccggtaccggggggtaccgtttaaacttttaacgttttacccgtggggttacggaacccgggggtaagggggggaaccggggggggggggtaacccccggggggtaaaacctttccgggttaggttcccgggttccgttttaccgtttaaggacccggttaacggggtcggggaacccggtaaccggggaccccgtttgggtacccttacccggttccttacccgtcgaacccgtcccgttaaccgaccccggaaccgggtcccctacggttccccggttccccttacccccggcgggtccccgtaccccgttcggtcccgtacccggaggtaccccgtcctaccccggg

SEQ ID NO: 10893 - DNA, 905 bp, Homo sapiens
  misc_feature: GYAE6OF02H9F50.40.16.B05.1.454.CMB.1.raw
tcagtctagcgactcacgaccggtgctcgatttagagctcacgtagggggcacaagaacatgaaacacctgtggttcttcctcctcctggtgcagctcccagatgggtcctgtcccaggtgcagcttcaggacgtcgggcccaggactggtagaagccttcggagacccctaaccctcacctgcactgtcgtctgggtcactccgatcgacgcccgtactactacgtgggacgtcgtaggactcccggggtacctccgggcccccgggtccggggacccgaaggggtccgtacgggtaaggttcggggtagtttccgggggacggtccggttacgtaacgtcctaacgacggtaacgaaacctggtaccctacctaaccgttccccccgttacccgacggtaacggtacggtaccgtaccgtacctaaccgttaacttttaccgaccgttaacgaacctaacccggttacccaaactaaaccgttcgttaccggttaccgttacccgtacgggtaacggtccgttaggacggttcttaccgttcgggtaccgaccccgggtccgaaccggggtaaccgtaccggggttactttaaacgtttaacgttccgtacgggtcggtaaccggggtaacgggggtaacccggggggggggttacccgggggtaaaacctttccggttaacgggttcccggttacctttcccggttaacgggtaacccgttacgggccgggggtaccggttaacccggggttacccgtcggttacccggtccgtttacccgtccgtaacgtacccgtaccctacccgggacgtaacccggggacctacgggttcccgttccccggttacccgacgggtcccctacccggttcgacctccgggaacggtccgccctaacccgg

SEQ ID NO: 10894 - DNA, 670 bp, Homo sapiens
  misc_feature: GYAE6OF02HF4AO.40.16.B05.1.454.CMB.1.raw
  modified_base (196)..(196): a, c, t, g, unknown or other
  misc_feature (196)..(196): n is a, c, g, or t
  modified_base (291)..(291): a, c, t, g, unknown or other
  misc_feature (291)..(291): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactgggtgaagccttcggagaccctaaccctcacctgcactgtctctggtnactccatcagccgctactactggagctggatccggctggccccgccgggcaggggactgggagtggattgggcgcgtctatcacagtcgaaaccngctacactcccctcctcgagacgtcgatccacctattttccactacgacaccgtaccaacaaatctagttcgtccctggacgtctagcgtctctggtcgaccggccgacggaccgacgggtcttaattactttacgtggtcggacggaaggggacggggggggacccgggggtaaactccggttaagtcgggtccttccgtttgaccgttacggtcggggacccaacgggtacccttgggtacctaccggttccttccgtcgaccgtccctacccgaccggaacgggtcccctaacggttccccggttccccgttcccccgtgggtaccccgtccccgttcggtaccccgttaccggacgggacctcccgtaaccccgg

SEQ ID NO: 10895 - DNA, 704 bp, Homo sapiens
  misc_feature: GYAE6OF02IN6AX.40.16.B05.1.454.CMB.1.raw
  modified_base (293)..(293): a, c, t, g, unknown or other
  misc_feature (293)..(293): n is a, c, g, or t
  modified_base (374)..(374): a, c, t, g, unknown or other
  misc_feature (374)..(374): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtgactccatcagccgctactactggagctggatccggctcgcccggcgggcagggactggagtggattgggcgtcgtcgtatccacgagtacgaaaaccngtacctaaccgacttcccccctaccgtacggagtacggtccgagtccaacctatttaccactaagacctacgtacccaaanaaactcctaaggttccgtacccctggaacgtctacggacgtccttacgtcggtaccggaccccggccggtacgggaaccgtacggggtacttaaattacgttaacgtggttacggacgggtaagggggacgggggggaacccgggggtaaactccggtaagtcggtaccttcgtttacggacttacggcggggtaccaggttccgtaaacccgtggtaccacccgttctacccgtcacgccctaccaccggaaccgggtccctaaccggttcccggttcccttaccccggtgggcccgtcccgttcgcccgtaccggacggacgtccccg

SEQ ID NO: 10896 - DNA, 731 bp, Homo sapiens
  misc_feature: GYAE6OF02HFG5N.40.16.B05.1.454.CMB.1.raw
  modified_base (305)..(305): a, c, t, g, unknown or other
  misc_feature (305)..(305): n is a, c, g, or t
  modified_base (511)..(511): a, c, t, g, unknown or other
  misc_feature (511)..(511): n is a, c, g, or t
  modified_base (687)..(687): a, c, t, g, unknown or other
  misc_feature (687)..(687): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctctggtgactccatcagccgctactactggagctggactccggctcggccccggccgggacaggggctgggagtgggagttcggggccgcgttctatcacgacggtacgaaaaccngtcctaacctccttcccccctcccgtacggaacggtacggtaccgaggttacccaaccttacttttaccaacgttacgacctaccgtacccaaactaaacttcgtaacgtttccgtacccgtagggaacggtccgtaggacgtccgtttcgtcggtccggacccggccgggacgggaccgacgggggtactttagtacgtttacgngggtacggacgggagggggaaccggggggggaccgggtaaactccgtaggtccggtcttacgttcggacgtacggtcggggacctacgggtacccgtacggtccaccgttcctccacgaccgtccctaaccgaccggtaccgggtccctaacggtcccggttccccgttccccggnggccccttcccgtagtcccgtaccgaaggtccgccctaacccgg

SEQ ID NO: 10897 - DNA, 812 bp, Homo sapiens
  misc_feature: GYAE6OF02JU6Z8.40.16.B05.1.454.CMB.1.raw
  modified_base (312)..(312): a, c, t, g, unknown or other
  misc_feature (312)..(312): n is a, c, g, or t
  modified_base (525)..(525): a, c, t, g, unknown or other
  misc_feature (525)..(525): n is a, c, g, or t
tcagtctagcgactcacgaccggtgctcgatttagagctcacgtagggggcacaagaacatgaaacacctgtggttcttcctcctcctggtggcagctcccagatggggtcctgtcccaggtgcagcttcaggagtcgggcccaggactgggtgaaggccttcgggagaccctaaccctcaccgtgcactgtctctggtgacctccatcagccgctactacgtcggagctggactccggctcgcccggcgggcagggtactggaggtggagttcggggacgtcgtacgtatcgaaccgtgtaacgaaacccnggaccttaccaccttccccctaccgtcgaagacggtccgaacgtccaccgtactttcaaccttacgacctaccggtacccaaaataaacttcgaacggtttccgtaccctagggtaccgggtactacggggtatcccttccggttggttacccggacccggccccgggcgggaaccgaaccgggggtactttaccggtaatttttacccgggnggtaccgggtacggggtaacggggggaccgggggggtaacccgggtaaccttcggtacggttcggtccgtttcgttaacggtaccggtacgggtccggggtaaccgaaccgggttaccgttcgggtcccgtccgtttccctccggacggtaaccctcccggtaccccgtaaccgggtaccggtacccgtcccggtttacccggtccccgttaaccccggtccggtaccccggtcccggtaccggtacccggttaccccgggtaggtaccccggaccctaccccgggg

SEQ ID NO: 10898 - DNA, 843 bp, Homo sapiens
  misc_feature: GYAE6OF02IBHME.40.16.B05.1.454.CMB.1.raw
tcagtctagcgactcacgaccggtgctcgatttagagctcacgtagggggcacaagaacatgaaacacctgtggttcttcctcctcctggtggtagctccagatgggtcctgtcccaggtgcagcttcaggagtcgggcccaggactggtgaagccttcggacgacccctaaccctcacctgacactgtctctggtgacctcgactcacgccgtactacgtacgtggacgtcgtaggacgtcccggcgtccggccccgggaccgggacgaggggtaccgtggggaacgggttgggtaacggttcggggccgttccggttactaacgtcctaagtaacggtaccggtaaaaccgacgtaccgttaactaccccttcccccgtaccccgttaacggaacggtaccggttaccggtaacgtccctaccttaacttttaccgacttaacgacctaaccgtaccaaacgtaaactctaacggttccgtaccgtgggtacggtcgttacggacgtccgtcgtgtacccgggacccggtcccgggacgggtaccgtaccggggtaacgtttaagtaaccgtttcggtggtaccgggtacgggggacgggggggtaaccggggggggggaacccgggttaaacctaccggttaacggtcggtttccgtttacggtttaccggcgttaaacggggccgggtacccgtaacggggtaaccgttccggtaccgtaccgttcctaaccgtccggtaccgaccctaccggaccggtacccggtccgtacgttcccgggttacccctccccggtggaccctccgacgttccgaccgtcgaccgtcccgaccgtacgg

SEQ ID NO: 10899 - DNA, 878 bp, Homo sapiens
  misc_feature: GYAE6OF02ITBXX.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctcgtggtcgacctccatcacgccgctactacgtggagcgtggactccggctcggaccccggccgggtacgagggtaccgtgggaggtcggtaggttcgggcgtcgtactagtccacgagtacgaaaccacgtacctactaccgttccccctccgtacggtacggtacggtaccggtacctaccgtaccctaacttttccgaacgttaaccggtaaccacccggttaccaaaccgtaaaacttccgttaaggttccgtttacccgtacgggtaacgggtacccgttaggtaaccggtcttacccggtacggttacccggacccccggtccgggaccgggtaaccggtacccggggtagttaaacgtttacgtttaccgtgggttacggacgggaacgggggggtaccgggggggtaaccgggtaacttcccgttaaggtacgggtttccctttacggtttaacgaccggttaccgggaccgggggtaccgtaacccgggtaacccgttgggtacccggtaacccgtttccgttacccgtacccggtacccgtaccccgttaaccgaccccggtaacccggggtaccccgttccgtttacccccggggtttccccgttacccccggcgggttcccccgtccggttaccggttaccccgtacccggaagggttaccctccccgtaaccccgg

SEQ ID NO: 10900 - DNA, 687 bp, Homo sapiens
  misc_feature: GYAE6OF02HLHH1.40.16.B05.1.454.CMB.1.raw
  modified_base (148)..(148): a, c, t, g, unknown or other
  misc_feature (148)..(148): n is a, c, g, or t
  modified_base (216)..(216): a, c, t, g, unknown or other
  misc_feature (216)..(216): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
tcagtctagcgactcacgaccggtgctcgatttagagctcacgtagggggcacaagaacatgaaacactgtggttcttcctcctcctggtggcagctcccagatgggtcctgtccaggtgcagcttcaggagtcgggccaggactggngaacgcttcggacgaccctaacctcacctgcactgtctctggtagactccatcaggcctctactacgnggactcgtgactccggctcgcccggcggtacgagggactggaggtggagttggggctacggtctatcacgagtacgaaccngctacacctcccctcagaganccgatcactagtttcaactagacaccgtaccaataaacgtntaacgtttcgaccggaacgtctaggcgtctggtaacgtcgacccgcggacgggtacgacgggttacgtagtattacgtcgtggacggagggggacggggggggttaaacccggggaactaccggtggtacgggtcccttacggtttacgaccgtttacgggaccggggaccggtaaccggaaccggttcgtaacccgtcccgttacgcccttaggacctcccggtaccaacgggtacccgggtccctaacggttcccggtacccctttcccggggcccctaccggttccccgtagtcccgaacccgggtcggagccccgtaacccggg

SEQ ID NO: 10901 - DNA, 756 bp, Homo sapiens
  misc_feature: GYAE6OF02GXF1N.40.16.B05.1.454.CMB.1.raw
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (506)..(506): a, c, t, g, unknown or other
  misc_feature (506)..(506): n is a, c, g, or t
tcagtctagcgactcacgaccggtgctcgatttagagctcacgtagggggcacaagaacatgaaacacctgtggttcttcctcctcctggtggcagctcccagatcgggtcctgtcccaggtgcagcttcagggagtcggggcccaggactggtgaagtccttcgggacgaaccccttaaccctcacctgcactgtctcgtggtcgactccagtcgacgcccgctaaccgtacgtgggacncgtgggactccggctcggcccggcgggcaggggactgggagtcggagttcgggcgtcgtctancacgacgtacgaaaccngacctaacncctaccccgtccgtacgacggacgtcgaccgtccaacgtatttaccgaactagaaccgtaccggttaccaaactaaattccgtaagttccgtaccgtaggacggtctacgacgtcttaccgtggtaccgacccggcggtaacggacgtacccgggtattacgtacgttacgtcggngacggggtaacgggggaccgggggggtaacccggtaaactcgttagggaccggttaccttccgtttaggaccgttagggaccgggacggtaaccgggtacccgtcgttacccgacccgttcctccgtacaaccgggtcccctaccggaccggtaaccgggtcctaccggtcccggtttaccccgtccccgtacgggtccccggacctccgggaccttaccgggaaccgggtaccaccccgtaacccgggg

SEQ ID NO: 10902 - DNA, 799 bp, Homo sapiens
  misc_feature: GYAE6OF02I8KRW.40.16.B05.1.454.CMB.1.raw
  modified_base (692)..(692): a, c, t, g, unknown or other
  misc_feature (692)..(692): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaacgtccttcggacgacccctaaccctcacctgcactgtctcgtggtcgacctccataccgacgccgtacctaactacgtaggacgccgttgggtacctccgggcctccgggcccccgggaccggggacgtaggggacgtggggaggtcgggtacgttcgggggcgtccgttacgtacgtcctaacgaagtacggaaaccacgtacctaacctacccgttcccccgtaccgtacggaacgtacggttaccgaccggtacctaaccttactttacgaacgttaacgaccgtaaccgttaaccaaactaaagtcccgtaaggttccgtacccggtaggtaacgtcgtacgtcggtaccttcggtacgtaccggcccgtacccgggtacggacccggtacgggtactttaggtactttacgggcgtaacggtcggggaacggggtaacggggggaacccggtaacttcgttacggtcgttacgtcttaagccggtaacgggcggtaaccgtaccgggtaccgtcgtacccgccttacgcccgngtacctccccgtaaccgacggtaaccgggtacctcccggtttccgttacccccgtcccgggaccgtcccgttcgtaccgtcccgaggacccggacgccccgtaccgg

SEQ ID NO: 10903 - DNA, 947 bp, Homo sapiens
  misc_feature: GYAE6OF02JSW2S.40.16.B05.1.454.CMB.1.raw
  modified_base (141)..(141): a, c, t, g, unknown or other
  misc_feature (141)..(141): n is a, c, g, or t
  modified_base (252)..(252): a, c, t, g, unknown or other
  misc_feature (252)..(252): n is a, c, g, or t
tcagtctagcgactcacgaccggtgctcgatttagagctcacgtagggggcacaagaacatgaaacacctgtggttcttcctcctcctggtggcagctcccagatggggtcctggtcccaggtgccgagctttcgaagggnggtccgggcccaaggactgggtgaagccttacgggacgaccccttaaacctcgacctgctactgtctccgtaggtcgactccacgtcaggcccgtctacctacgtgggacncgttcgggacttccggcttccgggccccggacgggtactaagggggaccttgggacggttggtcggttacggggccggtacggttaccgttacgaccgaacggtacgttacggaaaacccttaggactaacccgtacccgttaccccccgtccggttacggacggttaccgtaccggtaacggtacctaaccgttacgtttaaccgtaaccggttaactaaccggtccgtaacccaaacgttaacgttaccgtaagggtttcccgtaaccctcggggtacggtccttaacgggtcgtacctttgggtttaaccccggtaccggtcccgggtaaccccggggtacggtaacccgggtaacggggttacccgttaattttaacccgggttagggttccgggacggtaccgggggtaacgggggggtaccggggggggtaccccgggttaaacttccggggaacggttcccgggttaccgtttggttaccgtaccggtgggtcccgggtaaccggaacccggggttcgttaagggtacccccgtcgttaccggtcccgttaaacggaccgtccccgttacgggaccccgtaaccggggttccctacggggtttccccgggttacccctaccccgggtcgggtccccgtacccgtttccggaccggttacccgggcggtacggtaccccctacccgggg

SEQ ID NO: 10904 - DNA, 807 bp, Homo sapiens
  misc_feature: GYAE6OF02HOV5X.40.16.B05.1.454.CMB.1.raw
  modified_base (317)..(317): a, c, t, g, unknown or other
  misc_feature (317)..(317): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagtctagcgactcacgaccggtgctcgatttagagctcacgtagggggcacaagaacatgaaacacctgtggttcttcctcctcctggtgtagctcccagatgggtcctgtcccaggtgcagcttcaggagtcgggcccaggactggtgaagccttcggagaccctaaccctcacctgcactgtctcgtggtgactccatccagcccgactacgtactgggacgctgggactcccgggctcggccccggccgggcaggggactgggagtggagttggggcgtcgtctagtcacgaggtacgaaaccagcctaacncctacccccctccctacggagtacggtcgacgttccacctatttcactacgacncgtaccaanaaactctacgttccgtccctagggacggccttaggacgtccgttactcgggttaccggaccccgggcccgggtaccggggaaccgtacccggggggttaacgttaactttaacgtttaccggtgggtacgggaccggggtaacggggggaacccggggggggggggacccgggggttaaaacccttccggttaaagggttccgggttacccctttaccccggtttttagggaacccgtttaacgggtccggggggaccctaaaccgggggttaaccccgtcgggttacccacccggttcctcccgtacgacccgtcctaccccgaaccggtacccgggtcccttacggtccccggttacccccgttccccgccgggttcccaccccggttgaccccggtaccggagggccctcccgaccctaccggg

SEQ ID NO: 10905 - DNA, 850 bp, Homo sapiens
  misc_feature: GYAE6OF02GIJ1V.40.16.B05.1.454.CMB.1.raw
  modified_base (310)..(310): a, c, t, g, unknown or other
  misc_feature (310)..(310): n is a, c, g, or t
tcagtctagcgactcacgaccggtgctcgatttagagctcacgtagggggcgacaagaacatgaaacacctgtggttcttcctcctcctggtggcagctcccagatgggtcctgtcccaggtgcagcttcaggagtcgggcccaggactggtgaagccttcggagaccctaacctcacctgcactgtctctggtgactccatcagccgctactactggacgcgtggactccggctcggcccggcgggcagggactgggagtggtacttgggggcctcgttacgtacaccgtaacacggtacgaaaacccnggtcctaacacccttccccctccgtacggacgtacggttcggacgttcccaaccgttatttccaacgttaaggacctaccggttccaaaacgtaaacgtttccgtaaaggttttcccggtacccgttagggaccgggttaccttacgggaaccgttcccgttaacgtttcggggtaaccccgaccccggggttcccggacgggacccgtaccgggggtaactttacttaacgtttaccgtgggtacgggaacgggacggggggtacgggggggggtaacccgggtaaattccggtaaggttccgggttacctttccggtttacgaccggttacgggtccggggaccgttaacggggtaccccggtttacggtaccggttcccggttaccgttccgttaccccggagtaccccccggttaaccgaaccgggtaccggtccccgttaacggtttcccccgggttaccccttcccccggttaagggtccccgttacccgtccgtacccgttaaccgggacgggtaccctcccggtaaccccgg

SEQ ID NO: 10906 - DNA, 703 bp, Homo sapiens
  misc_feature: GYAE6OF02GVS42.40.16.B05.1.454.CMB.1.raw
  modified_base (320)..(320): a, c, t, g, unknown or other
  misc_feature (320)..(320): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaacgtccttcggacgtacccctaacccgtcaccgtgcacttgtctctggtcactccatcgacgccgctactacgtggacgtcgtggactccggctcggccccggcggcgagggtactgggagtggtagttcgggcgtcgtctagtccagtagtacgaaacgcgctacnccgtcccctccgcgagcgtcgacgtaccacctgtttacacgtagccacgtaccaagaactcgtagttctccgtgacggtctaggacgtctgtcgtccgacccggtccgaccgggacgtccggggtaccttaagttacgttaccggtggtaccggacgggggtagggggaccgggggggtaacccgggtaaactccgggttaacgccggttaccttcgttaccggtaccgttacgggccggggtaccgtaaccgggtcccgttcggaccccgttacgtcccgtaccgtcgaccgttccccgaaccgtacccgacgggtacccttacgggttcccgttaccctcccggcggccctccgtacgcccgtagcccgtcgaccctaccg

SEQ ID NO: 10907 - DNA, 789 bp, Homo sapiens
  misc_feature: GYAE6OF02JE2SM.40.16.B05.1.454.CMB.1.raw
  modified_base (559)..(559): a, c, t, g, unknown or other
  misc_feature (559)..(559): n is a, c, g, or t
  modified_base (678)..(678): a, c, t, g, unknown or other
  misc_feature (678)..(678): n is a, c, g, or t
  modified_base (746)..(746): a, c, t, g, unknown or other
  misc_feature (746)..(746): n is a, c, g, or t
  modified_base (759)..(759): a, c, t, g, unknown or other
  misc_feature (759)..(759): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggaggtcgggcccaggactggtgaagccttcgggacgaccctaaccctccacctgccactcgtctcgtggtgacctccatcacgcccgtctacctacgtgggacgctgggactcccgggctccggcccggccgggacgacgggacgtgggtaggtgggtacgttcggggccgtccggttactacgtccgaacgtacggtaacgaaacccgtaggtacctaaccgtacccttcccccccgtcccgtaacggtaacggtaaccggtccggtaacgtaccctaccgttaactttaccgaaccgttacggaaccctaaccggtaacccaacctaaagtccgttaacggttacgtccgtaggacggtcgtacgacgttccttcgtacggtccggaccgtccggaccgggtacggccggtaacttatcgttacgngggtaccgacgggtacgggggaccggggggtaccggtaacgtccgtaggtcggtcccgttcgtacgtacgtaccgggacgggcccggtacggtacccgggtcgtaccgtaccggttccncccgcgtacccgtccgtacccgaacggcccgggtacccgtccggttacccggttccctacccccgggngtcccggtcccgnggtcccgcggtaacggtccaccgtacccgg

SEQ ID NO: 10908 - DNA, 979 bp, Homo sapiens
  misc_feature: GYAE6OF02HCHCL.40.16.B05.1.454.CMB.1.raw
  modified_base (223)..(223): a, c, t, g, unknown or other
  misc_feature (223)..(223): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtcgggcccaggactggtagaagccttggacgaccctaaccctcacctgcactgtctcgtggtgactccagtccagccgactactacgnggacgcgtggactccgggctcggccccggcgggacgacgggtacgtgggaggtggaggttcggggcgtacgtacttacgaccgacgtaagtaaccgaaaccgacgtacctaacctacccgttccccccctccgtacggacggtacgtacgtaccgtacctaccgttactttaccgaacgtaacaccaacccgtaccaaacctaactacgttacgttcccgtaccgtaggacggtacgtggtaaccgttccgtacgtcggtaccggtccccgggacccggggtacgggaccggtaaccggggttacgtttaacgtaacggtttttacggtcggggtacgggaaccgggggtaaacggggggggtacccgggggggggtaacccggggttaaacccgttccggttaacggggttccgggttaacccgtttttcccgggttaacggggttaccgtttaaccggggggtcccggggggtaaccccgggtaaaaccgggggttaccccggttaccccgggggttaacccgttaccccgggttaccccgttacccgggacccccgtacccgttaaccccccgacccccggaaaccccggggttacccggggaccccccgttttaacccggggttcccccgggtttccccccgtttaccccccgggggtacccgggttccccccggttaaccccgttacccgggggttaacccctacccccgggggggtaccctaaccccggggtacccccgtaaccccgggg

SEQ ID NO: 10909 - DNA, 766 bp, Homo sapiens
  misc_feature: GYAE6OF02JGC6E.40.16.B05.1.454.CMB.1.raw
  modified_base (644)..(644): a, c, t, g, unknown or other
  misc_feature (644)..(644): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtcactccatcacgccgctactacgtggagctggactccggctcggaccccggccgggtacgagggtaccgtgggaggttaggtaggttcggggccgtcggtactataccacgagtacgaaaccagtcctacctacccttacccctccgtacggaacgtagtaccgacgtacctaaccgtactttaccgaactacgaacctacgtaaccaacaacttctacgttcgtaccctaggaacgtcgtaggacgtcctacgtcggtaccgacccggtccgacgggaaccggtacggggttacttaagttacgttacgtgggtacggcgggaaggggggaaccggggggtaacccgggtaaacttcggtacgtccggttcttaccgttacgtccgtaacgggtccgggaccgtaaccgggtaccgttacgtacccgtacccgttccttcccggtaacnccggtacccctaacccgtaccggaccggttacccgtaacccggttcccgggttacccgtcccccggtcggtccccgtaccccggtcgtacccgtacccggtcggacccgtacccgtcccggg

SEQ ID NO: 10910 - DNA, 673 bp, Homo sapiens
  misc_feature: GYAE6OF02JLXTE.40.16.B05.1.454.CMB.1.raw
  modified_base (195)..(195): a, c, t, g, unknown or other
  misc_feature (195)..(195): n is a, c, g, or t
  modified_base (309)..(309): a, c, t, g, unknown or other
  misc_feature (309)..(309): n is a, c, g, or t
  modified_base (406)..(406): a, c, t, g, unknown or other
  misc_feature (406)..(406): n is a, c, g, or t
  modified_base (451)..(451): a, c, t, g, unknown or other
  misc_feature (451)..(451): n is a, c, g, or t
  modified_base (465)..(465): a, c, t, g, unknown or other
  misc_feature (465)..(465): n is a, c, g, or t
  modified_base (628)..(628): a, c, t, g, unknown or other
  misc_feature (628)..(628): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtnactccatcagccgctactatggagctggactccggctcggccccgaccgggcacgggacgtggacgtggaggttcggggcgccgttcgtactccgaacgacggtacgaaaccgnggtacctacctccgtccccctaccgtacggagtacgtcgacgttaccacctatttaccaacgtacgaccacgtaccaactaagtcgtagttcgtccnggacgcgtgactctcgtacgtacgcccggtcgcggacgacgggtntaacgttcgttcgnggtcgcgggaggggcggggggaaccggtactcgtagtcgtcttccgtagacgtcgggcggacccgaacgggtacccttcgggtacctaccggttcctacccgtacgacccgtccctaccggaccgggaacccggtccgtaccggttccgttccccgtccccgngggtcccttcccgtgaccgtacccggacgttaccgccgtacccgg

SEQ ID NO: 10911 - DNA, 646 bp, Homo sapiens
  misc_feature: GYAE6OF02GKIGA.40.16.B05.1.454.CMB.1.raw
  modified_base (195)..(195): a, c, t, g, unknown or other
  misc_feature (195)..(195): n is a, c, g, or t
  modified_base (231)..(231): a, c, t, g, unknown or other
  misc_feature (231)..(231): n is a, c, g, or t
  modified_base (264)..(264): a, c, t, g, unknown or other
  misc_feature (264)..(264): n is a, c, g, or t
  modified_base (274)..(274): a, c, t, g, unknown or other
  misc_feature (274)..(274): n is a, c, g, or t
  modified_base (284)..(284): a, c, t, g, unknown or other
  misc_feature (284)..(284): n is a, c, g, or t
  modified_base (600)..(600): a, c, t, g, unknown or other
  misc_feature (600)..(600): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaaccctcacctgcactgtctctggtnactccatcagccgctactactggagctggatccggntgcccgcgggcagggctgggagtggattgggcncgtctatcanagtgaaaccngctacactcccctcctcgagacgtcgagtccacctatttcactagacacgtccaacaaatcagttctcctggacgctagatctactgtcgaccggccgacggacgacgggacttatacgttactggtgcggagggacgggggggacccgggggtaaacttcggtaagtcggcctttcgtttacgacttaccggcggggtacccgaacgggggtacccttggggtaccctaaccggttcctcctacgaccgtaccctcccgaccgaaccgggtcccctaaggttccccggttaccccttcccccggtagggtccccnccccgtttcgggacccttacccggagggtacccgcccttaccccgg

SEQ ID NO: 10912 - DNA, 910 bp, Homo sapiens
  misc_feature: GYAE6OF02HUELL.40.16.B05.1.454.CMB.1.raw
  modified_base (222)..(222): a, c, t, g, unknown or other
  misc_feature (222)..(222): n is a, c, g, or t
tcagtctagcgactcacgaccggtgctcgatttagagctcacgtagggggcacaaagaacatgaaacacctgtggttcttcctcctcctgggtggcagctcccagatgggtcctgtcccaggtgcagcttcaggagtcgggcccaggactggtgaagccttcggagacccctaaccctcacctgcactgtctctggtgactcatcagccgctactactgganctggactccggctcgccccggcgggcacgggactgggagtggtagttggggccgtacgtactacgtccaacgtaggtaacgaaaaccaggtacctaaccgtacccttcccccctaccgtacggtaacggtacggttaccggtaacgtaccctaaacctttaacttttacccgaaacgtaaacggtaacccaacccggttacccaaaaactaaaacgttccgtaacggttttccggtaccccgtagggtacgggtactttaacgggacgttcccgttacggttaccgggtacccgggaacccccgggacccgggtaccggggtaacccggtaaccgggggtaaccgttttaaacgtttaaccggtttaaccggttgggttaccggggaaccgggggtaaacggggggggtaaccgggggggggggtaaaccccggggttaaacttaccggtttaacgggtccgggttacccttttaccggtttacgggtaacccggtttaccggggccgggggtaacccggtaaaccggggtaccccgtttacggggtcccgtaacccgttcccgttaccgtccgaacccgtccccgtaaccgacccggtaacggtccccgttaacggtcccggttaccccctccccggtcggcccgtaccctcgtacccgtaccgggcggtacccgccctaacccggg

SEQ ID NO: 10913 - DNA, 831 bp, Homo sapiens
  misc_feature: GYAE6OF02FLKDN.40.16.B05.1.454.CMB.1.raw
  modified_base (324)..(324): a, c, t, g, unknown or other
  misc_feature (324)..(324): n is a, c, g, or t
  modified_base (346)..(346): a, c, t, g, unknown or other
  misc_feature (346)..(346): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactgggtagaagtcccttcgggacgacccctaaccctcacctgacactgtctctggtcgactccatcagccgctactacgtggagcgtggactcccggtctccgccccgggccgggacgagggaccgtgggacgtgggtaggttgggccgtcgtactactcaacgacggtacgaaaccncgactacctacccgttcccccnccgtacgagtacgtacggactccgtactactttaccaacgttagccaactcaaacctaaatcgtacggttccgcccgttagacgggtctaggacgtccttcgcggttccgaccccggccggtaccgggaaccggtaccggggttacttatttaaacgttaacgtgggtaccggtagggaaccgggggggacccggggggggtaacccggggtaaccttaccgggttacgtaccgggttccctttccgggtttaaccgtaccgggtttaaccgggttcggggggtaaccccgtaacgggggtaacccctttcggggtaccccgttacccgtttcccgtcccaccggttccctacccgtacccgaacccgggtaaccggcccgtttaccggtaccccggtttcccccgttaccccgggtcggtaccccccggtccttaccggtcccccggttaccgggtaccggtaccccgacccgtaacccccggg

SEQ ID NO: 10914 - DNA, 626 bp, Homo sapiens
  misc_feature: GYAE6OF02GG6PB.40.16.B05.1.454.CMB.1.raw
  modified_base (223)..(223): a, c, t, g, unknown or other
  misc_feature (223)..(223): n is a, c, g, or t
  modified_base (294)..(294): a, c, t, g, unknown or other
  misc_feature (294)..(294): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagacccctaaccctcacctgcactgtctctggtgactccatcagccgctaactacgtgganctggactccggctcgccccgcgggcagggactggagtggattgggcgtcgtctatccacagtacgaaaccngcctacacttccccctaccgtcgagtacgtcgagtccaacctatttccaactacgaccaccgtaccaacaaatcaagttcgccctaggacgtctgacgtctcgtgtccgaccgccgcggacgacggctatattaccgtggtgcggaggggtacgggggggaccgggtaaacttccgtagtcggtcttacgttgaccttacggcgggtaccacgggtaccctggtccaaccgttcacctcgacgcccttaccgaccgaaccggcctaacgtccgggttccccttcccggtcggcccgtcccggtgtccctaccggagtaccgtcccgtacccg

SEQ ID NO: 10915 - DNA, 721 bp, Homo sapiens
  misc_feature: GYAE6OF02IGCT4.40.16.B05.1.454.CMB.1.raw
  modified_base (196)..(196): a, c, t, g, unknown or other
  misc_feature (196)..(196): n is a, c, g, or t
  modified_base (252)..(252): a, c, t, g, unknown or other
  misc_feature (252)..(252): n is a, c, g, or t
tcagtctagcgactcacgaccggtgctcgatttagagctcacgtagggggcacaagaacatgaaacacctgtgttcttcctctcctggtggcagctcccagatgggtcctgtcccaggtgcagcttcaggagtcgggcccaggactggtgaagtccttggacgaccctaaccctcacctgctactgtctcgtggtnactccatcgacgccgtctactactggatcgtggactccggctcgccccggtcgggnagggcgtggagtaggtagttcggggcgtcgttactactccaacgtaggtaaccaaaccgtagtacctaacctaccgtccccccttacgtacggaagtacggtaccgtacgtccaaccttatttacaacgtacaccgtaaccgtaccaaaacgaaacttccgtaagtttccgaccgtaggtacgtacgttacgaacgtccgtcgtgggtcccgacccggtcggtaccggaacgggtacggtacttaagtacgtttcgacgggtcggaacggggtacgggggtaccgggggggtaacccggtaaattccggtaagtccgttacttacgttacgcgtaacgggtcggaaccgtacgggcccgttgtacccgtccgtactccgtagccgtacctacccgacggtacgtaccctcggtaccccgtccgttacccgcggtaccctcccgcgtaccgccgagtcccgctaccccgg

SEQ ID NO: 10916 - DNA, 812 bp, Homo sapiens
  misc_feature: GYAE6OF02I4H1V.40.16.B05.1.454.CMB.1.raw
  modified_base (313)..(313): a, c, t, g, unknown or other
  misc_feature (313)..(313): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggacgaccctaaccctcacctgcactgtctcgtggtgactccatcacgccgtctacgtacgtggacgcgtggactcccggcgtcggccccggccgggcgacgggtactgggagtggagttgggcgtcgtctatccacgtacgtacgaaaccgngtacctacaccgttcccctccgtacgacgacgtacgacgtaccaacctatttaccaacgttacgactaccgtaccaaactaaacgtctaacgttccgtcccgtaggacgtctacgtacgtcgtcgttacggtcggacccggtccggacgggaaccggcggggttaaccttagttaacgtttacgtggggttacggaccggggtaaacgggggggaccgggggggggttaaaccccgggtaaacctttccgggtaaggttccggtaccccgttttccgttaacggtacccgtttaccgggggacgggggtacccgttaaacccgggggtaccctttcggggtaaccccgtacccttaccgttacccgtccgtaacccgtccccgtaacccggtaccgaccgggtacccctcgggtttaccccggttacccctttccccgggacgtaccccggtcccgtcggtacccgtacgggtaacccggaccgtaccccgtaacccgg

SEQ ID NO: 10917 - DNA, 782 bp, Homo sapiens
  misc_feature: GYAE6OF02GGQQQ.40.16.B05.1.454.CMB.1.raw
  modified_base (207)..(207): a, c, t, g, unknown or other
  misc_feature (207)..(207): n is a, c, g, or t
  modified_base (232)..(232): a, c, t, g, unknown or other
  misc_feature (232)..(232): n is a, c, g, or t
  modified_base (313)..(313): a, c, t, g, unknown or other
  misc_feature (313)..(313): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtccgggcccaggactgggtgaaacggcctttacgggacgaacccctaaccctcacctgcactgtctcgtggtnactccatcagccgctactactgganctggatccggctcggccccggccgggcgaagggactgggagtcggagttcggggcgtcgtactatcacgagtacgaaaccncgacctaaccaccttcccccgtcccgtcggaagtacgtccgacgtccaccgtactttaccactaacgaacctacgtacccaaactaaactcgtacgtttaccgtcccgtaggacggtcctgggtactcttcgtacgttccgggaccccggccgggtaccgggaccggaccgggtacgttaatttaacgtttagtcggtcggacgggggaaacgggggtaccgggggggggtaacccggggtaaaccttcggttaacggtcggttcctttaccgttacgaccgtacgggtcgggtaacccggaacggggtaacccgttgggtacccgtccgtccttccctacggaaccgtcccctaccgaaccgggaccggtcccccgttaggttccccggttaccccggttcccccggcggggttaccccctccggtaccggaccctttaccggggacgggacccgtacccctaccggg

SEQ ID NO: 10918 - DNA, 838 bp, Homo sapiens
  misc_feature: GYAE6OF02GJ9N9.40.16.B05.1.454.CMB.1.raw
  modified_base (202)..(202): a, c, t, g, unknown or other
  misc_feature (202)..(202): n is a, c, g, or t
  modified_base (298)..(298): a, c, t, g, unknown or other
  misc_feature (298)..(298): n is a, c, g, or t
  modified_base (312)..(312): a, c, t, g, unknown or other
  misc_feature (312)..(312): n is a, c, g, or t
  modified_base (329)..(329): a, c, t, g, unknown or other
  misc_feature (329)..(329): n is a, c, g, or t
tcagtctagcgactcacgaccggtgctcgatttagagctcacgtagggggcacaagaacatgaaacacctgtggttcttcctcctcctggtggcagctccagatgggtcctgtcccaggtgcagcttcagggagtcgggcccaggactggtgaacggtccttcgggacgaacccctaaccctcacctgcactgtctctggtnactccgatcacgccgacttactacgtggacgtcgtggacgtccggctcggacccggcgggacagggacgtggaggtggtagtcgggcgtcgtctancacgagtacgaacngctacacctccctccgngagtacgtcgacgtccacttcttaccaactacgacctacgtaccaaagtaagtccttaaggttcctaaccggtggacggtcttacggacgtcttacggtgtaccgggacccggtccgggacgggtaaccggtcggggtaacgtttaacgttaacgtttccggtacggttagggaaaccgggtaggggggggttaacccggggggggaaacccgggggtaaaactttcccgggtaagggttaccgggttcccgttttacgggttaaccgtacgggttttaacccggggaacgggggtacccgtaaacccggggtacccgtttacgggtaaccccgtacccggttaccgtacccccgttagtaccccgtaccccgtaaccggtacccggtaaacccggcccgtttaaccggttttccccggtaccccgttttaccccggggacccgcccgggttttaccccgcccgggtttaccgaccgggtaaaccggtcccgtaacccgtaccccgggg

SEQ ID NO: 10919 - DNA, 890 bp, Homo sapiens
  misc_feature: GYAE6OF02JSHMU.40.16.B05.1.454.CMB.1.raw
  modified_base (197)..(197): a, c, t, g, unknown or other
  misc_feature (197)..(197): n is a, c, g, or t
  modified_base (400)..(400): a, c, t, g, unknown or other
  misc_feature (400)..(400): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttacggagaccctaaccctcacctgcactgtctcgtggtnactccatcagcccgctactactgggattcggatccggccgtgtcccggacccggggccgacgggacggtcggtaggtgggtagttagggtcgggaccggttcgttaactcgtaccgaagtacggtaaaacccgaacggtaccggttaccaacttaccccccgttccccccgtccggtaacggaacggtttcccgtaacggttnacctaccgtaccgttaccgttaacgtaaccgtaacgtaaccgtaacccgtaacctaaaccgtaacgtaccgttaccgtttaccgttaccgtacggtacggtacggtacgtacgtcgttcgtaccggtacccggtacccggaccggaccgggtaccgggtaccggtaccgttaacgtttacggttacggtacggtacgggtaacggggtaccggggggtacccggggggtaaccggggtaacccggttaccggttacggttaccggttaccgttaccgttaccggttaccggttaccgggtaccgggtacccgggtaacccggttaccgggtaccggtacccgttacccgttacccgttaccgtaccgtacccgtacccgtacccggtacccggtacccggtacccggttacccggttacccgttacccccgttccggtcccggtccccgtccggtacccgttacccggacggtaccggtacccgtacccg

SEQ ID NO: 10920 - DNA, 947 bp, Homo sapiens
  misc_feature: GYAE6OF02G8GN3.40.16.B05.1.454.CMB.1.raw
  modified_base (195)..(195): a, c, t, g, unknown or other
  misc_feature (195)..(195): n is a, c, g, or t
  modified_base (320)..(320): a, c, t, g, unknown or other
  misc_feature (320)..(320): n is a, c, g, or t
tcagtctagcgactcacgaccggtgctcgatttagagctcacgtagggggcacaagaacatgaaacacctgtggttcttcctcctcctggtggtagctcccagatgggtcctgtcccaggtgcagcttcaggagtccgggcccaggactggtgaagccttcggagaccctaacctcacctgcactgtctctggtnactcatcacgccgctactacgtggagccgtggactccggctacggccccggaccggggcacggggactggggagtgggacgttcggggaccgtcggttactaacgtcaacgtagtacgaaacccnggtacctaacaccttccccccgttccgtacggacggtacggtaccgaacgttccaacccttattttccgaacgtacggaaccctaccggttacccaaactaaacgttccgtaacggttttcccgtacccgtagggaaccggtctttacgaacggttccttacgttaacgggttccgggaaccccggtcccgggtaccgggtaaacccgggtaccgggggttaccgtttaaacggtttaaccgttttaaaccgggttcggggtacggggtaaccggggtaaacgggggggtaacccgggggggggggtaacccgggggggtaaaacccgtttccgggtttaaccgggttaccggggttccccgttttacccggttttaacgggtaacccggttacccgggttaccggggggacccggttaaccgggggtaaaccccgtttccgggtaacccgtacccgggtttaccctttccccggttaccgacccgggttcccttaccccggaaaccggttaccgggggtacccccttaacggtttcccgggttacccccgtttcccgggtcccgggcccgtttaccccgccggtaccgttccggaaccgggtcccgtaccggacccgttacccggg

SEQ ID NO: 10921 - DNA, 838 bp, Homo sapiens
  misc_feature: GYAE6OF02GBWFA.40.16.B05.1.454.CMB.1.raw
  modified_base (177)..(177): a, c, t, g, unknown or other
  misc_feature (177)..(177): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccagggactggtgaagccttcggagacccctaacccncacctgcactgtctctggtgactcatcagccgcttaactcgtgggagctggacgtcccggctcggccccggccgggcaaggggtacctggggagtcggagttgggggccgcgtctagtccaacgaggtacgaaaccagactacaccttccccccgtccgacgaggtacgtccgtagtaccaaccttatttccgaactaagacctaccgtaccgaaaacctaaacttcgaacggtttcgtaccctggtacgggtcctaggacgcttactacgggtaccgacccgggcccggtagggaacccgtaaccgggggtccgtttaaagtttaaaccttaccggttaggtggaaccggggtaaggggggaaccgggggggggaacccgggggggtaaaacccttccgggttaacggtacccggggtttacctttacccgtttttacgaacccgggtttacggggttaaccgggggcccgtaaaacccgggggtacccgttcggggttaaccctacccgggttcccacccggtttcgaacccgttccccgtaacccgtaacccggaaccgggtcccccgtaaggttaccccgggtttcccctaccccggtccggtaccccgttacccgtcggtacccgttacccggaacgggtaccgccctaacccggg

SEQ ID NO: 10922 - DNA, 684 bp, Homo sapiens
  misc_feature: GYAE6OF02H70ZY.40.16.B05.1.454.CMB.1.raw
  modified_base (271)..(271): a, c, t, g, unknown or other
  misc_feature (271)..(271): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttcggagaccctaacctcacctgcactgtctctggtgactccatcagccgctactacgtggagctggactccggctcgccccggccgggcgagggactggagtggagttgggcncgtctagtcaacgagtacgaaaccagcctaacactcccccctcctacggaagacgtccggactccaacctattttacgacttaacgactaccgtaccaacaaatcaacgttctccgtagcgctgagtctcgtgtccggaccgccggacggacacgggtacgtattacgttacgtggcgcggaaggggacgggggggaccgggggtaaactccgttaagtcggtcttacgttagtacgtaacggtcgggaccgtaaccggggaaccttcgggacctaccggttccttccgtacgaccgtacctacccgaaccgtaccgggtaccctacggtttacccggttcccttaccccccggtcggtaccccggtcccgttcggtacccttccgggaacggttaccggcccgtaaccccgg

SEQ ID NO: 10923 - DNA, 751 bp, Homo sapiens
  misc_feature: GYAE6OF02IAKOM.40.16.B05.1.454.CMB.1.raw
  modified_base (647)..(647): a, c, t, g, unknown or other
  misc_feature (647)..(647): n is a, c, g, or t
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccagggactggtgaagccttcggagacccctaaccctcacctgcactgtctctggtgactccatcgagccgtctactacgtggagctggactccggctccggcccggccgggacgacggggacgtgggaggtcggtagttcgggcgtccgtctacgtcaacgagtacgaaaccgatcctaaccacccgttccccccgttccgtacggtaacggtaacggtcggaccgtcctaaccgttacttttaccaactacgaacctaccgtaccaacaaactacgtacgttctccgtaggaggtccgttgaccgtcctagtcggtaccgacccggccgggtcgggaccgaacgggtcttaactacgtttagtgggtacggacgggaacggggggacgggggggtaacccggggtaacttccgacggtccggttccgtttaccgtttagggaaccgttcgggcggggaccgtaaaccggggtaccctcgggtaccgtacccgtccttacgacccncgtacccaccgaacccggacggtaccccgtcggtccccgtttccccgtacccggtccgccccttcccggacgtcccgacggaccggtacccggccctacccggg

SEQ ID NO: 10924 - DNA, 837 bp, Homo sapiens
  misc_feature: GYAE6OF02HE2ZL.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcagggagtccgggccaggactgggtagaacgtcttcggacgacccctaaccctctacctgccactcgtctctggtgactcatcgagccgtactactacgtggacgcgtggacgtccggctccggcccggccgggcgagggacgtgggtaggtggaggttcgggcgtcgtactacgtcacgacgtacaaaccgagtaccactaccctcccctacccgtcggtaacgccgtcgtaacgtcctaacctagtttacaacgtaacgaccgttaaccgtaccctaaaacttaaacgcgttaacggttttccgaaaccccggttggtacggtcccgtaaggaccgttccttaccggtcgtaccggggaacccgtcccgggaacggaccgggttaccgtacgtttactacggttttaccggggtacgggacggggtacggggggaccgggggtaaccggttaacttcggtacggtccgttaccgtaccggttaggtaaccgtaccgggtacggggaacccgtaccggggtacccgtcggttaaccccgtcccgttacccgttaccggacctaacccgggtaacccgttacccgaaccccggggtacggtccccgttcccgggtaccccgttttcccccgtaccccggggttacccggtacccgtcccccggtttacgccccggttaccgggtaacgtacccggtacccggtacccgg

SEQ ID NO: 10925 - DNA, 990 bp, Homo sapiens
  misc_feature: GYAE6OF02GB0E3.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcggcccaggactggtgaagtccttcggacgacccctaaccctcacctgcacgtgtctcgtggtcacctccatccagccgtctactacgtggacgctacgggactcccggcctccggccccgggaccggacgaacggggaccgtgggaggtcggggtcggttgggggaccgtggttccttagtaccgacgtaaggtaccgaaaaccctcggaccttaaccgaccccttccccccgtacccgtacggtaacggtacgtcccgtaacggtaccctaaaccgttaacgttttacccgaaccttaacggtaccccgtaaaccggttaccctaaaaaccgtaaacgtttccgtaacgggttttaccggttccccttaacggggaaccgggtttcctaacggggtcggttaccctttcggtacccggggttacccggtaacccccggggcccgggtaaccgggaaccggggttaaccccggggtttattaaactttttaaccgtaaccgggtttcggacgggggtaccgggtaaaaggggggggtacccggggggggggtaaaccccgggggaaaacctttttccggtaaaccgggttcccgggtttaaccgttacccggttttacgtaaaccccggggttcgggtaccggggtaaccccggaacggggttaaccccgtccgggttaaccgtaccccgtcgttacccgtacgtaccccgtcctaaccccggtaccgtaacccgggccttacccccgggttacccgttttaccccccgtcccccgggtttcggaccccccgttccctacccgggggtttacccaccccgggggactttacccccgggacccttaacccccggg

SEQ ID NO: 10926 - DNA, 894 bp, Homo sapiens
  misc_feature: GYAE6OF02HI7S2.40.16.B05.1.454.CMB.1.raw
tcagtctagcgactcacgaccggtgctcgatttagagctcacgtagggggcacaagaacatgaaacacctgtggttcttcctcctcctggtggcagctcccagatgggtcctgtcccaggtgcagcttcaggagtcgggcccaggactggtgaagccttacggagaccctaaccctcacctgcactgtctctggtcgacctccatcgagcccgcgtaactacgtgggaacgtctgggacctcccggcgtccggccccgggccgggacgaggggaccgtggggacgttgggaggttcggggaccgttcgtactagtaccaagacggtaacgaaaacccgtggtacctaaccaccccttccccctaccgacggaacgttacggaccgtacgtacctaccttaatttccgaaacgttacaaccgtaacccgtaccaaaacgtaaccttacgtacggttcctttacccggaggtaccgggttcaacggtccgtaccgttcgtacgggtacccggaccggtccccgggtaggaaccggtacggggttacgtaaattaacggtttacggtacggttacgggacgggggtaacggggggtaacccgggggggggtaacccggggttaaactccgggttaaacgggtccgggttacgttttcccgggtttaacgaacccgggtttcccggggtaaccggggacccgggttaaccggggtaaccccgggtttcggggtaaccccttacccggttaccgtcccggtacctaccggttaccccgaccgaacccgggacggtacccgtccgggttttcccccggacccttccccggggtaaccgttccccgcccggtttacgggcccccttaacggggaacccggttacccaccccgtaacccggg

SEQ ID NO: 10927 - DNA, 555 bp, Homo sapiens
  misc_feature: GYAE6OF01EZKK5.2.87.H10.1.454.CMB.1.raw
  modified_base (524)..(524): a, c, t, g, unknown or other
  misc_feature (524)..(524): n is a, c, g, or t
tcagacgctcgacacacgaccggtgctcgatttagcagtactgcgttgggtttgggggagtcagtctcagtcaggacacagcatggacatgaggtccccgctcagctcctgggctcctgctactctggctccgaggtgccagatgtgacatcccggtgacccagtctcctccctccctgtctgcttctgttggagacagagtcaccatcacttgccggtcaagtcagagtatttacaccttatttaaattggtatcagcaaaaaaccagggaaagccctaaggctcctcctctactctgcaagcagcttgcatgctggggtcccatcaagattccgtggcagtggatcgtggacagaattcaactctcacgatcaccagtctggaacctgacgtactttgacctaactttacttctgtacaaaactagttaaccaccctacccccgtaataaacctttcggaccctaggggaccctacggtggaagataccaaaacgaactggtacggctggaccaccgattcncgttcctttcaacttccttccccgcctaacg

SEQ ID NO: 10928 - DNA, 556 bp, Homo sapiens
  misc_feature: GYAE6OF01C5PYP.2.87.H10.1.454.CMB.1.raw
  modified_base (273)..(273): a, c, t, g, unknown or other
  misc_feature (273)..(273): n is a, c, g, or t
  modified_base (346)..(346): a, c, t, g, unknown or other
  misc_feature (346)..(346): n is a, c, g, or t
  modified_base (523)..(523): a, c, t, g, unknown or other
  misc_feature (523)..(523): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctgcttctgttggagacagagtcaccatcacttgccggtcaagtcagagtattacacttatttaaatgtatcagacaaaaacaggaacnccctagctcctctctactctgacaagcagcttgcatcgcgtgggtcccatcaagtcttcgtgcaggtgatcgngggacagtacttcactctacgacgactacacctagtacctacggaaaccctggtaaccgttactttacgacttaaccttacttctagtaacaaaactcgttaaccaccctacccgtaataaccgttcggaccgtagggaccaggtagacgactaacgaacgtactgcgtactgaccnctatcgtcttaccttcactcccttcccgctacg

SEQ ID NO: 10929 - DNA, 561 bp, Homo sapiens
  misc_feature: GYAE6OF01CUA35.2.87.H10.1.454.CMB.1.raw
  modified_base (223)..(223): a, c, t, g, unknown or other
  misc_feature (223)..(223): n is a, c, g, or t
  modified_base (274)..(274): a, c, t, g, unknown or other
  misc_feature (274)..(274): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctgcttctgttggagacagagtcaccatcacttgccgtnaagtcagatattacacttattaaattggtatcagacaaaaaccaggaaacnccctaggctcctcctctactctgacaagcagcttgcatgcgtcggggtcccagtccaagtacttccggtggcaggtggatcgtaggggacagtaattcaactctacacgatcaccagtctaggaacctgtacgtactttgactaactttacttactacgtaactaaaaccacgttaaccacccttccccgtaactaaccgtttcggacccgtaacggggaccaggtacggagaactacaaaccgactgcgctagcaccatctgtccttacacttcctcccgtctacg

SEQ ID NO: 10930 - DNA, 529 bp, Homo sapiens
  misc_feature: GYAE6OF01D83S7.2.87.H10.1.454.CMB.1.raw
  modified_base (269)..(269): a, c, t, g, unknown or other
  misc_feature (269)..(269): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctattaaatggtatcagcaaaacaggaanccctagctctcctctactctgcaagcagcttgcatgctggggtcccatcaagacttccgtggcagtggatcgtgggacagattcactctcacgatcaccagtctggaacctgacgtactttgactaactttacttctagtacaaaactacgttaaccacccttaccccgtaactaaccgtttcggaccgtacggggacccacgggtggagactacgaaacgactgtcggctgccacatctgtcttacattcctcccgcta

SEQ ID NO: 10931 - DNA, 645 bp, Homo sapiens
  misc_feature: GYAE6OF01DOBUM.2.87.H10.1.454.CMB.1.raw
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctgcttctgttggagacagatccaccatccacttcgccggtacaagtcaagtagttatttaccacttaatttaaattggtaatcaagacaaaaacgagggaaacgccctaaggcctcctcctctactctgacaagcagtcttgcatcgcgtcggggtaccccagtaccaaggtacttccggtggactaggtggatcggtagggacaagtactcaactctacacgactccacctagtcctacggaacctgtaacgtactttcgaacttaacgtttacttacgtacgtaacctaaacgtacgttaacctaccccgttaccccgttaactaaccggtttccggacccgtaacggggtaccctacggggtacggtaacgaacgtaaccaaacggtacgttggtacggtctacgaccctaccgtaacttcgtacgttccttactaacctcccgttcccgcttaacg

SEQ ID NO: 10932 - DNA, 578 bp, Homo sapiens
  misc_feature: GYAE6OF01ACC55.2.87.H10.1.454.CMB.1.raw
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccgtcaagtcagagtatttacaccttatttaaattggtatcagacaaaaaccagggaaagccctaggctcctcctctactctgcaagcagcttgcatgctggggtccccatcaagattccgtgacagtggatcgtgggacagaacttcactctcacgatcaccagtctggaacctgacgtactttgacctaacttacttctagtacaaactagttaaccacctaccccgtaactaaccgtttcggaccgtaggggaccctacgggtacggagacgttaccgaaaacgtaacgtcggtacggtaccgtcgacctaacccgtacttccttcgttcctttaccattccctttccccgaccttacg

SEQ ID NO: 10933 - DNA, 573 bp, Homo sapiens
  misc_feature: GYAE6OF01AM1XU.2.87.H10.1.454.CMB.1.raw
  modified_base (275)..(275): a, c, t, g, unknown or other
  misc_feature (275)..(275): n is a, c, g, or t
tcagacgctcgacacacgaccggtgctcgatttagcagtactgcgttgggtttgggggagtcagtctcagtcaggacacagcatgaacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacttatttaattggtatcagacaaaaccagggaaacnccctaggctcctcctctactctgcaagcagcttgcatgcgtcgggtcccatcaagcttccgtggctagtggatcgtgggacagtacttcactctcacgactcaccgtagtctacggaacctgaacgtactttgactaacttacttctacgtacaaactgttaaccacccttacccgtactaacgtttcggaccgtacggggacctacgggtggaacgaacgtaccgaaacgtacgtcggtacggtcctgacccacgtactccgttcgttccttactacttccccgttcccgccttacg

SEQ ID NO: 10934 - DNA, 576 bp, Homo sapiens
  misc_feature: GYAE6OF01EFB4X.2.87.H10.1.454.CMB.1.raw
  modified_base (275)..(275): a, c, t, g, unknown or other
  misc_feature (275)..(275): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagacaaaaaccaggaaanccctaggctcctcctctactctgcaagcagcttgcatgctgggtcccatcaagattccgtggcagtggatcgtgggacagaattcactctcacgatcaccagtctaggaacctgacgtactttgacctaactttacttctagtaccaaaactcgtttaacccacccttaccccgtaactaaccgttttcgggacccgtaacgggggtacccacgggttaggagtaactaccgaaaaccggtactaggtggtacctggaccacctatccttacgttccttacacttcccttccccgctaacg

SEQ ID NO: 10935 - DNA, 593 bp, Homo sapiens
  misc_feature: GYAE6OF01BC1WY.2.87.H10.1.454.CMB.1.raw
  modified_base (326)..(326): a, c, t, g, unknown or other
  misc_feature (326)..(326): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctcctgtctgcttctgttggagacagagtcaccatcacttgccggtcaagtcagagtatttacacctatttaaattggtatcagacaaaaaccaggaaagccctagctcctcctctactctgcaagcagcttgcatgctgggtccatcaagntccgtgcagtgatcgtgggacagaatcactctcacgatcacagtctaggaacctgacgtactttgactaacttacttctgtaacaaatcgttaaccacccttacccgaactaaccgtttggacccgtagggggacctacgggtaggaacgtaacgtaaccgaaaaccggtacgtacggtacgggccttacgggacctaaccccgaagtttacccgttacggtttacccctttaccaaacctttccccgtttacccccgcccgttaac

SEQ ID NO: 10936 - DNA, 556 bp, Homo sapiens
  misc_feature: GYAE6OF01CI8JB.2.87.H10.1.454.CMB.1.raw
  modified_base (222)..(222): a, c, t, g, unknown or other
  misc_feature (222)..(222): n is a, c, g, or t
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (433)..(433): a, c, t, g, unknown or other
  misc_feature (433)..(433): n is a, c, g, or t
tcagacgctcgacacacgaccggtgctcgatttagcagtactgcgttgggtttgggggagtcagtctcagtcaggacacagcatggacatgaggtccccgctcagctcctggggctcctgctactctggctccgaggtgccagatgtgacatcccggtgacccagtcctcctccctcctgtctgcttctgttggagacagagtccaccatcacttgccggtnaagtcagatattacacttattaaatgtatcagacaaaaacgaggaaacgccctaggctcctcctctactctgcagcagcttgcatgcgtcgggtcccagtcaagtacgttcgnggtacaggtggactcgtggganaagaattcgaactctacacgataccaccagtctaggaacctgacgtacttcgacaactttactctagtacaaaacncgttaacaccctccgtaactaacgttggaccgagggaccacggtcggaatactaacgaaacgacgttacgtcgcgtagacctacctacgttcctcgtcttacgaacttccttacccgcttacg

SEQ ID NO: 10937 - DNA, 524 bp, Homo sapiens
  misc_feature: GYAE6OF01B4SRG.2.87.H10.1.454.CMB.1.raw
  modified_base (273)..(273): a, c, t, g, unknown or other
  misc_feature (273)..(273): n is a, c, g, or t
  modified_base (475)..(475): a, c, t, g, unknown or other
  misc_feature (475)..(475): n is a, c, g, or t
  modified_base (499)..(499): a, c, t, g, unknown or other
  misc_feature (499)..(499): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtattacactatttaaattggtatcagcaaaaaccagggaaanccctaggcctcctcctctactctgcaagcagcttgcatgctggggtcccatcaagacttccgtggcagtggatcgtgggacagaattcactctcacgatcaccagtctaggaacctgacgtactttgactaactttcttctgtacaaaactgttaaccaccctcccgtaactaactttcggacctaggggaccagggtgganagtaccaaagactgtgctgccacntctgtcttacatccttcccgctacg

SEQ ID NO: 10938 - DNA, 603 bp, Homo sapiens
  misc_feature: GYAE6OF01AH50M.2.87.H10.1.454.CMB.1.raw
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctccctccctccctgtctgcttctgttggagacagagtcaccatcacttgccggtcaagtcagagtatttacactatttaaatggtatcagacaaaaaccgaggaacgccctaggcctcctcctctactctgcaagcagcttgcatgctgggtcccatcaagacttccgtgcaggtggatcgtgggacagtaacttcactctcacgatcaccgagtctaggaacctgaccgtacttcgactaacttacttctagtacaaaacgtcgttaccacccttaccccgtactaacgtttcggaccgtaacggggtaccaacgggtaggaacgactaaccgaaaccgtaaacgtggtacgggtccttacggacctaacccgtacgttccgttacggtttaccctttaccgaaccttttccccgttcccccggtccttaaccg

SEQ ID NO: 10939 - DNA, 630 bp, Homo sapiens
  misc_feature: GYAE6OF01CWZ4Q.2.87.H10.1.454.CMB.1.raw
  modified_base (270)..(270): a, c, t, g, unknown or other
  misc_feature (270)..(270): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgttacatcccggtgacccagtctcctccctccctgtctgcttctgttggagacagagtcaccatcacttgccggtcaagtcagagtattacactatttaaatgtatcagcaaaaacagggaaancccctaggctcctcctctactctgcaagcagcttgcatgctggggtcccatcaagacttccgtggcagtggatcgtgggacagtaatcactctcacgatcacctagtctcggaacctgacgtactttgactaactttacttctagtaccaaaactcgtttaaccacccttaccccgtaactaaccgttttcgggacccgtaacggggggtacccgtaacggggtacggtaacggtacttaaccgaaaaaccggtaaccgttagggtacgggaccgttcgggaccctaaccccgtagttcccgttacggtttaccctttaccgtaactttcccgtttacccccggccttaactttacccgg

SEQ ID NO: 10940 - DNA, 581 bp, Homo sapiens
  misc_feature: GYAE6OF01AKNAN.2.87.H10.1.454.CMB.1.raw
  modified_base (196)..(196): a, c, t, g, unknown or other
  misc_feature (196)..(196): n is a, c, g, or t
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacatcccggtgacccagtctcctccctccctgtctgcttctgttgganacagagtcaccatcacttgccgtcaagtcagatatttacaccttatttaaattggtatcagacaaaaccaggaagccctaggctacctcctctactctgcaagcagcttgcatgctgggtcccatcaacgattccgtggcagtggactcgtacgggacagtattcactctcacgatccacctagtcctaggaacctgaccgtacttgacctaacttacttctgtacaaaactcgttaaccacccttaccccgtactaaccgtttggacccgtacgggaccacgggttcggagtacgtaccgaaacgtacgtaggttccggcgtacgacctaacctacgttaccttcgttacctttacgtaacttccccgtttccccgcttaaccg

SEQ ID NO: 10941 - DNA, 611 bp, Homo sapiens
  misc_feature: GYAE6OF01BIICV.2.87.H10.1.454.CMB.1.raw
tcagacgctcgacacacgaccggtgctcgatttagcagtactgcgttgggtttgggggagtcagtctcagtcaggacacagcatggacatgaggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagcaaaaaccagggaaagccctaggctcctcctctactctgcaagcagcttgcatgctggggtcccatcaagacttccgtggcagtggatcgtgggacagtaattcactctcacgatccaccagtcctaggaacctgacgtactttgactaactttcttctagttacaaaactacgtttaaccacccttaccccgtaacctaaccgttttcgggacccgtaacgggggaaccctacggggttagggaacgtaactaccgaaaaaccggtaaccgtggttacggccgttaggacccaacccgtaattcccttacggttacctttaccacctttccctttcccccggtccttaaccg

SEQ ID NO: 10942 - DNA, 614 bp, Homo sapiens
  misc_feature: GYAE6OF01EC9JL.2.87.H10.1.454.CMB.1.raw
  modified_base (222)..(222): a, c, t, g, unknown or other
  misc_feature (222)..(222): n is a, c, g, or t
  modified_base (264)..(264): a, c, t, g, unknown or other
  misc_feature (264)..(264): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtnaagtcagagtatttacactatttaaatgtatcagacaaaacnggaaagccctaggctcctctctactctgcaagcagcttgcatgctgggtcccagtcaagtacttccgtggcagtggatcgtagggacagtaacttccaacttcctcgaacgatccgaacctagtctacggaacctgacgtactttgaccttaacttacttctagtaccaaaacgtcgtttaaccaccccttacccgtaactaaccgttttacgggaccgtaaccggggtaacctacggggtaggacgtaacgttaaaccgaaaacgtaaccgttgggtacggtcctaggtcccaaacttcttaccgttcgtttaaccttccgtaactttcccgtttccccgccgttaacg

SEQ ID NO: 10943 - DNA, 826 bp, Homo sapiens
  misc_feature: GYAE6OF01A3VQC.2.87.H10.1.454.CMB.1.raw
  modified_base (159)..(159): a, c, t, g, unknown or other
  misc_feature (159)..(159): n is a, c, g, or t
  modified_base (810)..(810): a, c, t, g, unknown or other
  misc_feature (810)..(810): n is a, c, g, or t
tcagacgctcgacacacgaccggtgctcgatttagcagtactgcgttgggtttggggaggtcgagtctcagtcaggacacagcatggacatgaggtcccgcctcagctcctgggctcctgctactctggctccgaggtgccagatgtgacatcccggtnacccagtcctcctcctccctgtctgcttctgttggacacagacgtcaccagtcaccgttgggaccgtactaagtcgaagtacgttatttaccaaccttaagttttaaaatttggtaattctaagtaaccgtaaaaaaaccgtaggggaaaaccgtaccccgttaagggaccttacccgtaccccttacttaaccgttccgtacggtaacccaaacggtaccgacggtacctttaggacctaacgttacggccgttaaccgggggttccccaaagttaccggaaacgttacggtttacccggttcgggaaccgttagggtacgggtactttacccggtagggggtaaacctaaacgttaactttacccggtaacctttaccgtaccgtaacgtaacctaccgtaaacccgtagttccgttaaccgggaaaccccttagggtaaacccgttaacccgttttcgaacccgttaaacttttttaccccgtattaaccggtaacctaaaaaaaccgttccggttttaaaccaacccccgttttacccggtaacttaaaccgggtttcgggaaccccgtacgggggaccttaacgggagttaacgacttaacggaaaccgttcgtagtccgggatcgaccatacgtctgttcctatntacccgtcccgtatcg

SEQ ID NO: 10944 - DNA, 548 bp, Homo sapiens
  misc_feature: GYAE6OF01B02FE.2.87.H10.1.454.CMB.1.raw
  modified_base (275)..(275): a, c, t, g, unknown or other
  misc_feature (275)..(275): n is a, c, g, or t
  modified_base (506)..(506): a, c, t, g, unknown or other
  misc_feature (506)..(506): n is a, c, g, or t
  modified_base (524)..(524): a, c, t, g, unknown or other
  misc_feature (524)..(524): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacagtcccggtgacccagtcctccctccctccctgtctgcttctgttggagacagagtcaccatcacttgccggtcaagtcagagtattacacttatttaaattgtatcagacaaaaacaggaaanccctaaggctacctcctctactctgcaagcagcttgcatgcgtcggggtacccattaccaagtacttccggtggacaggtggattcgtagggacagaacttcactctcacgatccacagtctagacctagacgtactttcgacaacttacttctacgtacaaaactagttacaccttacccgtacaacgtttcggaccaggggaccacggtaggacatacaaacgacttgnggtctgaccacatccttntccttcattcccttcccgcgttac

SEQ ID NO: 10945 - DNA, 584 bp, Homo sapiens
  misc_feature: GYAE6OF01A37L2.2.87.H10.1.454.CMB.1.raw
  modified_base (279)..(279): a, c, t, g, unknown or other
  misc_feature (279)..(279): n is a, c, g, or t
  modified_base (451)..(451): a, c, t, g, unknown or other
  misc_feature (451)..(451): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagttatttacaccttaatttaaattggtatcagacaaaaacagggaaacnccctaggctcctcctctactctgcaagcagcttgcatgcgtgggtcccatcaagtattccgtggcaggtggatcgtgggacagtaacttcgactctcacgatcacagtctacggacctgacgtactttgactaacttacttctagtacaaactcgttaccacctcccgtaanaccgtttcggaccgtaaggggaccctacgggtaggaagtacgtaccgaaaacggtacgtaggtcggtacctggaccctaaccgagttcccgttcgttacccttacaacctttccccgttcccgtcccttaacg

SEQ ID NO: 10946 - DNA, 611 bp, Homo sapiens
  misc_feature: GYAE6OF01A7X47.2.87.H10.1.454.CMB.1.raw
  modified_base (268)..(268): a, c, t, g, unknown or other
  misc_feature (268)..(268): n is a, c, g, or t
  modified_base (333)..(333): a, c, t, g, unknown or other
  misc_feature (333)..(333): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccgtcaagtcagagtattacaccttattaatgtatcagacaaaacaggaacnccctagctcctcctctactctgcaagcagcttgcatgcgtcgggtcccatacaagtacgttccgnggcaggtggagtcgtgggacaagtattcgactctacacgtatccaacctagtcgtagaaccctgtaacgtacttgacctaactttacttctagtaacaaactacgttacccacccttacccgtaactaaccgtttcggacccgtaacggggtaccgtacgggtaggaacgtaacgtaaccgaaaaccggtacgttcggtacggtacctacggacctacccgtacgttccgttcgtttaccttaccctaccgtttccccgttacccccgtccttaaccg

SEQ ID NO: 10947 - DNA, 624 bp, Homo sapiens
  misc_feature: GYAE6OF01A57XL.2.87.H10.1.454.CMB.1.raw
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagcaaaaaccaggaaagccctaggctcctcctctactctgcaagcagcttgcatgctggggtcccatcaagattccgtggcagtggatcgtgggacagattcactctcacgatcacctagtcctaggaacccttgaaccgtactttacgcctaaactttactttactacgttaccaaaaacctacgtttaacccaaccccgttaccccgttaacctaaaccgttttcgggacccgtaacgggggtaccctaacggggttggaacgaactaccgaaaaccgtaacgtggtacggccttaggacctaacccagttcccttacgggttaccctttacctaacgtttcccctttcccccgtcccttaaccg

SEQ ID NO: 10948 - DNA, 756 bp, Homo sapiens
  misc_feature: GYAE6OF01BYLCJ.2.87.H10.1.454.CMB.1.raw
tcagacgctcgacacacgaccggtgctcgatttagcagtactgcgttgggtttgggggagtcagtctcagtcaggacacagcatggacatgaggtcccgctcagctcctggggctcctgctactctggctccgagatcgcagatgtcgacacgtcccggtcgacctacgtcctccctccctccgtgtctcgtcttcgttggttaggagacgagtacgtaccacctacgtacctacgttccggaccgtactaacgtacgaagtaagtttaactttaccaacttttaaattttaaagttggttaactaccgaacgtaaaaccgaaaaacggtaacggggaaacctccccgtaacggtcccttccctaccgttcctactcgtcgacgtaagccgagttcgtcgactagtcggacggttccgggtaccctaagtaccgaagttccgttcgggacgacgttgggagtacgttcgggaagggactaaagttaacctcgaccttcgtaacacgtacctaccgacgtacgttcggtaacgtacctacgtacttacgttacacttaactttactctaccgtaataaaccttcgtaccctacccgttaccgttaacgtacgttaccgggaacggtaccgggacctacgggagtacgtaactaaaccggtaacgtaaccggttcggtacggtaccgaccgtaacccgtaccttcggttaccgtccgtttacccttacccgttaacctttccccccgtacccggtacc

SEQ ID NO: 10949 - DNA, 559 bp, Homo sapiens
  misc_feature: GYAE6OF01CCM9B.2.87.H10.1.454.CMB.1.raw
  modified_base (272)..(272): a, c, t, g, unknown or other
  misc_feature (272)..(272): n is a, c, g, or t
  modified_base (300)..(300): a, c, t, g, unknown or other
  misc_feature (300)..(300): n is a, c, g, or t
  modified_base (531)..(531): a, c, t, g, unknown or other
  misc_feature (531)..(531): n is a, c, g, or t
  modified_base (539)..(539): a, c, t, g, unknown or other
  misc_feature (539)..(539): n is a, c, g, or t
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacatcccggtgacccagtcctcctccctccctgtctgcttctgttggagacagagtcaccatcacttgccggtcaagtcagtagttattacacttaattaatgtatcagacaaaacgaggaacncctaggctcctctctactctgcaagcancttgcagtgcgtcggggtcccagtacaacgtacttccggtgacgaggtggaactcggtacgggaactaagtaacttacgactcgtaccacgactaccaccgtagtcgtacgtaaccgtagaccgtacttacgtactaacttacttctacgtactaaactacgtacctaccctacccgtactaacttacgccgtaggacccccgaggtggagacgtacgaacgactgcgtcngcacactntctctcactcctccgctacg

SEQ ID NO: 10950 - DNA, 665 bp, Homo sapiens
  misc_feature: GYAE6OF01ACLMU.2.87.H10.1.454.CMB.1.raw
  modified_base (159)..(159): a, c, t, g, unknown or other
  misc_feature (159)..(159): n is a, c, g, or t
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
  modified_base (344)..(344): a, c, t, g, unknown or other
  misc_feature (344)..(344): n is a, c, g, or t
tcagacgctcgacacacgaccggtgctcgatttagcagtactgcgttgggtttgggggagtcagtctcagtcaggacacagcatggacatgaggtccccgctcagctcctggggctcctgctactctggctccgaggtgccagatgtgacatcccggtnacccagtcctccctccctccctgtctgtcttcgtgttcggagacagacgtcaccatcacttgccgtnaagtcagattattacacttattaattgtatcagacaaaacgaggaacncccgtaggcctcctctctactctgcagcagctgacatcgcgtcgggtacccagtacaagtacgttccggnggacctaggtacggtactcggtacgggtaacctaaggtaacttccaaccttccgtacgaacgtactacccgaacgtacgttccgtacggtaaccctcggtaaccgttaccttacggtaaccttaaccgttttacctaccgttacgtaacccgtaaaactttccgtttaaccccaccccgtttaaccccggtaaacttaccggtttacggacccggtaacgggtaccgtacgggtacggaactacgtaacccgaaacggtacgtcgtacggtctacgacctctacgtctacgttccttacaccgttccctccccgtattacg

SEQ ID NO: 10951 - DNA, 694 bp, Homo sapiens
  misc_feature: GYAE6OF01DEJJT.2.87.H10.1.454.CMB.1.raw
  modified_base (224)..(224): a, c, t, g, unknown or other
  misc_feature (224)..(224): n is a, c, g, or t
  modified_base (283)..(283): a, c, t, g, unknown or other
  misc_feature (283)..(283): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctcctccctcctgtctgcttctgttggagacagacgtcaccatcacttcgccggtnaagtcagtagttattacaccttatttaaattggtatcaagacaaaaaccgagggaaacncccgtaggcctcctcctctactctgacaacgcagtcttgactagtcgtcgtcggggtcccagtacaacgtacgttccggtggacctaggtacggtattcggtacgggaactaaggtacttaccgaaccttctaccgaacgtactaccctaacctggtacctacgggaaacccttggtaacccgttaacgtttacgaacctttaacctttaccgtttaccgttaacgtaaacctaaaacgttacgtttaacccctaaccccgttaacccgttaactaaccggtttaccggacccggtaacggggtaccgacgggtacggtaactaacgtaaccgaaacgtaccgtggtacggtcctacggtccaaccgtacttcgtccgtttcttacgtaccttaccccgtcccgactaccg

SEQ ID NO: 10952 - DNA, 566 bp, Homo sapiens
  misc_feature: GYAE6OF01BJQ1L.2.87.H10.1.454.CMB.1.raw
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagaaagagtcaccatcacttgccggtcaagtcagagtattacacttattaaattgtatcagcaaaaaccaggaagccctaggctcctcctctactctgcagcagcttgcatcgctggggtcccatcaagattccgtggcagtggatcgtggactagaacttcactctacacgtatccactagtctggaacctgacgtactttagactaacttcttactgtactaaactacttacctaccctccccgtaataccgtttcggaccgtaacggggtaccctaagggtcggaacgtactacgtaaaccgtaatcgtggacgtcggaccaccgtactcgttcgttactcctacttcccttacccgccgtattcccg

SEQ ID NO: 10953 - DNA, 582 bp, Homo sapiens
  misc_feature: GYAE6OF01A4OM2.2.87.H10.1.454.CMB.1.raw
  modified_base (272)..(272): a, c, t, g, unknown or other
  misc_feature (272)..(272): n is a, c, g, or t
tcagacgctcgacacacgaccggtgctcgatttagcagtactgcgttgggtttgggggagtcagtctcagtcaggacacagcatggacatgaggtccccgctcagctcctggggctcctgctactctggctccgaggtgccagatgtgacatcccggtgacccagtctcctccctccctgtctgcttctgttggagacagagtcaccatcacttgccggtacaagtcagagttattacaccttattaatggtatcagacaaaacgaggaacnccctaggcctcctcctctactctgcagcagctgctatgcgtcgggtcccatacgaacgtcgttccgtgacaggtgactcgtaggaactagtactcactctacacgtactaccaccgtacgtacgtacgaacctagaccgtacttcgtacctaactttacttctacgtaaccaaactacttaccaccccttacccgtaacttacgttcggaccgtaccgggaccgtacggagacgtactacgaaacgtacgtaggtacgtctagacctacctaacgttcctacgttcttacctactccttaccccgctacg

SEQ ID NO: 10954 - DNA, 541 bp, Homo sapiens
  misc_feature: GYAE6OF01ELM26.2.87.H10.1.454.CMB.1.raw
  modified_base (269)..(269): a, c, t, g, unknown or other
  misc_feature (269)..(269): n is a, c, g, or t
  modified_base (327)..(327): a, c, t, g, unknown or other
  misc_feature (327)..(327): n is a, c, g, or t
  modified_base (333)..(333): a, c, t, g, unknown or other
  misc_feature (333)..(333): n is a, c, g, or t
  modified_base (507)..(507): a, c, t, g, unknown or other
  misc_feature (507)..(507): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctcctgtctgcttctgttggagacagagtcaccatcacttgccggtcaagtcagatattacacttattaattggtatcagacaaaaccaggaacnccctaggctcctcctctactctgcaagcagcttgcatgcgtcgggtcccatcaacgtnttccgnggcagtggatcgtagggacagtactcactctcacgtactcacctagtcctaggaaccctgacgtactttgacctaactttcttctgtacaaactcttaccaccctcctaactacgttcgccgtaacgggacctacgggtgagtactaacgaaacgtacgtggtacggctgaccncctattctacgttcttcactttcctcccgctacg

SEQ ID NO: 10955 - DNA, 603 bp, Homo sapiens
  misc_feature: GYAE6OF01DDZFZ.2.87.H10.1.454.CMB.1.raw
tcagacgctcgacacacgaccggtgctcgatttagcagtactgcgttgggtttggggggagtcagtctcagtcaggacacagcatggacatgagggtccccgctcagctcctggggctcctgctactctggctccggaggtgccagatgtgacactcccggtgacccagtcctccctccctccctgtctgtcttctggttggagacagagtccacctatcctacttcggccggtacaagtcaagtagttattaccacttatttaattggtatcagacaaaaacgaggaaacgccctaggcctcctctactactctcgcaagcagtcttgcagtgcgtcggggtcccagtcaagtgttccgtggctaggtgactcgtagggactagtactcaactctacacgtactccaacctagtcctacggaccgtgtacgtacttgactaacttcttactacgtaacctaaacttactacctaccctacccgtaactaaccgtttcgggaccgtacgggaccgtacggtagacgtactaacgaacgtacgtggtcggataccgtacaccctatccgttcgttaccttacacctttccctcccgtcgtaccg

SEQ ID NO: 10956 - DNA, 651 bp, Homo sapiens
  misc_feature: GYAE6OF01DCP9E.2.87.H10.1.454.CMB.1.raw
  modified_base (162)..(162): a, c, t, g, unknown or other
  misc_feature (162)..(162): n is a, c, g, or t
  modified_base (282)..(282): a, c, t, g, unknown or other
  misc_feature (282)..(282): n is a, c, g, or t
  modified_base (351)..(351): a, c, t, g, unknown or other
  misc_feature (351)..(351): n is a, c, g, or t
  modified_base (645)..(645): a, c, t, g, unknown or other
  misc_feature (645)..(645): n is a, c, g, or t
tcagacgctcgacacacgaccggtgctcgatttagcagtactgcgttggggtttgggggagtcagtctcagtcaggacacagcatggacatgagggtccccgctcagctcctggggctcctgctactctggctccgaggtgccagatgtgacatccccggtnacccagtcctccctccctccctgtctgtcttctggttggagacagatcaccatcacttgccggtcaagtcagtagtattacacttaatttaaattgtatcagaacaaaaacgaggaaacnccctaaggcctcctcctactactctgcaagcagcctgcatgcgtcgggtacccatcaagtacttccggnggcgtaggtggatcgtagggactaagacttcaactctacacgtactccaaccgtagttaccgtacggaaacccttggaaccgttacttttcgaactaactttaccttactacgtaaactaaaactacgtttaacccacccgttaacccctaacgtaacccgttttgggaccccgaaacgggggtaaccctacggggtacggaaagtaaccgttaacgaaaaccggtaccgtaggtcccgggattaccgggaccaccctattccgttctaccttacaaccgtttccctcccccgnttaacc

SEQ ID NO: 10957 - DNA, 523 bp, Homo sapiens
  misc_feature: GYAE6OF01EIMIB.2.87.H10.1.454.CMB.1.raw
  modified_base (281)..(281): a, c, t, g, unknown or other
  misc_feature (281)..(281): n is a, c, g, or t
  modified_base (345)..(345): a, c, t, g, unknown or other
  misc_feature (345)..(345): n is a, c, g, or t
  modified_base (521)..(523): a, c, t, g, unknown or other
  misc_feature (521)..(523): n is a, c, g, or t
tcagacgctcgacacacgaccggtgctcgatttagcagtactgcgttgggtttgggggagtcagtctcagtcaggacacagcatggacatgagggtcccgctcagctcctggggctcctgctactctggctccgaggtgccagatgtgacatcccggtgacccagtcctccctccctccctgtctgctttctgttggagacagagtccaaccatcacttggccgtcaagtcagtatatttacaccttatttaaattggtatcaagacaaaaacgaggaacnccctaggctcctcctctactctgacaagcagcttgcatgcgtgggtcccaatcaagtcttccgnggacagtgactcgtaggacaagtaatcaactcacgacactacacctacgtctacgaactcgacgtacttacgtacctaacttacttactactactaaactactaacctaccctacccgtacctaacgttcgaccgtacgggaccgtacggagagactacgaaacgacgtacggtannn

SEQ ID NO: 10958 - DNA, 540 bp, Homo sapiens
  misc_feature: GYAE6OF01EYPQL.2.87.H10.1.454.CMB.1.raw
  modified_base (200)..(200): a, c, t, g, unknown or other
  misc_feature (200)..(200): n is a, c, g, or t
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacngagtcaccatcacttgccgtnaagtcagatattacactatttaatgtatcagacaaaacaggaacnccctaggctcctctctactctgcagcagcttgcatgcgtcgggtcccatcaagtgttccgtgcagtggagtcgtagggacagtactctactctcacgtactccactacgtcgtagaaccgtgaacgtacttgacctaacttactactcgtaacaaactcttacctacccgtacccgtaacgtaaccgttcggacgtacgggccgtacggtcgaagcctaacgaaacgacgtgtagctagactcattctcgtcctactacttccctccgtctacg

SEQ ID NO: 10959 - DNA, 676 bp, Homo sapiens
  misc_feature: GYAE6OF01A6YLP.2.87.H10.1.454.CMB.1.raw
  modified_base (160)..(160): a, c, t, g, unknown or other
  misc_feature (160)..(160): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
  modified_base (273)..(273): a, c, t, g, unknown or other
  misc_feature (273)..(273): n is a, c, g, or t
tcagacgctcgacacacgaccggtgctcgatttagcagtactgcgttggggtttgggggagtcagtctcagtcaggacacagcatggacatgaggtccccgctcagctcctggggctcctgctactctggctccgaggtgccagatgtgacatcccggtnacccagtctccctccctccctgtcctgtcttcgtgttgganacagacgtcaccatcacttgccgtnaagtcagtatattacacttattaatgtatcagacaaaacgaggaacncccgtaggctcctcctcgtactctgactagcagcttgactgtagcgtccgggtcctagtacgtaagtacgttccgtggtactaggtcggacttccggtagggaacaaggtaacttccgtaaccttcctaccgtaacggtactacccgtaaccgtacggttaccgtacgggaaacccttgtaaccggtacctttacggtaaccttaaccgtttaccgttacctacgtaacctaaaaccgtcgttaacccaccccgttacccgtaacgttaaccgttcggaccggtaacgggcccgtagggtacgagtaacgtaaccgtaaacggtccgttacgggtacgcgttaccgacctaaccgtcttaccgtacttaccgttcaacccgtttccctcccggtaccttacgg

SEQ ID NO: 10960 - DNA, 674 bp, Homo sapiens
  misc_feature: GYAE6OF01B3MEN.2.87.H10.1.454.CMB.1.raw
  modified_base (288)..(288): a, c, t, g, unknown or other
  misc_feature (288)..(288): n is a, c, g, or t
  modified_base (305)..(305): a, c, t, g, unknown or other
  misc_feature (305)..(305): n is a, c, g, or t
  modified_base (362)..(362): a, c, t, g, unknown or other
  misc_feature (362)..(362): n is a, c, g, or t
  modified_base (634)..(634): a, c, t, g, unknown or other
  misc_feature (634)..(634): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctgtcttcgtgttggagacagagtccaccatcacttgccgtacaagtcagtagttattaacacttaatttaaattggtatacaagaacaaaaacgacggaaacnccctaggcctcctcctntacctctgacagcagtcttgcatcggcgtccgggtaccataccgaagtacttccggnggacaggtcgtatcgtaggactaagtacttcactctacacgtctaccactacgtacgtacgtaacctagtaaccgttactttaccgaaccttaactttaccgttacgtaacgtaacctaaaaacgttacccgtttaaccacccccgtttaacccgtaaaccgttaaccgtttacccgggaacccgggtacgggaaaccgtacgggtacggaataaccgtaaacgaaccggtaacgtcgggtagacctacggacctaaccgtattacccgttnttacccgttactacccgtttccccttcccgccgtttaacg

SEQ ID NO: 10961 - DNA, 826 bp, Homo sapiens
  misc_feature: GYAE6OF01CT5CM.2.87.H10.1.454.CMB.1.raw
  modified_base (210)..(210): a, c, t, g, unknown or other
  misc_feature (210)..(210): n is a, c, g, or t
  modified_base (241)..(241): a, c, t, g, unknown or other
  misc_feature (241)..(241): n is a, c, g, or t
  modified_base (301)..(301): a, c, t, g, unknown or other
  misc_feature (301)..(301): n is a, c, g, or t
tcagacgctcgacacacgaccggtgctcgatttagcagtactgcgttggggtttgggggagtcagtctcagtcaggacacagcatggacatggacgggtccccgctcagctccgtggggctcctgctactcgtggctccggaggtgccagatgtgacacgtcccggcgaccagtcctccctccctcctgtctcgtcttcgtggttagganacgagacgtccacatctacgttcgccggtanagtcagtattacttaacacttaattaagtgtactacgaacgaacaaaaccgaggaaaccncccgtaaggcctccctacctctactcgtacgacgaacgccagtcctacgactacgtcgtccggttccgggtaccctagtaccgtaggtaccgttcggtaggaccgtagggtacggtacgttaccgggttacgggaaacgttaagtacccttaccgtacctacgtacccgtaaacggtctaaccctacggtaccgttaccgtaaccgggtaacctacggttaaccttaggttaacctacgttaaacccgtttctttaacgtaaaccgtaaaccttaaaacgttacccggttaaccctaaccccgttaccccggtttaacgttaaaccgggttcccggaaccccggggtacgggggtaaaccccgtacgggggttaaaccggtaaccgtaaacgttaaaacccgggtaaaacccggcggtttacgggaaaccccggtggttaaccccgaaccctttaacgttccgtttacccttaaggtttccccctaatttaacccccggttccccgttaaccccgtgtaacccgg

SEQ ID NO: 10962 - DNA, 598 bp, Homo sapiens
  misc_feature: GYAE6OF01CAPJG.2.87.H10.1.454.CMB.1.raw
  modified_base (276)..(276): a, c, t, g, unknown or other
  misc_feature (276)..(276): n is a, c, g, or t
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
  modified_base (591)..(591): a, c, t, g, unknown or other
  misc_feature (591)..(591): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacagtcccggtgacccagtctccctccctccctgtctgtcttcgtgttggagacagagtccaccatccacttgccggtcaagtcagtatattaccacttattaatgtatcagacaaaacgaggaacnccctaggcctcctcctctactctgacagcagtcttgacagtcgcgtcgggtccctagtaccgtaagtacgttccggnggctaggtcgatcgnggaacagtaatcacttcacgacgactccactacgtctacggaacctgtaccgtattcgaccttaactttacttcgtacgtaacaaacgtacgttaacccacccttacccgtaattaaccgttcggaccgtacgggaccgtaggtacggaacgtactaaaccgtaaagtacgtggtacgccgtacgacctactacgtcttcgtacttacgtacttcccgtcccncgttacg

SEQ ID NO: 10963 - DNA, 977 bp, Homo sapiens
  misc_feature: GYAE6OF01AQ6SE.2.87.H10.1.454.CMB.1.raw
  modified_base (167)..(167): a, c, t, g, unknown or other
  misc_feature (167)..(167): n is a, c, g, or t
  modified_base (172)..(172): a, c, t, g, unknown or other
  misc_feature (172)..(172): n is a, c, g, or t
tcagacgctcgacacacgaccggtgctcgatttagcagtactgcgttgggtttgggggagtcagtctcagtcaggacacagcatggacatgagggtccccgctcagctccgtgggctcctgctactcgtggcctccggaggtcgccagatgtgactacgtcccggtnacccngtcctccctccctcctgtctgtcttcgtggttggacgacaggtacgtaccacctatctaccgtttcggcccggttaacaaggtccgaaggtagtttaactttaacctaaccgtttaaatttttaaacgttggttaacttacgaacggtaaacccaaaaaaccggaacggggaaaacccgtaccccggtaacggttaccccttaccccttaccccgtttacccttacccttaccgtacggaccgtaaacggcctaacggtcctttcggactacggttccggtaccgggttacccggggtacccctaacgttaacgtaaacggttaccggtttaccccggtagggtaaccgtaagggtacggttaacgttacgggttacggggaaccttaacggttaacttacgttacccgtttaccgtaaccgtaccggtaaccttaccgaacccgttaacggttaccggttaaccgggtaaccgttacggttaaaccgttaacggtttaccgtaaacccttttaacccgtttaccgtttaccgttaacgtaaacccgtaaaacccgtttacccgttaacccccgttaaccccctttaacccccgggttaacctttaacccggtttaccggggaacccgggtaacccggggttaacccgggtaacggggttaacgggaacgttaaccgttaaacccggtaaaaccggtaccggttaccgggtaccggtacgttacccggtaccctacccggttacttaccggttccgtttaccgttacccttacccggtttacccccgttccccgtaccgttaccg

SEQ ID NO: 10964 - DNA, 599 bp, Homo sapiens
  misc_feature: GYAE6OF01D50SM.2.87.H10.1.454.CMB.1.raw
  modified_base (197)..(197): a, c, t, g, unknown or other
  misc_feature (197)..(197): n is a, c, g, or t
  modified_base (267)..(267): a, c, t, g, unknown or other
  misc_feature (267)..(267): n is a, c, g, or t
  modified_base (328)..(328): a, c, t, g, unknown or other
  misc_feature (328)..(328): n is a, c, g, or t
  modified_base (367)..(367): a, c, t, g, unknown or other
  misc_feature (367)..(367): n is a, c, g, or t
  modified_base (522)..(522): a, c, t, g, unknown or other
  misc_feature (522)..(522): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctcctccctcctgtctgcttctgttgganacagagtcaccatcacttgccgtcaagtcagatattacacttattaatgtatcagacaaaacaggaaacnccctagctctcctctactctgacaagcagcttgcatgcgtcgggtccatcaagtcttccgnggacagtgactcgtagggacagtaatcactctacaacgntaccacagttcctaggtaaacctgaccgtacgtttacgaccttaacgtttcttactacgtaacctaaaacctcgttaacccacccgttacccgtaactaacgtttccggaacccgtacgggacctacgggtacgacgtacgtaaccgaaaacgtntacggtcggtactacggacctaacccgtagttacgttcgttacctttacctaccgtttcccgtccccgtaccttacg

SEQ ID NO: 10965 - DNA, 665 bp, Homo sapiens
  misc_feature: GYAE6OF01AQV50.2.87.H10.1.454.CMB.1.raw
  modified_base (240)..(240): a, c, t, g, unknown or other
  misc_feature (240)..(240): n is a, c, g, or t
  modified_base (303)..(303): a, c, t, g, unknown or other
  misc_feature (303)..(303): n is a, c, g, or t
  modified_base (361)..(361): a, c, t, g, unknown or other
  misc_feature (361)..(361): n is a, c, g, or t
  modified_base (376)..(376): a, c, t, g, unknown or other
  misc_feature (376)..(376): n is a, c, g, or t
  modified_base (425)..(425): a, c, t, g, unknown or other
  misc_feature (425)..(425): n is a, c, g, or t
  modified_base (659)..(659): a, c, t, g, unknown or other
  misc_feature (659)..(659): n is a, c, g, or t
tcagacgctcgacacacgaccggtgctcgatttagcagtactgcgttggggtttgggggagtcagtctcagtcaggacacagcatggacatgagggtccccgctcagctccgtggggctcctgctactctggctccgaggtcgccagatgtgacacgtcccggtgacccagtcctccctcccctccctgtcctgtcttcgtggttggacacgagagtccacctatctcgttggccggtanaacggtcagtaagttacttacaccttaatttaattggtatacaagaaccaaaacgaggaaacnccctagctcctctctactctcgacaagccgtatctggacactcggcgttcgggacctntacagtacttccggnggctaggtgacttcgtacggactaagtacctcgtaactctacgacgtancctaaccgtagtaccgtacgaaccttcgtaaccggtactttacgaaccttcctttaacttctacgaaacccgtaaagttaccgtaccctacccccgttaacttaaccgttacgggttccggaaccgggtaaccgggtaccaaggggttacagttaacctaaccgaaagtctcgggtcgactccgtactaacccgtgttccgttctacttacccgtactttccccggtaaacccngttacg

SEQ ID NO: 10966 - DNA, 718 bp, Homo sapiens
  misc_feature: GYAE6OF01C0ZXF.2.87.H10.1.454.CMB.1.raw
  modified_base (284)..(284): a, c, t, g, unknown or other
  misc_feature (284)..(284): n is a, c, g, or t
  modified_base (311)..(311): a, c, t, g, unknown or other
  misc_feature (311)..(311): n is a, c, g, or t
tcagacgctcgacacacgaccggtgctcgatttagcagtactgcggttgggtttgggggagtcagtctcagtcaggacacagcatggacatgagggtccccgctcagctcctggggctcctgctactctggctccgaggtgccagatgtgacactcccggtgacccagtcctccctccctccctgtctgtcttctgttggagacagacgtcaaccatcacttcggaccggtcaagtcagtagtattacacttattaatggtatcagacaaaaaccagggaaacncccgtaggacctcctctctaactctancaagctagcttgactagtcgtacgtcggggtacccagtacaagtactttccggtacggctaggtcggtaatccgtaggggaacctaaggtaaacttcaaccgtcttaccgaacggtacttaccgaaccgtacggttcttaccggtaaccttacggtaaccgttaactttcggtaaccttaaccgttttacttaccgttaacgtaaactaaaaccttacgttaaccctaccccgttaaccccgtaaccgttaaaccggtttccggaacccgggtacggggtaacccgtacggggttacggacgtaacgtaaccgtaaaaccgacgttagggtacgtaccgttacggacctacgaacccgttacgttacgttcctttaaccgtacctttacccgttccccgtcttaccg

SEQ ID NO: 10967 - DNA, 667 bp, Homo sapiens
  misc_feature: GYAE6OF01EBM95.2.87.H10.1.454.CMB.1.raw
  modified_base (162)..(162): a, c, t, g, unknown or other
  misc_feature (162)..(162): n is a, c, g, or t
  modified_base (211)..(211): a, c, t, g, unknown or other
  misc_feature (211)..(211): n is a, c, g, or t
  modified_base (224)..(224): a, c, t, g, unknown or other
  misc_feature (224)..(224): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (596)..(596): a, c, t, g, unknown or other
  misc_feature (596)..(596): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacagtccccggtnacccagtcctccctccctcctgtctgtcttctgttggagacagatcacntcacttgccgtanagtcagtagttattacacttaatttaagttgtatcanacaaaacaggaacgcctagctcctctctactcngacaagcagtcttgctagtcgtcggtcgggtacccctagtactaagtacgttccggtggtacgaggtggactcggtacgggaacaagtacttcacttacctacgtaacgactaccaacgtacgttccgtaggtaaacccgttgtaacgtactttacgaaccttaactttactttacctaagtaacctaaaccgttacgttaaccctacccgttaaccccgttaacgttaaccggtttccgggaacccgggtaaccgggtaacccgtaacgggtaggacggtaacctaacggaaacgtaacgnggttacggcgtacgtacctaccgtactttccgtaacgttccttactaccttacccgttcccgacgttaccg

SEQ ID NO: 10968 - DNA, 766 bp, Homo sapiens
  misc_feature: GYAE6OF01BH1XE.2.87.H10.1.454.CMB.1.raw
  modified_base (200)..(200): a, c, t, g, unknown or other
  misc_feature (200)..(200): n is a, c, g, or t
  modified_base (217)..(217): a, c, t, g, unknown or other
  misc_feature (217)..(217): n is a, c, g, or t
  modified_base (263)..(263): a, c, t, g, unknown or other
  misc_feature (263)..(263): n is a, c, g, or t
tcagacgctcgacacacgaccggtgctcgatttagcagtactgcgttgggtttggggagtcagtctcagtcaggacacagcatggacatgaggtccccgctcagctcctggggctcctgctactctggctccgaggtgccagactgtgacatcccggtgacccagtcctcctccctcctgtctgcttctgttgagacagntcacatcacttgccgtnatcatgtattacacttattaattgtatcagacaaaaccgaggaacncctaggctcctcctctactctcgactagcagtacttcgactatacgcgtcgggtacccatacgaacgtactccgtggcgtaggtcgtaatcgtacggactaagtacttcacgttacctaccacgtactaccgtaccgtagttaccgtacggtaaccgttacgtaaccgttacgtttacgaacccgtttaacccttttaaccgtttcccgtaaacgtttaaaccccgtaaacgttaacccgtttaccccgtaaccccgtttaacccccgttaacccgtttaacccgttttacccgggaacccggttaacccggggtaccgtaaacccggggtttacggggaacccgttaaaaccggttacgaaaacccccgggttaaacggttaacgggttcccggtaaaccggttaccacccccggttaaccacccggttttaaccccgttcggttaaccctttaccctttaacccgtttcccccgttacccccggttaccctttaaacccgg

SEQ ID NO: 10969 - DNA, 921 bp, Homo sapiens
  misc_feature: GYAE6OF01B0AAQ.2.87.H10.1.454.CMB.1.raw
  modified_base (210)..(210): a, c, t, g, unknown or other
  misc_feature (210)..(210): n is a, c, g, or t
tcagacgctcgacacacgaccggtgctcgatttagcagtactgcgttgggtttgggggagtcagtctcagtcaggacacagcatggacatggacgggtccccgctcagctccgtggggctcctgctactcgtggctccgaggtcgccagatgtgacacgtcccggtcacccacgtcctccctccctcctgtctcgtcttcgtggttgganacgagactacacatctactcggcgtacagtcagtattacttactacttaatttaagttgtactacgaaacgtaaaccgaaaaaaacggtaacggaaaaccggtacccgtacggtacccttaccccttaccccttaccttaccgttaccgtacggaccgtaaaaccggtccgtaacgttaccgtttcggacgttaacgtccgggttacccgggttacccggggttaaccctaaacgttacccgaaaacgggtttcccgttttacccgggacggtaacgggttacgggttagggttaccgtacggggtaacgggtaacgtaacgttaaccgttaaccgtaccttaaccgtaccgtaaccgttaactacccgtaacgtaacgttaaccggttaccggtaacccgttaacggtaaccggtttagttaaccgttaacccttaacccgtttttaccgtaaacgttaaccgttaaaacctaaaacctttcccggttaaaaccccttaccccgttaaccccgttaaacgtaccggtttacccgggaacgggtaacccggggtaacggtaacgggttacggaaacgtaacccgtaacggtaaaaccggtacggtaaccggttacgggaaccttacgaacccggttaccgtttaaccttccggtttaaaccgtttcccgttaacccttaccccgtttaaccggttcccccgtaattaaccg

SEQ ID NO: 10970 - DNA, 662 bp, Homo sapiens
  misc_feature: GYAE6OF01CB1L6.2.87.H10.1.454.CMB.1.raw
  modified_base (199)..(199): a, c, t, g, unknown or other
  misc_feature (199)..(199): n is a, c, g, or t
  modified_base (222)..(222): a, c, t, g, unknown or other
  misc_feature (222)..(222): n is a, c, g, or t
  modified_base (260)..(260): a, c, t, g, unknown or other
  misc_feature (260)..(260): n is a, c, g, or t
  modified_base (280)..(280): a, c, t, g, unknown or other
  misc_feature (280)..(280): n is a, c, g, or t
tcagacgctcgacacacgaccggtgctcgatttagcagtactgcgttgggtttgggggagtcagtctcagtcaggacacagcatggacatgagggtcccgctcagctcctgggctcctgctactctggctccgaggtgccaggatgtgacagtcccggtgaccctagtcctcctccctcctgtctgtcttcgtgtgganacagatcacatcacttgaccgtnaagtcagagttacttacacgttaatttaagtgtactanaacgaacaaaacgaggaacncccgtagccttcctcctcgtactctacgactagctatacgttgacagtcggtcgtcgggtcccaagtacgacgtacttccggagacggtaggtcgacgtcggaggaactaagtaccttacgaccttactacgaaccgtactaccgtaacgtacgtacgtacgtaacctacgtaccgttacttacgtaacgttaccttacgttacgtaacgtaaaccgtaacgttaccgttaaccgtacccgttaacccccgttaagttaacccggttacgggtcccggaaaccgggtaacccgtagggtaacggacgtaactaaccggtaaacgtcgtacggtccgaactcggactaacgttcacgttcgtacctctacgtccctcgctacg

SEQ ID NO: 10971 - DNA, 864 bp, Homo sapiens
  misc_feature: GYAE6OF01BIAYS.2.87.H10.1.454.CMB.1.raw
  modified_base (171)..(171): a, c, t, g, unknown or other
  misc_feature (171)..(171): n is a, c, g, or t
tcagacgctcgacacacgaccggtgctcgatttagcagtactgcgttgggtttgggggagtcagtctcagtcaggacacagcatggacatgacggtcccgctcagctcctggggctcctgctactcgtcggctccggaggtcgccagtagtgtagacacgttcccgggtanacccgagttcctccctccctccctgttctcgtcttcgtggttggacgtacaggacgttaccaacctaacgttctaaccgttggacccggtaacaacgttccgaagtaacgttactttaacctaacctttaaagtttaaaagtttcgggttaataaccggaaacgtaaaaccgtaaaaaaaccggaaccgggtaaaaccggtaccccgttaacggtacccttccccttacccgttaccgttaaccgttacgtaccgtaacgaacgtcgtaacgtctttacgacgtacgtacggtccgggtcgggtaccctaaacgtacgtaaaaccgtcgttaccggtacggacgtacgggtaacgtacgtcggttaagggaactaacggtaaaccttacaaaccgttcctaacggtaaccgtactaacccgtaacgtaacgggtccttaaccgggtaaactacggtaaccgttaacctttagtaacccttacttaacgtttaccgtaacgtaaacctaaaacttcccgtttaaaccccacccgtaacccgttaacttaaccgggttaggaacccgggttacgggaaccgtacgggtagaaacccgtaagaaccgtaaacgtaccgttgtaccgggtactaacggaccgttccaccgttacgttccgtaactttcgtaacctttaacccgtccgtaacctacgg

SEQ ID NO: 10972 - DNA, 763 bp, Homo sapiens
  misc_feature: GYAE6OF01EQHFV.2.87.H10.1.454.CMB.1.raw
  modified_base (140)..(140): a, c, t, g, unknown or other
  misc_feature (140)..(140): n is a, c, g, or t
  modified_base (164)..(164): a, c, t, g, unknown or other
  misc_feature (164)..(164): n is a, c, g, or t
  modified_base (269)..(269): a, c, t, g, unknown or other
  misc_feature (269)..(269): n is a, c, g, or t
tcagacgctcgacacacgaccggtgctcgatttagcagtactgcgttggggtttggggagtcagtctcagtcaggacacagcatggacatgagggtccccgctcagcctcctgggctcctgctactctggctccgaggtnccagatgtgacagtccggtgaccngtctcctcctcctgctgtcttctgttgagacagtacgtcaccgatctacttcgaccggtacaagtccagtacgtatttaccaccttatttaaattgtactacaanaaccgtaaaaaccgaggaaacgcccgtagtacctcctccttactacctacgtgactaacgcaggtcttagctagtcgcgtccgggtaaccctatacgaacgtcgttaccggaggacgtaaggtcggtagtcgtaggaacggataacgttactactcgtaccggaactactacgtaacctacgttaccgtaacggtaaccgtcgtaaaccgtacgtttaacggtaaccttaaaccgtttactttaaaccgttaccggttaaaccaaaaccgttaccgttaaaccccgtacccgtttaaccccgtaaaccttaaccggtttacgggaacccggtaacgggtaacccgggttaacggtcgggtaaccgtaaccgttaacgtaaacccgtaacggttacggtacgggtaccttacggaacccgttaccaacggttccgtttaacgggttaccctttaccggttaccttttacccgttaccccggtacccttaaccggg

SEQ ID NO: 10973 - DNA, 818 bp, Homo sapiens
  misc_feature: GYAE6OF01DUIR6.2.87.H10.1.454.CMB.1.raw
  modified_base (202)..(202): a, c, t, g, unknown or other
  misc_feature (202)..(202): n is a, c, g, or t
  modified_base (234)..(234): a, c, t, g, unknown or other
  misc_feature (234)..(234): n is a, c, g, or t
tcagacgctcgacacacgaccggtgctcgatttagcagtactgcgttgggtttgggggagtcagtctcagtcaggacacagcatggacatgaggtcccgctcagctcctggggctcctgctactctggctccggaggtgccagatggtgacagtcccggtgacccagtcctccctccctcctgtctgtcttctggttagganacagacgtacaccatcctacgttcgccggtanaagtcagtagttacttaacctacctttaatttaagttaggtataacaaacggttaaaaaccgaagggaaaaccgtacccgtaaggccttaccccgtcctacctacttctggacaacgacgtagtcgttcggactagtcggtccgttacggggtaccctagttaccgtaagttaccgttccgggtacggacgtaaggtacggtacgttacggtacgggaaccgtaaggtaaccgtttacctaaccgttaccgttacccgaacggtaaccttaccaacccggttacgttacccggtaaccggttaaccgtaacggtacccgtttaacgtttacccgtaaaccttaacccttttacgttacgttacccgttaaaccaaaccgttaccgtttaaacccgtaccccgttaccccgtaacgttaaccgtttcggaccccggtaacgggtaccggtaacgggttacggaaccgtacgtaaaccgtaaacgttaccggtacggtacggtaccgtcgaaccggtccctttaacgtccgttacgtttaccttaccttcccttacccggtttacccctcccgttagttaacccgg

SEQ ID NO: 10974 - DNA, 677 bp, Homo sapiens
  misc_feature: GYAE6OF01BUFKC.2.87.H10.1.454.CMB.1.raw
  modified_base (212)..(212): a, c, t, g, unknown or other
  misc_feature (212)..(212): n is a, c, g, or t
  modified_base (224)..(224): a, c, t, g, unknown or other
  misc_feature (224)..(224): n is a, c, g, or t
  modified_base (277)..(277): a, c, t, g, unknown or other
  misc_feature (277)..(277): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctcgtcttcgtgttggagacagatcacntcacttgccgtnaagtcagtagtattaccactaattaatgtatacagaacaaaaccgaggaaccnccgtagctcctcctactactcngacagcagtcgtnctagtcgtcgtcgggtccagtacgaagtcgtcgtcggagagtaggtagtcgaggtaactagtacgtacctactaccgtacgtacgtactacccaccgtaacgttaccgtacggtaaccgtacggaaccgtttacttaacgtacccttaactttaccgtttactaacgttaaacctaaaccgttaccttaccccgttaaccccgttaccccggtaaacttaaccggttaccggaccggtaaccggggtaccgaccgggtaacggtacgtaacctaccggaaaacgtccgtacggtacggtaccgttcgaaccctacctacgtttactaccgtttctaaccctcgttcccccttaccgccttaacgg

SEQ ID NO: 10975 - DNA, 657 bp, Homo sapiens
  misc_feature: GYAE6OF01AWNM6.2.87.H10.1.454.CMB.1.raw
  modified_base (305)..(305): a, c, t, g, unknown or other
  misc_feature (305)..(305): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtcgccagatgtgacacgtcccggtgaccctagtcctccctccctcctgtctgtcttctgttggagacagacgtccacctatccacgttggcggtacaagtcagtagttacttaacgtaccttaatttaaagttgtactacaacgaaccgaaaaaccgagggaaaccncccgtacggtcctcctcctctacctctacgacacgactagtctcgcagtcgcgtcgggtacctagtacgaagtccgttccgtggtcgtaggtcgtagtcggtacggaactaacgtacttctacctcacacgtactacctaccgtacgtacgtaacgtaaccctggtaaccttacgttactacttaccttcgttactaacgtaacctaacctaccgttacctacccctaacccgttaactacgttccggaccggtaccggacgtacggtaggacacgtaaccgacgtaacgtcggagtcctacgtacctacgtcttacttcgtaccttactaccttcccgtacccgtcgtacg

SEQ ID NO: 10976 - DNA, 814 bp, Homo sapiens
  misc_feature: GYAE6OF01AXVVB.2.87.H10.1.454.CMB.1.raw
  modified_base (196)..(196): a, c, t, g, unknown or other
  misc_feature (196)..(196): n is a, c, g, or t
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (271)..(271): a, c, t, g, unknown or other
  misc_feature (271)..(271): n is a, c, g, or t
tcagacgctcgacacacgaccggtgctcgatttagcagtactgcgttgggtttgggggagtcagtctcagtcaggacacagcatggacatgaggtcccgctcagctcctgggctcctgctactctggctccgaggtgccaggatgtgacagtcccggtgacccagtcctcctccctcctgtctgcttctgttgganacagatcaccagtcacttgccgtanaagtcagtattattacacttatttaatgtatcagacaaaaccgnggaacnccctagctcctcctctactctgacaagcagtcttacggactacgtcgtcgtcggggtaccctagtacctaaacggtccttaccggttggaccgtaagggtacgggtacttaccggtacggggtaactaacgttaaccgttactaccttaccgtaccgtaacgtaaccttccgaacccgttaaggttacccgttaacggtaaacccgttacgggtaaccgtttaacggttttaccgtaacgtttaaaccgtttaaccgtttaccgttaaccgtaaacctaaaaccgtaccgttttaaaccctaacccccgtttaaccccgtttaaaccgtaacccggtttttacccgggaaccccgggtaaaccgggggttaaccccgttaaccgggggttacggtaaaccggtacgttaaaacccggtaaaacccggtaaaccgtttaccgggaaccggttaccggttacgaccccgttaaccggtacctttaacccgttacgtttaccttaccgttaccctttaacccgttccccgttaacccgttaacccg

SEQ ID NO: 10977 - DNA, 813 bp, Homo sapiens
  misc_feature: GYAE6OF01CPPLX.2.87.H10.1.454.CMB.1.raw
tcagacgctcgacacacgaccggtgctcgatttagcagtactgcgttgggtttgggggagtcagtctcagtcaggacacagcatggacatgacggtccccgctcagctcctggggcctcctgctactctcggactccgaggtcgcccgaagattggtcgaactacgtccccggtcgaccctacgttcctccctcccctccctgtcctcgtcttcgtcggttagacgacgagacgtccaacctagtccgtacgttacccgggtaccgtaacgtaaacgtacgtaacgttaacgtttaaccttaacctaaccttttaaaagttttaacgttagttaactaacaaacgtaaaaacccgaaaaaaccggtaaccgggaaacccgtacccggttacggtaccccttaccccttaccttaccgtaccgttccgaacgaaccgtaaacgtaccggtacgtacgtttcggaactacgttcgggtcccggttaaccgggtaaccccttaataccggtaaagtcgttccggagtacgtaggtacgagtcggtagactaatacgtctaaccgtcaaccgacgtacacccgtacgacggttaccgacgtaacgtacgtacttacgtacgtactttaacctagttacctaaagtaacctaacctaacgtaccctaacctacctacgtaccgttacggacccggacgtacggacgtacgacgaacgtaaaccgagtaaccgtggtacgtaccggtacctacgacccgttacgttccgttacttacccttacttaccccgggtttacccctccggtaccccgtttacg

SEQ ID NO: 10978 - DNA, 745 bp, Homo sapiens
  misc_feature: GYAE6OF01DNZTK.2.87.H10.1.454.CMB.1.raw
  modified_base (691)..(691): a, c, t, g, unknown or other
  misc_feature (691)..(691): n is a, c, g, or t
tcagacgctcgacacacgaccggtgctcgatttagcagtactgcgttggggtttgggggagtcagtctcagtcaggacacagcatggacatggacggtccccgctcagctccgtgggcctcctgctactcgtggcctaccggaggtcgaccagagtgtgaccacgtcccggtacacccagtcccttccctccctcctgtctgtcttcgtgtgagagagctaccactatcctacttacggcgtacagtcgaagttacgttactttaacactttaagttttaagttagtacttaccgaacgaaaaccgtaaaaaccggtaacgggaaccccgtaccgtaacggtaccccttacccctacccgttaccttacccgttactaccgaacgaacgtccgtacgttcgtacgctaaccgtcgggttcccgtaccgggttaccacgtaaccgtaacgttccgttaccggtacgtaggtacggtaccggtaagtttacggtaacggaacgtaagtacctttacctactaccgtacctaacgtacctccgtaaccgtactacccggtaacgacgtacgttaccgtacgtcgttaacctacttactctaactaaccgtaactacctactacccttaaccgtccttaacgggccgaccgggtacgacgtacggacagtaaccgtacaacggtactacggtacncgtacgaacccgtgtacctcggttacttcttactaccttcccgacgttctaccg

SEQ ID NO: 10979 - DNA, 769 bp, Homo sapiens
  misc_feature: GYAE6OF01CZOW8.2.87.H10.1.454.CMB.1.raw
  modified_base (166)..(166): a, c, t, g, unknown or other
  misc_feature (166)..(166): n is a, c, g, or t
  modified_base (402)..(402): a, c, t, g, unknown or other
  misc_feature (402)..(402): n is a, c, g, or t
  modified_base (752)..(752): a, c, t, g, unknown or other
  misc_feature (752)..(752): n is a, c, g, or t
tcagacgctcgacacacgaccggtgctcgatttagcagtactgcgttggggtttgggggagtcagtctcagtcaggacacagcatggacatggacggtccccgctacagcctccgtggggccttcctgccttactcgtggccgtccgagggtcgccagattcggtnaccacgtccccgggtacgaccctacgttcccttcccctccctcccttgtctcgtcttcgtggttagacggacacgactcacactctaccgttcggaccgtacagtacagtaattatttaacctacctttaattaaagttcgtactacaacggaaacccaaaaacggacggtaaaccgtacccgtacgtccttcccttacctcctactcgtacgaccaagcgtacgtcgttacgacnggtacgtaccggtccgggtaacccagttaccgtacgtcgttaccgggtacgacgtacggtcggtacgtacgggtaacgggaaccgtaagtaaccgtttacaccctacccgtaactacgtaacctaccgtaaccgtaacggtccgttaacccggtaaacggtaccgtttaacgttaacttaccgtaacctttacctttacgtcctaaccgtaactaaccggttacctacccgttacccctttaaccggtaacttaccggtggtaaccgggacggtaaccgtagggtagacgtaactaaaaccggtacgtacggttcggacggctacggactacctcgtactcgtaccttcncccttaccggcctctag

SEQ ID NO: 10980 - DNA, 739 bp, Homo sapiens
  misc_feature: GYAE6OF01BI4KG.2.87.H10.1.454.CMB.1.raw
  modified_base (127)..(127): a, c, t, g, unknown or other
  misc_feature (127)..(127): n is a, c, g, or t
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactntggctccgaggtgccagatgtgacacgtcccggtgacccagtcctccctccctcctgtctgtcttctgttaggacgacagagtcaccatctaccttcggccggttacaacgtcgaagtagttactttacctacttaatttaagttgtaatcaagaaccaaaaaccgaagggaacncccgtaggcctcctcctctactcgtcacagcagtctncgtactgcggtccgggtcctatacgaagtacgttccgtcggagtaggtacggtagtaccggtagggaacctaaggtaacttaccgtaccttacctacgtaaccgtacgtaccctaaccgttacgtccggttaacggtaaccccgtttaacggaaccgtttaaccgtttaccggtaaccctttaaccgtttaccctttaccgtaacgttaaaccgtaaaaccgttaccgtttaaccccgttaacccccgttttaacccgtaaccgtttaacccggttaccggggaaccccgggtaacgggtacccggtaggtacggtaacgtaaccgtaacgaaacccgtagtcggtacgtcgacgtacctactctattcggttaccacgttccctacccttccgcctacg

SEQ ID NO: 10981 - DNA, 802 bp, Homo sapiens
  misc_feature: GYAE6OF01BHSLW.2.87.H10.1.454.CMB.1.raw
  modified_base (791)..(791): a, c, t, g, unknown or other
  misc_feature (791)..(791): n is a, c, g, or t
tcagacgctcgacacacgaccggtgctcgatttagcagtactgcggttggggtttgggggagtcagtctcagtcaggacacagcatggacatggacgggtccccgctcagctccgtggggctcctgctactctggcctccgaggtcgaccagatgtacgactacgtcccgggtacgaccctactcctccctccctccttgtctcgtcttcgtggttaggagacagtacgtcaccactctacttcggccgtacagtcagtacttacttactacttaatttaagtgtactacgtaaaacgtaaaaccggagggtaaccgtacccgtacgtcccttccctacctacctactcgtagaaccgacgtcagtctcgactcggttcggtaccggttaccgggtaccaagttaaccgtacggttaccttccggggagtaccggtacgggttaggacgttacgggtacggtaactaacgttaaccttacctcggtacctacgacccgtaactacctaacgttacgtaccgtacgggtaaccttacgggtaacccttcgttaacctaccgtttaaccgtttacgttacctaaacgttaaaacctaaccggttaaccttacccgtaaccccttaaccgtaacgttaaccggtttaacccggggaccggtaaccgggtacccggttaggggtaacctaacttaaccggaacccggtaaacggttcgtaggtacccggtctaccgtacccgtacctacggtttccgtacctttaccgttacccttaaccgtccctttaacccgngttacgttcgg

SEQ ID NO: 10982 - DNA, 739 bp, Homo sapiens
  misc_feature: GYAE6OF01BI40L.2.87.H10.1.454.CMB.1.raw
  modified_base (228)..(228): a, c, t, g, unknown or other
  misc_feature (228)..(228): n is a, c, g, or t
  modified_base (363)..(363): a, c, t, g, unknown or other
  misc_feature (363)..(363): n is a, c, g, or t
  modified_base (381)..(381): a, c, t, g, unknown or other
  misc_feature (381)..(381): n is a, c, g, or t
  modified_base (450)..(450): a, c, t, g, unknown or other
  misc_feature (450)..(450): n is a, c, g, or t
tcagacgctcgacacacgaccggtgctcgatttagcagtactgcgttgggtttgggggagtcagtctcagtcaggacacagcatggacatggacgggtccccgctcagctcccgtggggctcctgctactcgtggctccggaggtcgccagagtcgtagactacgtccccggtcgaccctagttccctccctccctccctggttcctcgtcttcgtgttacggacganacggactcaacatcgtacgtcggccgtacaacgtcgagtacttacttaactaacctttaatttaagtcgtacttaacgaacgtaaaccgaaaacggacggaacccgtaccgtacgcctttacccacgttcctacncgacgtacaacgccgtanccgttacgacttacggttccggtcgggttaccgggtaacccaacgtaacgtacgggttaccttccgggnggtaacgtacggggttcggaattcccgggttaaggactaacgttaccgttactactccgtaaccgtacgtaccgtaacccgaccgtacgtaccgtacggtaaccgtaccgtaacgttacgttactacgttacttacgttacgtacgtaacctaacgtactacctaacctacctactaccggtcgaccggacggtacgacggtacgacgacgtaacgaacgtacgtacggcgtcgtactacaacttcgtacgttacgttacgttacttccgttaccctcccgtcgttacg

SEQ ID NO: 10983 - DNA, 793 bp, Homo sapiens
  misc_feature: GYAE6OF01D1JTX.2.87.H10.1.454.CMB.1.raw
  modified_base (163)..(163): a, c, t, g, unknown or other
  misc_feature (163)..(163): n is a, c, g, or t
tcagacgctcgacacacgaccggtgctcgatttagcagtactgcgttgggtttgggggagtcagtctcagtcaggacacagcatggacatgacggtcccgctcagctcctggggctcctgctactcgtggctccggaggtgccagatgtgacacgtcccggtnacccagttcctccctccctcctgtctgtccttcgtgttggagtacaggacgtccaacctatcctacgttcggacgtacaacgtcaggtaattactttacgaaccttaattttaaagttggtatactaacggaacaaaaaccgagggaaaaccgtcccgtaacggtcccttccctcctacgttaccctacgtacgaccgtaacgacgtacggttccttacgacgtagtttacggccggttaccggggtcccctaacgttacgtaaacgtcgtttaccggtcggacgtacgggtagtacggtcggttacgggaactaagtaacgttaccgtactaccgtacacgtacctaccgtaaccgttacggtacgttacgaaccgtacgtaaccgtacgtttactaacccgtaaccttttacgttaccgttaaacgtaactaaaccgtttccgttaaccctaaccccgttacccgttaaccgttaaccggttaccggggaaccttaccgggggtaacgtaccggggtaacggacgtaacgttaaaaccggtaaacggtacgttcggtacggtaccctaggacccgtacttacgttcgttaccgttcttaacttaccgttcccgttacccacgttaccg

SEQ ID NO: 10984 - DNA, 631 bp, Homo sapiens
  misc_feature: GYAE6OF01EFEC5.2.87.H10.1.454.CMB.1.raw
  modified_base (162)..(162): a, c, t, g, unknown or other
  misc_feature (162)..(162): n is a, c, g, or t
  modified_base (295)..(295): a, c, t, g, unknown or other
  misc_feature (295)..(295): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtcgccagatgtgacactcccggtnacccagtcctcctccctcctgtctgtcttctgttggactacagagtcaccatctacttcggccgtacaagtcagtagttactttacaccttaatttaacgttggtactacagtaaccaaaaaccgaggaaacnccgtaagcctcctcctctactctagacaagctacgtctcgcacgtcgtcgtcgggtcctacgtactaacgtcgtcggcgtacgagtagtacgtcgacggtacaagtactctactctacgacgtactacaccgtagtaccgacgtaaccgtacgtacgttacttacgtaccttactttacgtctaacgtactaaacttactaacctacccgtaccctaagtaaccgttacgaccggtaacgggtacctacgggtacacgtacgtaaccgtaaacgtacgtcgtacgtcgtagacctacgtactcgtacgttcctacttacctcccttccgcgttacg

SEQ ID NO: 10985 - DNA, 511 bp, Homo sapiens
  misc_feature: GYAE6OF02IKZ06.2.87.H10.1.454.CMB.1.raw
tcagacgctcgacacacgaccggtgctcgatttagcagtactgcgttgggtttggggagtcagtctcagtcaggacacagcatggacatgagggtcccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagcaaaaaccagggaaagcccctaggctcctcctctactctgcaagcagcttgcatgctggggtcccatcaagattccgtggcagtggatctgggacagaattcactctcacgatcaccagtctggaacctgacgactttgctaacttacttctgtacaaaactcgttacaccttcccgtacaactttggccaggggaccacggtggagatacgaaacgactgtggctgcacatctgtcttcatccttcccgctac

SEQ ID NO: 10986 - DNA, 538 bp, Homo sapiens
  misc_feature: GYAE6OF02HJ3IC.2.87.H10.1.454.CMB.1.raw
  modified_base (278)..(278): a, c, t, g, unknown or other
  misc_feature (278)..(278): n is a, c, g, or t
  modified_base (429)..(429): a, c, t, g, unknown or other
  misc_feature (429)..(429): n is a, c, g, or t
tcagacgctcgacacacgaccggtgctcgatttagcagtactgcgttgggtttggggagtcgagtctcagttcaggacacagccatggacatgagggtcccgctcagctcctggggctccgtgctactctggctccgaggtgccagatgtgacatcccggtgacccagtcctcctccctccctgtctgcttctgttggagacagagtcaccatcacttggcggtcaagtcagagtatttacacttatttaaattgtatcagacaaaaaccagggaaancccctaggctcctcctctactctgcaagcagcttgcatgctgggtcccatcaagattccgtggcagtggatcgtgggacagaattcacttctacacgatcaccagtctaggaacctgactactttgactaacttacttctagtacaaaacngttaaccacccttacccgtaactaactttcggaccaggggtaaccacgggtggagatacaaacgactgtcggactgacaaccattctcgtctcacttccttcccgctac

SEQ ID NO: 10987 - DNA, 599 bp, Homo sapiens
  misc_feature: GYAE6OF02JC84P.2.87.H10.1.454.CMB.1.raw
  modified_base (425)..(425): a, c, t, g, unknown or other
  misc_feature (425)..(425): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagcaaaaaccagggaaagcccctaggctcctcctctactctgcaagcagcttgcatgctggggtcccatcaagattccgtggcagtggatcgtgggacagaattcactctcacgatcaccagtctggaacctgacgtactttgactaacttacttctagtacaaaacngtttaaccacccttaccccgtaactaaaccttttcgggaccctaacgggggtacccctaacgggttacgggaacgtaacttaccgaaaaccggtacgttggtacgggtccttacggacctaacccgattccgtacgtttacctttaccactttcccgtttcccccgacctaacg

SEQ ID NO: 10988 - DNA, 574 bp, Homo sapiens
  misc_feature: GYAE6OF02G58TE.2.87.H10.1.454.CMB.1.raw
  modified_base (277)..(277): a, c, t, g, unknown or other
  misc_feature (277)..(277): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacaccttatttaaattggtatcagacaaaaaccagggaaancccctaggctcctcctctactctgcaagcagcttgcatgctgggtcccatcaagacttccgtggcagtggatcgtgggacagaattcactctcacgatcaccagtctggaacctgactactttgactaactttacttctagtacaaaactgttaaccacccttccccgtaactaaccgtttcggaccctaagggggaccctacggggttggaacgtactaccgaaacgtacgttggtacgggccttcggacctaacctattccgttgttcctttcgactttcccttccccgcctacg

SEQ ID NO: 10989 - DNA, 583 bp, Homo sapiens
  misc_feature: GYAE6OF02IRV5Z.2.87.H10.1.454.CMB.1.raw
  modified_base (275)..(275): a, c, t, g, unknown or other
  misc_feature (275)..(275): n is a, c, g, or t
  modified_base (379)..(379): a, c, t, g, unknown or other
  misc_feature (379)..(379): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctcctgtctgcttctgttggagacagagtcaccatcacttgccggtcaagtcagagtatttacaccttatttaaatggtatcagacaaaaaccaggaaacncccctaaggctcctctctactctgcaagcagcttagcatgctgggtccatcaagattcgtgcagtgatcgtggacagaattcactctacacgatcaaccagtcnggaacctgacgactttgactaacttacttctagtacaaaactcgttaaccacccttacccgtaactaaacctttcggacccgaacggggtacccaacgggttggaaacgacttaacgaaaacgtaccgttggtacggacttacggacctaaaccgtacttccgttacggttccttacgacgtttcccttccccggaccttaacg

SEQ ID NO: 10990 - DNA, 617 bp, Homo sapiens
  misc_feature: GYAE6OF02IVQ1T.2.87.H10.1.454.CMB.1.raw
  modified_base (224)..(224): a, c, t, g, unknown or other
  misc_feature (224)..(224): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctgcttctgttggagacagagtcaccatcacttgccggtnaagtcagagttattacacttaatttaattggtatcagacaaaaacgaggaaacgcccctaggcctcctcctactactactgacaagcagctgcatcgctcgggtccatacaagtacttccgtggcagtgtatcgtaggacagtaattcactctacacgactacaactagtccgtacggtaacctggtaaccgtactttacgaccttaaactttccttactacgtaacaaaacgtcgttaacctacccttacccgtactaaccgtttcggacccgtaacgggacctagggtacgaacgaacacgtaaaacgccgtagtacgggaccttacgacctaacccgtagttccttacggttaccttacctaaccgtttcccgttaccccgtaccttacg

SEQ ID NO: 10991 - DNA, 593 bp, Homo sapiens
  misc_feature: GYAE6OF02JKMVP.2.87.H10.1.454.CMB.1.raw
  modified_base (278)..(278): a, c, t, g, unknown or other
  misc_feature (278)..(278): n is a, c, g, or t
  modified_base (340)..(340): a, c, t, g, unknown or other
  misc_feature (340)..(340): n is a, c, g, or t
  modified_base (442)..(442): a, c, t, g, unknown or other
  misc_feature (442)..(442): n is a, c, g, or t
tcagacgctcgacacacgaccggtgctcgatttagcagtactgcgttgggtttgggggtaggtcagtctcagtcaggacacagcatggacatgagggtcccgctcagctcctgggctcctgctactctggctccgaggtgccagatgtgacatcccggtgacccagtctcctccctccctgtcctgcttctgttggagacagagtcaccatcacttgccggtcaagtcagagtatttacaccttatttaaattggtatcagacaaaaaccaggaaacncccctaggcctcctcctctactctgcaagcagcttgcatgcgtgggtccatcaagattccgnggcagtgatcgtgggacagaattcactctacacgatcaccagtctacggaacctgacgtactttgacctaacttacttctagtaactaaaacctgttaaccncccgttacccctaactacgtttcggacccgtaggggtaccctaaggggtcggagaactaccgtaaaaaccggcttacgggtggtaccgttagacccttaacctacttaccgttcgtttaccttaccaactttcccgttcccccgacttacg

SEQ ID NO: 10992 - DNA, 625 bp, Homo sapiens
  misc_feature: GYAE6OF02HQY7O.2.87.H10.1.454.CMB.1.raw
  modified_base (277)..(277): a, c, t, g, unknown or other
  misc_feature (277)..(277): n is a, c, g, or t
  modified_base (338)..(338): a, c, t, g, unknown or other
  misc_feature (338)..(338): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagacaaaaaccagggaaacncccctaggctcctcctctactctgcaagcagcttgcatgctgggtcccatcaagattccgngcagtggatcgtgggacagaattcactctcacgatcacctagtctggaacctgactactttgactaacttacttctagtactaaaactcgttaaccacccttacccgtaactaaccgttttcggacccgtaagggggaccctaacggggttggaaagtaaccgttaacgaaaaccggtaacgttgggttacgggaccgttcggacccgtaacccgtaacgtttcccgtttacggtttacccttttaccgtaaccgttttccccgtttaccccccggaccttaaaccg

SEQ ID NO: 10993 - DNA, 833 bp, Homo sapiens
  misc_feature: GYAE6OF02HQRDJ.2.87.H10.1.454.CMB.1.raw
  modified_base (200)..(200): a, c, t, g, unknown or other
  misc_feature (200)..(200): n is a, c, g, or t
  modified_base (229)..(229): a, c, t, g, unknown or other
  misc_feature (229)..(229): n is a, c, g, or t
  modified_base (284)..(284): a, c, t, g, unknown or other
  misc_feature (284)..(284): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtcctgcttctgttgganacaggagtccaccatcacttcgccggtanaagtcagtagttattacaccttaatttaaattggtatcagacaaaacgaggaacnccctagctacctctctactctgacaagcacgtcttgactagtcgccggtacggggtcccaagttacgaacgtacgttcccggtaggactagggtaggaacgttcggttaggggaaacctagtaactttccaaccttccgtaccaacggtacttaccgaaccgtaaggttccgttaacggaaacccgttggtaaaccgttacgttttacggaacctttaaaccgttttacgttacccgtttaagttaaaaccctaaaaaaccgttacgtttaaaccctaaaccccccgttaccccggttaaaaccgtttaaacccgtttttccgggggaaaccccgtaaaccggggggttaaccctaaccgggggttaacggggaaaaccgtaaacggtttaaaccccgaaaaaacgggtttaacccgtgggggttaacccggacgtttaaacccggtaccgtaaacccccgttacggtttacccgtttaacccgggttttcctttaacccgttaaacccggtttttccccgtttaccccccggtaaccctttaaaccgg

SEQ ID NO: 10994 - DNA, 589 bp, Homo sapiens
  misc_feature: GYAE6OF02FJFFF.2.87.H10.1.454.CMB.1.raw
  modified_base (382)..(382): a, c, t, g, unknown or other
  misc_feature (382)..(382): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagcaaaaaccaggaaagcccctaggctcctcctctactctgcaagcagcttgcatgctggggtcccatcaagacttccgtggcagtggatcgtgggacagaattcactctcagactcaccagtcncggaacctgacgtactttgactaaacttacttctacgttacaaaactacgtttaaccacccttaccccgttaactaaaccgttttcggacccgtaacgggggtacccaacggggttaggaacgtaataccgaaaacgtacgttggtcggtctcgacctaaccctagttccgtagttcctttaccaactttcccgttcccgacctacg

SEQ ID NO: 10995 - DNA, 557 bp, Homo sapiens
  misc_feature: GYAE6OF02GIGGS.2.87.H10.1.454.CMB.1.raw
  modified_base (275)..(275): a, c, t, g, unknown or other
  misc_feature (275)..(275): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacacctatttaaattggtatcagcaaaaaccagggaaancccctaggctcctcctctactctgcaagcagcttgcatgctggggtcccatcaagattccgtggcagtggatctgggacagaattcactctcacgatcacctagtctggaacctgacgtactttgactaacttacttctgtacaaaactagttaccaccttacccgtactaactttcggaccctaacgggggaccctacgggtaggaacgtaactaccgaaaacgtacgtggtacggctaggccaaccgtattctgtccttacacttccttccccgctaacg

SEQ ID NO: 10996 - DNA, 593 bp, Homo sapiens
  misc_feature: GYAE6OF02GNAHN.2.87.H10.1.454.CMB.1.raw
  modified_base (339)..(339): a, c, t, g, unknown or other
  misc_feature (339)..(339): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtatttacaccttatttaaattggtatcagacaaaaaccagggaaagcccctaggctcctcctctactctgcaagcagcttgcatgctggggtcccatcaagattccgnggcagtggatcgtgggacagaattcactctcacgatcaccagtctggaacctgacgtactttgactaacttacttctagtacaaaactacgttaccacccttacccgtaactaaccgtttcggacccgtaacggggacccacgggtggaacgaacgtaccgaaacgtacgttggtacggacctacgacctaacccgtaacttccgttacggttcctttaccgtaacctttcccgtttacccccggaccttaacg

SEQ ID NO: 10997 - DNA, 571 bp, Homo sapiens
  misc_feature: GYAE6OF02HTQWG.2.87.H10.1.454.CMB.1.raw
  modified_base (373)..(373): a, c, t, g, unknown or other
  misc_feature (373)..(373): n is a, c, g, or t
  modified_base (492)..(492): a, c, t, g, unknown or other
  misc_feature (492)..(492): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtacaagtcagtagttatttacaccttaatttaaattggtatcagacaaaaaccaggaaacgccctaggctcctctctactctgcaagcagcttgcatgctcggggtcccatcaagtacttacgtgcagtgatcgtaggacagaattcgactcncacgatcacctagtctacggaaccttgaacgtacttgactaacttacttcttagtacaaactagttaccacccttccgtaacctaacgttcggaccgaagggaccctacggtacggaanacttacgaaaccgtacgtggtacggcttcggaccacctacgttccttgttccttataccgttccttccccgaccttacg

SEQ ID NO: 10998 - DNA, 696 bp, Homo sapiens
  misc_feature: GYAE6OF02IH5NC.2.87.H10.1.454.CMB.1.raw
  modified_base (549)..(549): a, c, t, g, unknown or other
  misc_feature (549)..(549): n is a, c, g, or t
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacagtcccggtgacccagtcctccctccctccctgtcctgcttctgttaggagacagacgtccaaccatcacttcgccgtacaagtcaagtagttacttacaccttaatttaaattggtaatctagacaaaaaccgaggaaactccccgtaaggcctcctctactactctagccaagccagtcttgctaatcgacgtcggggtacccagttacaacgtacttcccggtaggactaacggttgggtaacttccggtaggggaaacctaggttaaaacgtttcccgaaaccttccgtacgtaaccggtaacctaccaaccgtacgttaccgttacgggtaaacccttggtaacccgttaactttcggacccttaaacgtttcttacgttacgtaactaaaacncgttaaccacccttaccgaactaacgtttcggacccgtaagggacctacggtcggaaatactaaccgaaacgtacgtggttacggctacggacctaaccgtacttccgtgttacccttacgtaactttccccttaccccgatacccg

SEQ ID NO: 10999 - DNA, 597 bp, Homo sapiens
  misc_feature: GYAE6OF02GOYHS.2.87.H10.1.454.CMB.1.raw
  modified_base (276)..(276): a, c, t, g, unknown or other
  misc_feature (276)..(276): n is a, c, g, or t
  modified_base (342)..(342): a, c, t, g, unknown or other
  misc_feature (342)..(342): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctccctccctccctgtctgcttctgttggagacagagtcaccatcacttgccgtcaagtcagagtattacaccttatttaaattggtatcagacaaaaacagggaaacncccctaggctcctcctctactctgcaagcagcttgcatggctcggggtcccatcaagacttccggnggctaggtgatcgtgggacagaattcactctacacgtactcacctagtctacggaacctgactacttagacctaacttcttactacgtaaccaaactcgttaaccacccttacccgtaataaccgtttcggaccgtacggggaccctacgggtacggacgtaacgtaccgaaacgtacgtcggtaggtccgtacgaccctaacctacgttccgttcgttaccttacctacgtttccccttaccccggacttaccg

SEQ ID NO: 11000 - DNA, 584 bp, Homo sapiens
  misc_feature: GYAE6OF02F7DUL.2.87.H10.1.454.CMB.1.raw
  modified_base (221)..(221): a, c, t, g, unknown or other
  misc_feature (221)..(221): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctcctgtctgcttctgttggagacagagtcaccatcacttgccggtnaagtcagagtattacactattaaattggtatcagacaaaaaccagggaaacgcccctaggctcctcctctactctgcaagcagcttgcatgcgtggggtcccatcaagacttccgtggcagtggatcgtgggacagaattcactctcacgatcaccagtctggaacctgacgtactttgactaactttcttctagtaaccaaaactagttacccacccgttaccccgttaactaaccgtttcggacccgtaacggggaccctacgggttaggacgtaacgtacgaaacgtacgtggtacgggctacggacctaacctagttccgttacgttcctttacctacttcccgttccccgacttaacg

SEQ ID NO: 11001 - DNA, 580 bp, Homo sapiens
  misc_feature: GYAE6OF02JWXPF.2.87.H10.1.454.CMB.1.raw
  modified_base (198)..(198): a, c, t, g, unknown or other
  misc_feature (198)..(198): n is a, c, g, or t
  modified_base (224)..(224): a, c, t, g, unknown or other
  misc_feature (224)..(224): n is a, c, g, or t
  modified_base (273)..(273): a, c, t, g, unknown or other
  misc_feature (273)..(273): n is a, c, g, or t
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
  modified_base (331)..(331): a, c, t, g, unknown or other
  misc_feature (331)..(331): n is a, c, g, or t
  modified_base (519)..(519): a, c, t, g, unknown or other
  misc_feature (519)..(519): n is a, c, g, or t
  modified_base (576)..(576): a, c, t, g, unknown or other
  misc_feature (576)..(576): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacagtcccggtgacccagtcctccctccctcctgtctgcttctgttganacagagtccaccatcacttgccgtanaagtcagtattattacacttatttaatgtatcagacaaaacgaggaacnccctagctctcctctactcgnacaagcagtctncatcgcgtgggtcccatacaacgtntccggtgactaggtcgacttcggtaggactaagtaacttcactctacgacactccacgtacgttcgacgtaaccgtgtaccgtaactttcggaaccttaactttaacgttcttaagtaacctaaaacgtcgttaacccacccttacccgttataacgtttcggaccgacgggtccctaagggcgtaanacgaactaacgctcggtacgctagcccatacgtcttacgtcctatacgtctacccgntacg

SEQ ID NO: 11002 - DNA, 508 bp, Homo sapiens
  misc_feature: GYAE6OF02HX9ZS.2.87.H10.1.454.CMB.1.raw
  modified_base (409)..(409): a, c, t, g, unknown or other
  misc_feature (409)..(409): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtattacacctattaaattgtatcagcaaaaacaggaaagccctaggctcctctctactctgcaagcagcttgcatgctgggtcccatcaagattccgtggcagtgatctgggacagaatcactctcacgatcaccagtctggaacctgacgtacttgcaacttactctgtacaaaacngtacacctcccgtaacaactttcgaccagggaccacggtggaagatacaaacgactgtggctcgcaaccatctgttcttacaacttcttccccgctaac

SEQ ID NO: 11003 - DNA, 724 bp, Homo sapiens
  misc_feature: GYAE6OF02HSP32.2.87.H10.1.454.CMB.1.raw
  modified_base (308)..(308): a, c, t, g, unknown or other
  misc_feature (308)..(308): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctcctgtctgtcttcgtgttggacgacagacgtcaccatctacgttggcgtcaagtcagatattacacttaattaattgtatcagacaaaacgaggaacgccctaggctccgtctctactctgacaagcgancttgacagtgccgttcggggtccctaagtacgtaaaggtactttcccggaggacgtaaggttcggacttcggtagggaactacgtaaacttacaaccgttcctacgtaacgtacgtacaaccgtacgttaccgtacggaaacccgtagaaccgttaacgtttaggaaccttaaacctttaacggttacttacggtaaacctaaaaaccgttaaccgttaaaccctaccccgttaacccccgttaaattaaacccggttttacggaaccccggtaacgggggtaacccgtaaccggggttaggaaacgttaaacgtaacctaaacggtaaccgttcggtacggtacgttaccgactaaacccgtagttccgtacgtttccgttaccgttaccgtaccctttaccccggacttaaccg

SEQ ID NO: 11004 - DNA, 590 bp, Homo sapiens
  misc_feature: GYAE6OF02HN4XW.2.87.H10.1.454.CMB.1.raw
  modified_base (275)..(275): a, c, t, g, unknown or other
  misc_feature (275)..(275): n is a, c, g, or t
  modified_base (337)..(337): a, c, t, g, unknown or other
  misc_feature (337)..(337): n is a, c, g, or t
  modified_base (440)..(440): a, c, t, g, unknown or other
  misc_feature (440)..(440): n is a, c, g, or t
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacatcccggtgacccagtctccctccctccctgtctgcttctgttggagacagagtcaccatcacttgccgtcaagtcagagtattacaccttaatttaaattggtatcagacaaaaacaggaaacncccctaggctcctcctctactctgcaagcagcttgcatgcgtgggtccatcaagtacttcgnggacaggtggatcgtaggacagtaattcactcctacaacgtactaccaccgtacgtcgtacggaacctgtaaccgtactttcgacctaactttacttcgttanaactaaaactacgttaaccaccccttacccgtaactaacgtttcggaccgtaacggggacctacgggtaggaacaacgtacgaaaacgacgttggacgctacgaccaaccgtattcgtcgttcctataccgttcccttccgaccttaacg

SEQ ID NO: 11005 - DNA, 662 bp, Homo sapiens
  misc_feature: GYAE6OF02I61DD.2.87.H10.1.454.CMB.1.raw
  modified_base (271)..(271): a, c, t, g, unknown or other
  misc_feature (271)..(271): n is a, c, g, or t
  modified_base (292)..(292): a, c, t, g, unknown or other
  misc_feature (292)..(292): n is a, c, g, or t
  modified_base (305)..(305): a, c, t, g, unknown or other
  misc_feature (305)..(305): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttcggccgtcaagtcagtatattacactatttaattgtatcagacaaaacgaggaacnccctagctcctctctactctncagcagcttgacngtcgtcgtcgggtcctatacgtaacgtcgttccgtggaccgtaggtcggtacgtcgtacggggaactacggtaacttcctaaccttcgtacctaacgtactaccgaaccctacgttccgtaacggtaacccgttacggtaacgttacgtttcgaaccttaaacctttccgtttactacgtaactaaaactaccttaacctaccccgttaaccccgttaacttaccggtttaccggaccggtaacgggtacccgtaacggtaggactaaacgtacaaacggtacgttggtaccggtctcggacctacgtacttacgttcttacctttaccgacgtttacccgttaccccgtacttacg

SEQ ID NO: 11006 - DNA, 686 bp, Homo sapiens
  misc_feature: GYAE6OF02JCBJM.2.87.H10.1.454.CMB.1.raw
  modified_base (456)..(456): a, c, t, g, unknown or other
  misc_feature (456)..(456): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctcctgtctgcttctgttggagacagagtcaccatccacttgccgtcaagtcagagttattacacttattaattggtatcagacaaaaaccgaggaaacgacccgtaggactcctcctctactctgacaagcagcttgctatcgtcgtcggggtaccagtcaagtacttccggtaggccgtagtaggacttcgagggacaagtacttcacttctcgaacgacttcgaacctagtccgtaacgaccgtacgtaccgtactttacgacccttaactttaccttnttacgttaacgtaaaacgttacgttaaccctaccccgttaccccgttaaaccttaaccgttttaccgggacccgtaacggggaacccgttaacggggtacggaacggtaacgtaaccgaaaccgtaccgttaggttcccgggaccgtttaagacccgtaacccgtacgtttacccgttacgttaccctttaaccttaccgttttacccctttaccccggacctttaaccg

SEQ ID NO: 11007 - DNA, 539 bp, Homo sapiens
  misc_feature: GYAE6OF02JGBR6.2.87.H10.1.454.CMB.1.raw
  modified_base (419)..(419): a, c, t, g, unknown or other
  misc_feature (419)..(419): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctcctccctgtctgcttctgttggagacagagtcaccatcacttgccgtcaagtcagagtattacactatttaaattggtatcagcaaaacagggaaagcccctaggctcctcctctactctgcaagcagcttgcatgctggggtccatcaagattccgtggcagtggatcgtgggacagaattcactctcacgatcaccagttctcggaacctgacgtactttgactaacttacttctctacaaaacngttaaccaccctcccgtaactacttggaccacggggacctaacgggtcggaacgtaatacgaaacgtacgtaggtggctgaccaacctatctcgttctaccgtacttctacccgctaacg

SEQ ID NO: 11008 - DNA, 612 bp, Homo sapiens
  misc_feature: GYAE6OF02ITRPW.2.87.H10.1.454.CMB.1.raw
  modified_base (261)..(261): a, c, t, g, unknown or other
  misc_feature (261)..(261): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagtagttattacacctaatttaaattggtatcanacaaaaaccgaggaacgcccctaggctcctcctctactctcgacaagcagcttgctatgcgtcgggtacccatcaagtacttccggtgctaggtggatcgtggacagtaatcactctacacgatccaactcgtcgtacgaacctgtaaccgtactttgacctaactttaccttcttacgttaaccctaaaactcgttaccacccttaccccgtacttaaccgtttcggacccgtaacggggacctacgggtacggacgtaactaaccgaaaccggtacttaggtccggtcacgtaccaaccgtacgtttcgttacgttccttacctaccttacccgttacccgtctaaccg

SEQ ID NO: 11009 - DNA, 825 bp, Homo sapiens
  misc_feature: GYAE6OF02H9FAW.2.87.H10.1.454.CMB.1.raw
tcagacgctcgacacacgaccggtgctcgatttagcagtactgcgttggggtttgggggagtcagtctcagtcaggacacagcatggacatgagggtcccgctcagctcctggggctcctgctactctggctccgaggtgccagatgtgacatcccggtgacccagtcctcctccctcctgtctgcttctgttggagacagagtcaccatcacttgccggtcaagtcagagtattacaccttaattaatgtatcaagacaaaaaccgaggaacgcccctaggtcctcccttcctacctacctcgtcacaacgtcacgtccttagcctactcggtcgtcggggttccccagttaccgaaagtacgtttcccggtacggaccgtaggtcggaactttccggtaacgggggtaacctaaggtaaactttaccgtaacccgttacctaccgtaacccggtaagtaccctaacccggttaacggttacccggttacgggtaaaccccgttacgggtaaccgggttaaccgttttacgggaaacccgtttaaacccgttttaaccgtttaccgttaaccgttaaaccttaaaaacccgttaccgggttttaaaccccaacccccgtttaccccggttaaaaccgttaacccggttttaccgggaccccgggtaaacggggggtaccccttaaaccgggggttacgggaaaccggttaaacttaacccggaaaaccgtaacggttcggttaacgggtcctaacggaccctaaccgttaacgttacgtttacgttaccttaaccgtacctttcccgttaccccgacttaaccg

SEQ ID NO: 11010 - DNA, 611 bp, Homo sapiens
  misc_feature: GYAE6OF02J0U8Z.2.87.H10.1.454.CMB.1.raw
  modified_base (196)..(196): a, c, t, g, unknown or other
  misc_feature (196)..(196): n is a, c, g, or t
  modified_base (223)..(223): a, c, t, g, unknown or other
  misc_feature (223)..(223): n is a, c, g, or t
  modified_base (282)..(282): a, c, t, g, unknown or other
  misc_feature (282)..(282): n is a, c, g, or t
  modified_base (354)..(354): a, c, t, g, unknown or other
  misc_feature (354)..(354): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctcctgtctgcttctgttgganacagagtcaccatccacttgccggtanaagtcagtagttatttacaccttatttaaattggtatcagacaaaaaccgagggaaacncccctaggcctcctcctctactcagtcaagcagccttgcagtgtccgtcgggtcccaatcgaagtcgttcgngacagtggtatcgtagggacagtaacttacactctacagactccacgtagtctaggacctgacgtacttgacctaacgttacttctacgtaacaaactcgttaacccacccttaacccgtaacgtaccgtttcggaacccggacggggtaccttaacggggtagaacgtaacgacgtaaaccgagttcggacgtctaacggtacccaaccgttatccgtttagttcccttacgtaactttcccgttacccgctaacg

SEQ ID NO: 11011 - DNA, 529 bp, Homo sapiens
  misc_feature: GYAE6OF02GXHR6.2.87.H10.1.454.CMB.1.raw
  modified_base (327)..(327): a, c, t, g, unknown or other
  misc_feature (327)..(327): n is a, c, g, or t
  modified_base (375)..(375): a, c, t, g, unknown or other
  misc_feature (375)..(375): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttggcggtcaagtcagagtattacactatttaaattggtatcagcaaaaaccaggaaagcccctaggctcctcctctactctgcaagcagcttgcatgctgggtcccatcaagnttccgtggcagtggatcgtggacagtaattcactctcacgatcaccgngtctacggaacctgacgtactttgacctaacttacttctgtacaaaactgttaccaccctcccgtaactaccgtttcggaccaggggaccaggtggagactacgaaacgactgtggctagcaccattctacgttcttctactccttcccgctac

SEQ ID NO: 11012 - DNA, 583 bp, Homo sapiens
  misc_feature: GYAE6OF02GS7CN.2.87.H10.1.454.CMB.1.raw
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctcctgtctgcttctgttggagacagagtcaccatccacttgccggtcaagtcagtagtattacaccttaatttaaattggtatcagacaaaaaccgagggaaacgcccctaggctcctcctctactctgcaagcagcttgcatgcgtggggtcccatcaagtacttccgtggcaggtggatcgtagggacagaattcactctacacgataccaccagtctaggaacctgacgtactttagaaactttacttacttagtaccaaaactgttacccaacccttaccccgtaactaacctttcggacccgtaacgggggacctacgggtggaacgtactaaccgaaacgtacgtgtcggctcgacctacctattccttgttaccttctacgttcccttacccgctattccg

SEQ ID NO: 11013 - DNA, 807 bp, Homo sapiens
  misc_feature: GYAE6OF02FYD0E.2.87.H10.1.454.CMB.1.raw
  modified_base (299)..(299): a, c, t, g, unknown or other
  misc_feature (299)..(299): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacacgtcccggtgacccagtctccctccctccctgtctgcttcgtgttggagacagagtcaccatcacttgccgtcaagtcagtagtattacacttaattaattgatacagacaaaacgaggaaacgcccctagctcctcctctactctncaagcagcttgacatcgcgtcgggtacccatacgtaaagtacgttccggtggcgtaggtacggtaagtccggtaggggtaaccaaaggttaaacttaccgtaaccttaccgtaccgaaaccgtactaacccaacccgtaacggtttaccgtaaccgggtaaacccttacgggaacccgtttaaccgttttacggaaccctttaaaaccctttttaccgttacctttaacggtaaaaaccctaaaaaccgttaaccggtttaaacccctaacccccggttaaccccccgtttaaactaaaaccccggtttttccggggaaccccggggtaaacggggggtaacccccgttaacggggttaacgggtaaacccggtaactaaaacccgtaaaacggtacccggtttacgggtacgggtaacccgttacggaacccctaaaccttaccgttaccgttccgtttaacccgtttaccgtaaccctttacccggtttacccccgaccttaacgg

SEQ ID NO: 11014 - DNA, 581 bp, Homo sapiens
  misc_feature: GYAE6OF02FPQ4K.2.87.H10.1.454.CMB.1.raw
  modified_base (276)..(276): a, c, t, g, unknown or other
  misc_feature (276)..(276): n is a, c, g, or t
  modified_base (559)..(559): a, c, t, g, unknown or other
  misc_feature (559)..(559): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttggcggtcaagtcagagtatttacactatttaaattggtatcagacaaaaaccgaggaaacncccctaggcctcctcctctactctgacaagcagctgcatgcgtgggtcccatacaagtcttccggtggctagtggatcgtaggacagtattcactcacacgatacactagtcaggacctgacgtactttgactaactttctctacgtaactaaactcgttaccaacccttacccgtaataccgtttcgggaccctacggggacccacgggtagaacgttaacacgtaaaccgtactacggtcggccttaggaccctaactacttccgtaccgttacgttaccnccttacccgttccccgctaacg

SEQ ID NO: 11015 - DNA, 721 bp, Homo sapiens
  misc_feature: GYAE6OF02HICBX.2.87.H10.1.454.CMB.1.raw
  modified_base (166)..(166): a, c, t, g, unknown or other
  misc_feature (166)..(166): n is a, c, g, or t
  modified_base (276)..(276): a, c, t, g, unknown or other
  misc_feature (276)..(276): n is a, c, g, or t
tcagacgctcgacacacgaccggtgctcgatttagcagtactgcgttggggtttgggggagtcagtctcagtcaggacacagcatggacatgagggtccccgctcagctcctggggctcctgctactctggctccgaggtgccagatgtgacatcccggtgacccngtcctccctccctcctgtctgcttctgttggagacagacgtcaccatcacttgccggtcaagtcagatatttacaccttaatttaatgtatcagaacaaaacgaggaacnccctaggcctcctcctctactctgacagcagtcttgctagtcggcggttcgggtacccctagtacgtaacggtcgttcccgtgggacctagggtaggtactcggtacgggaacgtaacgttaaccttacctacttaccctacgtaaccgtactacccgtaaaccgttacggtaccgttaaccggtaacccgttacgtaaaccgtttcgtttacgtaaccttaaaccgttttcctttaccgttaaccgttaaactaaaaccgttacgtttaacccccaaccccgtttacccgttaaacttaaccggtttccgggacccgaacggggtacccgtaacgggtacggaacgttaactaaccgaaaacggtccgttaggacggtaccgcgtacctaaccggttactacgttcgtttacctaccgttaccgtttcccgtaccctacgtacg

SEQ ID NO: 11016 - DNA, 578 bp, Homo sapiens
  misc_feature: GYAE6OF02I3PNN.2.87.H10.1.454.CMB.1.raw
  modified_base (280)..(280): a, c, t, g, unknown or other
  misc_feature (280)..(280): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctgctttctgttggagacagagtccaccatcacttgccggtcaagtcagagttattacacctatttaaattggtatcagacaaaaaccagggaaancccctaggctacctcctctactctgcaagcagcttgcatgcgtggggtcccatcaagcttccgtggcagtggatcgtgggacagtaattcacttctcacgatccaaccgtgtctacggaaccctgaccgtacgtttacgacctaacctttacttctacgtactaaaacgtcgttaaccacccttaccccgtaactaacgtttccggaccgacggggtaccacgggttgacgaactaccgaaacgtacgtcgtaggcctagcaacctatctgttccttacacttcccttcccgcctacg

SEQ ID NO: 11017 - DNA, 623 bp, Homo sapiens
  misc_feature: GYAE6OF02GBUZP.2.87.H10.1.454.CMB.1.raw
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacatcccggtgacccagtcctccctccctccctgtctgtccttctgttaggagacagagtcaccatcacttgccgtcaagtcagtattattacacctatttaattggtatcagacaaaacgaggaacgcccctaggctcctcctctactctgacaagcagtcttgcatgtcgtcgggtcccatacaagtattccgtgctagtgactcgtaggacgtaagtaacttacactacgtactacgactactacccagtccgtacggtacctacgtacgtaacgttcgaccttaactttacttactacgttaactaaaccgttactaaccctaccgtaacccgttaacctacgtttaccggaccgtaccgggtaaccgtacgggtagaccgtaagtaaccgaacgtaccgtgtacgggtctacggacgtaaccctgttacccgttcgtacctttccgacgtttcccttaccccgtctaccg

SEQ ID NO: 11018 - DNA, 708 bp, Homo sapiens
  misc_feature: GYAE6OF02FY59X.2.87.H10.1.454.CMB.1.raw
  modified_base (223)..(223): a, c, t, g, unknown or other
  misc_feature (223)..(223): n is a, c, g, or t
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctcctccctccctgtctgcttctgttggagacagagtcaccatcacttgccggtnaagtcagagtattacactattaatgtatcanacaaaacaggaacnccctagctcctcctctactctgacagcagcttgcagtgcgtcgggtccatacaagtacttccggtaggacaggtgatcgtaggacagtaattcaccgtctacgacgactaccgactacggtaccgtacggtaaccctcgtaaccggttacctttacggaacccttaaaccttttaccgttaccttacgttaaacccgtaaaaaccgttaccgtttaacccctaaccccgtttaacccccgttaaacgttaaccggtttcccgggaacccgtaaaccgggggtacccgtaacgggggttacggtaaaccgtaacgttaacccgtaaaacggtaacggtccggttacggtacccgttacggaacccgtaacccgttaacgtttaccgtttaccggttccgttttaaccctaccgtttacccccgttacccggacccttaccg

SEQ ID NO: 11019 - DNA, 545 bp, Homo sapiens
  misc_feature: GYAE6OF02GCA96.2.87.H10.1.454.CMB.1.raw
  modified_base (227)..(227): a, c, t, g, unknown or other
  misc_feature (227)..(227): n is a, c, g, or t
  modified_base (274)..(274): a, c, t, g, unknown or other
  misc_feature (274)..(274): n is a, c, g, or t
  modified_base (342)..(342): a, c, t, g, unknown or other
  misc_feature (342)..(342): n is a, c, g, or t
  modified_base (499)..(499): a, c, t, g, unknown or other
  misc_feature (499)..(499): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacactcccggtgacccagtcctccctccctcctgtctgtcttctgttggagacagagtcaccatcacttcgccggtanaagtcagtatattacactatttaatgtatcagacaaaacgaggaacnccctaggctcctcctctactctgacaagcagctgcatgtcgtcgggtacccatacgaagtacttccgngcagtgatcgtggacagtaatcactctacaacactccactgtctacgactagacgtcttagactacttacttcataacaaactagttaccacctaccctaactaacgttggaccgagggtaccacgggtagagaactaacgaacgtacgtggtacgntacgacaccttatcgtattccgttataccgtccttacccgattacg

SEQ ID NO: 11020 - DNA, 577 bp, Homo sapiens
  misc_feature: GYAE6OF02FODCQ.2.87.H10.1.454.CMB.1.raw
  modified_base (340)..(340): a, c, t, g, unknown or other
  misc_feature (340)..(340): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctcctccctccctgtctgcttctgttggagacagagtcaccatcacttgccggtcaagtcagagtattacaccttatttaaattggtatcagacaaaaaaccgagggaaagcccctaaggctcctcctctactctgcaagcagcttgcatgctgggtcccatcaagattccgnggcagtggatcgtggacagtaattcacttctacacgtatacaaccagttctacggaacctgacgtaactttgacctaacttacttctagtacaaaactgttaaccacccttaccccgtaataaccgttttcggaccgtaacggggaccacgggtagaacgatacgaaacgtacgtgtacggtctacgacctaacacgttctcgtttaccttcgaacttcccgttacccgacttaacg

SEQ ID NO: 11021 - DNA, 551 bp, Homo sapiens
  misc_feature: GYAE6OF02IK94M.2.87.H10.1.454.CMB.1.raw
  modified_base (519)..(519): a, c, t, g, unknown or other
  misc_feature (519)..(519): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtctccctccctccctgtctgcttctgttggagacagagtcaccatcacttggcgtcaagtcagatattacactattaaattggtatcagacaaaaaccaggaaacgcccctaggctcctcctctactctgcagcagtcttgcagtgcgtcggggtcccaatcgaagtacttccggtggctagtcggtatcgtgggaacagtaagttcaactctacacgatccaacctagtctaggaacctgaacgtcttgactaacttcttctgtacaaactcgttaccacctcccgtataacgtttcgaccgacgggacgacggtaggagtaactacaaacgtactggcggctcgccacctntccgtgttacttccacttccttccccgcttac

SEQ ID NO: 11022 - DNA, 725 bp, Homo sapiens
  misc_feature: GYAE6OF02H01O1.2.87.H10.1.454.CMB.1.raw
  modified_base (263)..(263): a, c, t, g, unknown or other
  misc_feature (263)..(263): n is a, c, g, or t
  modified_base (279)..(279): a, c, t, g, unknown or other
  misc_feature (279)..(279): n is a, c, g, or t
  modified_base (302)..(302): a, c, t, g, unknown or other
  misc_feature (302)..(302): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctccctccctgtctgtcttctgttggagacagagtcaccatcacttcgccggtacaagtcagagttacttacacttaattaattgtatcanaacaaaacgaggaacnccctagcctcctctctactctancaacgcagtctgacagtgcgtcgggtccatacgaagtacgttccggtaggcgtaggtaggtactacggtacggtactaagtaacttcgtaacctctaccgaacgtactaccgtaacgtacgttaccggtaacgtaaccgtcgttaaaccgttacgtttacaaccgttttaaacctttacgttaccgttaacggtaaacccttaaaacgttacgtttaaaccccaccccgtttaacccgtaaaccgtttaaccggtttacccgggaccgggtaaaccggggtacccgtacgggttacgggaaacgtaaccgtaaccgtaaaaccggttacgtcgggtaaccgtccgtaacccggtaccaaccgttaccgttcgtttaaccgttccttaaccgtcccctttcccggttaccccgtacttaaccgg

SEQ ID NO: 11023 - DNA, 764 bp, Homo sapiens
  misc_feature: GYAE6OF02H5K11.2.87.H10.1.454.CMB.1.raw
  modified_base (160)..(160): a, c, t, g, unknown or other
  misc_feature (160)..(160): n is a, c, g, or t
  modified_base (204)..(204): a, c, t, g, unknown or other
  misc_feature (204)..(204): n is a, c, g, or t
  modified_base (226)..(226): a, c, t, g, unknown or other
  misc_feature (226)..(226): n is a, c, g, or t
  modified_base (258)..(258): a, c, t, g, unknown or other
  misc_feature (258)..(258): n is a, c, g, or t
  modified_base (260)..(260): a, c, t, g, unknown or other
  misc_feature (260)..(260): n is a, c, g, or t
tcagacgctcgacacacgaccggtgctcgatttagcagtactgcgttggggtttgggggatcagtctcagtcaggacacagcatggacatgagggtccccgctcagctcctggggctcctgctactctggctccgaggtgccagatgtgacatcccggtnaccctgtcctccctccctccctgtctgtcttctggttggagacngtagcaccatcacttgccgtanaagtcagtatacttacgacttattaatgtatnanacaaaacctaggaacgccctaggctcctcctcgtacgtctcgacaagtcgagtcttggcctagtcggtcgttacgggtcccagttacaaagtacgttaccggtggactaaggtacggacttacggtaagggaacctaagtaacctttactaaaccggtccttaccgtaacggtaacttacaaccccgtaagttaccgtaacggtaaacccgttacggtaaacgttacgtttacggaactttaaacctttaccgttaacgttacgtaaactaaaaacgttaccgtttaaacccacccgttaaccccgttaaagtaaccgttttacgggaacccgtaaacggggtaccctaacggggttaacggaacgtaaaccgttaaaccgaaaaccggtttacgtaacgggttacgggtaaccgttaacccggttacccaaaccgttaccgtttaacgttcggtttaccctttaccggttaacccgttttaccccgttaccctacgttaccgg

SEQ ID NO: 11024 - DNA, 894 bp, Homo sapiens
  misc_feature: GYAE6OF02IZ246.2.87.H10.1.454.CMB.1.raw
  modified_base (197)..(197): a, c, t, g, unknown or other
  misc_feature (197)..(197): n is a, c, g, or t
  modified_base (285)..(285): a, c, t, g, unknown or other
  misc_feature (285)..(285): n is a, c, g, or t
tcagacgctcgacacacgaccggtgctcgatttagcagtactgcgttgggtttgggggagtcagtctcagtcaggacacagcatggacatgagggtcctcgctcagctcctggggctcctgctactctggctccgaggtgccagatgtgacatcccggtgacccagtcctcctccctcctgtctgcttctgttgganacagagtcacctatcacttgccggtacaagtcagtagtacttaccaacttaatttaaattggtatacagaacaaaaaccgaggaaacnccctaaggcctacctctactactcgtcgacgaacgactacgtcgttacgcaagttcggccggttaccggggtaccccagttaaccgaaaggtaccgtttacccgggaggaccgtaggtacgggtaacttacgggtacgggtaactaaggtaaactttcctaaccgttactaccgaacggtaaccttaccgtaaacccggtaacggttccggtaaccggtaacccgttaacgggaacccgtttaacgttttaccggtaaaccctttaaaaccgtttttaaccgtttaccgttaaacggttaaacccgttaaaaaaaccgtttacccggttttaaacccgaaacccccccttttaaaccccggggttaaaacctttaaacccggttttacggggaaccccgggtaaaccggggggttaaacccgttaaacgggggttaaacggtaaacgtaaacccggttaaacccgtaaaaacccgttaaccggtttacgggggttcccgaaccggtttaaccggtaaccccgtaacccgtttaagtttaaccccggtttacgtttaacccccgttttaccgtaccggtttttaccccccgtacccccgtttaaacccgg

SEQ ID NO: 11025 - DNA, 609 bp, Homo sapiens
  misc_feature: GYAE6OF02G6JLJ.2.87.H10.1.454.CMB.1.raw
  modified_base (163)..(163): a, c, t, g, unknown or other
  misc_feature (163)..(163): n is a, c, g, or t
  modified_base (228)..(228): a, c, t, g, unknown or other
  misc_feature (228)..(228): n is a, c, g, or t
  modified_base (271)..(271): a, c, t, g, unknown or other
  misc_feature (271)..(271): n is a, c, g, or t
  modified_base (305)..(305): a, c, t, g, unknown or other
  misc_feature (305)..(305): n is a, c, g, or t
  modified_base (351)..(351): a, c, t, g, unknown or other
  misc_feature (351)..(351): n is a, c, g, or t
  modified_base (541)..(541): a, c, t, g, unknown or other
  misc_feature (541)..(541): n is a, c, g, or t
  modified_base (578)..(578): a, c, t, g, unknown or other
  misc_feature (578)..(578): n is a, c, g, or t
tcagacgctcgacacacgaccggtgctcgatttagcagtactgcgttgggtttgggggagtcagtctcagtcaggacacagcagtggacatggagggtcccgctcagctcctggggctcctagctactctcggctccgaggtgccagatgtgacatcccggtnacccagtcctcctccctcctgtcctgctttctgttaggagacagagtcaccatcacttggccgtnaagtcagagtattacacttattaactgtatcagacaaaaaccngaagaaacgcccctaggcctacctcctctactcncgacagcagtcttcgcatcgcgtcgggtcccatcaagtacttccgngcaggtgatcgaggacagtaacttcaacgttcctacgaacgactaccgtaaccgtaggttccgtacggaaacccgtcggaaccgttacgttttacgaccttaaaccgtttaccttcgttacgtaaccaaaactcgttaccaccctacccgtaactacgtttcggaccgtacgggacctagggtacggaanactaaccgaacgtacgtcggtacgcctacgcctactnttccgtcgttccttcaccgttccctaccgtc

SEQ ID NO: 11026 - DNA, 681 bp, Homo sapiens
  misc_feature: GYAE6OF02IX2DH.2.87.H10.1.454.CMB.1.raw
  modified_base (226)..(226): a, c, t, g, unknown or other
  misc_feature (226)..(226): n is a, c, g, or t
  modified_base (259)..(259): a, c, t, g, unknown or other
  misc_feature (259)..(259): n is a, c, g, or t
  modified_base (261)..(261): a, c, t, g, unknown or other
  misc_feature (261)..(261): n is a, c, g, or t
  modified_base (275)..(275): a, c, t, g, unknown or other
  misc_feature (275)..(275): n is a, c, g, or t
  modified_base (296)..(296): a, c, t, g, unknown or other
  misc_feature (296)..(296): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacactcccggtgacccagtcctccttccctccctgtcctgcttctgttggagacagagtcaccatcacgttgccgtnaagtcagagttattacacttattaaattgtatnanacaaaacaggaacnccctagctctcctctactctnacaacgtcagtcttgcatgacgtcgggtcccagtacgtaagtcgttccggtggactaggtcggtactcgtaacggggaactaagtaacttcctaacctaccgtaccacgtactaccaacctacgttaccgtacggtaacctggtaaccgtactttacgaccttaaactttaccttacgtaacgtaaacctaaaaccgtcgttaaaccctacccgttacccgttacttaaccgttccgggtaaccggaacgggtaaccgtaaccgggttagaacgtaacgtaaccgtaaaaccgtacgttggtccgggtactaccggtacctaaccgttacttccgtttaccgttaccgtttaccgtaccgtttaccccgttacccgacttaaccg

SEQ ID NO: 11027 - DNA, 726 bp, Homo sapiens
  misc_feature: GYAE6OF02JNHU1.2.87.H10.1.454.CMB.1.raw
  modified_base (165)..(165): a, c, t, g, unknown or other
  misc_feature (165)..(165): n is a, c, g, or t
  modified_base (272)..(272): a, c, t, g, unknown or other
  misc_feature (272)..(272): n is a, c, g, or t
tcagacgctcgacacacgaccggtgctcgatttagcagtactgcgttgggtttgggggagtcagtctcagtcaggacacagcatggacatgagggtccccgctcagctccgtgggctcctgctactctggctccgaggtgccagatgtgacatcccggtgacccngtctcctccctcctgtctgcttctgttgagacagtagtcacatcacttggccgttcaagtcagtagtattacacttaattaattgtatcagaacaaaacgaggaacnccgtagtctacctctctactcgtcgactaagctagtcttagactagtcgtacgtcgggtaccagttacaaacgtcgttaccggtacggcgtacggtaggtacgttacggtacgggtaacgtaacgttaacttaccgtacgttccgttaccgaacgtaacgtaccctaaccgtagttaccgtaacggtaacccgtagtacccggtaagtttaccgtaaccgttaaaccgttttaccgtaccgtttaaacgttaaaccgtaaaccgttaaccggttaaccctaaccccgttacccgttaaacgttaacccggtttcggaaacccggtaccgggtaaccgtaacgggttacgtaaacgtaacgtaaccgtaaaccgtacgttcgtaaccggtcgtaccacgttaacccgtacgttacgtccttaacgtccgtaccgttcccgttacccgcctaacgg

SEQ ID NO: 11028 - DNA, 831 bp, Homo sapiens
  misc_feature: GYAE6OF02GD1MT.2.87.H10.1.454.CMB.1.raw
  modified_base (237)..(237): a, c, t, g, unknown or other
  misc_feature (237)..(237): n is a, c, g, or t
  modified_base (286)..(286): a, c, t, g, unknown or other
  misc_feature (286)..(286): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtcgccagatgtgacagtcccggtgacccagtcctccctcccctccctgtctcgtcttcgtggttaggacgacaggagtccaccatcacgttgccggtanaagtcagtatattacacttattaattgtatcagacaaaacgaggtaacncctagctccgtactctactctgacaagcagtcttagacctagtcgcggttacggggtacccagtaccgtaaagttaccgtttccggtcgacggtaggttagggtaactcggtaaggggaaactaacggttaaactttccgaaccgttaccgttaccgtaacgggtaactttaccccgaaaccgtacgggttaaccgtttaaccgggtaaaccgttccggtaaaccgtttaccgtttaaccgaaccgttttaaccctttaacgtttacctaaccggtttaaaccaaaaaccgtttacccgtttaaacccgttaacccccgttacccccgttaaacgtaaaccgtttttccgggaaccccgggtaaacgggggtaacccgtaaccggggttaggaaaccgttaaacgtttaaccccgaaaacggttcccgtttaaggggtacccggttctaaccccggaacccgtaaaccgttcggtttaccttttacccggtaccgtttttaaccgaacccggttttcccccgttaccccggttaccgttaacccg

SEQ ID NO: 11029 - DNA, 739 bp, Homo sapiens
  misc_feature: GYAE6OF02JH4E7.2.87.H10.1.454.CMB.1.raw
  modified_base (225)..(225): a, c, t, g, unknown or other
  misc_feature (225)..(225): n is a, c, g, or t
  modified_base (334)..(334): a, c, t, g, unknown or other
  misc_feature (334)..(334): n is a, c, g, or t
  modified_base (369)..(369): a, c, t, g, unknown or other
  misc_feature (369)..(369): n is a, c, g, or t
tcagacgctcgacacacgaccggtgctcgatttagcagtactgcgttgggtttgggggagtcagtctcagtcaggacacagcatggacatgagggtcccgctcagctcctggggctcctgctactctggctccgaggtgccagatgtgacatcccggtgacccagtcctcctccctcctgtctgcttctgttaggacgacaggactcaccatcacttgccggttnaagtcaagtagttacttaacaccttaatttaaattggtattcagacaaaaaccgaggaacgcccgtaagccttacctccgtcttacctgtacgacaagtccgtagcttncctatcgtctcggggtccaatcgaagtacttcggnggctaggtgtacgtcgtacgggacaagtactcacctcgtacaacgctcaaccgtaggtcgtacggtacccgtagtaacgttacgttagacccgttaactttaccgttctaaccgtttaacgaaaaaccgttaccgttaacccgccccgtttaaccccggtaaaccgtttaccggttttccggggaaccggttaaaccgggggtacccgtaaaccggggttaggaaacccgttaaacggttaaacccaaaaccgggttacccgtttgggaccgggttaccggttacccgtagtaaccccggttactttaccggttacccggttttaccttaccgtttaaccgtccccgtttaccccggtaccttaacccgg

SEQ ID NO: 11030 - DNA, 830 bp, Homo sapiens
  misc_feature: GYAE6OF02FTCAB.2.87.H10.1.454.CMB.1.raw
  modified_base (202)..(202): a, c, t, g, unknown or other
  misc_feature (202)..(202): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacacgtcccggtgacccagtcctccctccctccctgtctgcttctgttagganacagcgtaccaccatcacgttcgaccgtcaagtcagtagttattaccaccttaattaattggtactcaagaccaaaaaccgaggaaacgcccctaggcctccctcctcctactcgtagaccgaacgacgcgtcttacgacgtactcggtccgttaccggggtacccctagtaccgtaaacggtaccgtttccggtacggtacgtacgggttggtacgttcggtacgggaacgttaacggtaacttacccgtaccgttacctaccgaacccgtatacccgtaaccgacgttccgtaacggtaacccggtacgtaccgttaccgtttacgaacccttaaccgttttacccgttacgttaacttaaacccgtaaaacccgtttaccggttaaccccttaaccccccggttaaccccgtttaaacccgttaaacccgggtttaccgggaacccggggttaaacccggggacccggttaaccgggggtaacgtaaagggttaacccgtaaaccggttaaaccggtacggtttaccgggtcgggtaacctccgggaacctaacccgtaacgtttacccgtcgtttaacccttcccgtaacccggttccccctttaccccgggacctttaaccgg

SEQ ID NO: 11031 - DNA, 674 bp, Homo sapiens
  misc_feature: GYAE6OF02G0JQR.2.87.H10.1.454.CMB.1.raw
  modified_base (299)..(299): a, c, t, g, unknown or other
  misc_feature (299)..(299): n is a, c, g, or t
  modified_base (348)..(348): a, c, t, g, unknown or other
  misc_feature (348)..(348): n is a, c, g, or t
  modified_base (351)..(351): a, c, t, g, unknown or other
  misc_feature (351)..(351): n is a, c, g, or t
  modified_base (439)..(439): a, c, t, g, unknown or other
  misc_feature (439)..(439): n is a, c, g, or t
  modified_base (625)..(625): a, c, t, g, unknown or other
  misc_feature (625)..(625): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctccctaccctccctgtcctgcctttcgtgttggacgtacaggacgttccacctatccacgttcggccggtactaaagtccaggtattacttaccaccttaatttaagttggtatcgagtacaaaaaacgngggtaaaccgccccgtaggcctcctaccgtctacgtctgacagcaagtntancgatcggacgttcggggaccctagtaccgtaaagtccgttcggtcgggaccgtaggtacggtacttcggtacgggactaagtaccttnacgtctacgacgtactacctaaccggtactccgtaacggtacccttaggtaaccgtcttacgaaccgttaacttctttacgtacgtaacaaacttacgttaccctacccgttaccgtacgtaacgttccgaccgtacgggtaccgtcgtaggtactaagacccgttaaaggacttcgggaccggtntaccaccgtaacgtatcgtaacgtccttaatcgtccctccgtactacgg

SEQ ID NO: 11032 - DNA, 644 bp, Homo sapiens
  misc_feature: GYAE6OF02FLL33.2.87.H10.1.454.CMB.1.raw
  modified_base (278)..(278): a, c, t, g, unknown or other
  misc_feature (278)..(278): n is a, c, g, or t
  modified_base (285)..(285): a, c, t, g, unknown or other
  misc_feature (285)..(285): n is a, c, g, or t
  modified_base (593)..(593): a, c, t, g, unknown or other
  misc_feature (593)..(593): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggctccgaggtgccagatgtgacatcccggtgacccagtcctcctccctccctgtctgcttctgttcggagacagagtccacatcacttgccggtcaagtcagtagtatttaaccaacttatttaaattggtatacagaacaaaaaccgnggaaacnccccctagctcctacctctactctgacaaggctagtcttgactatcgcgttcgggtaccctaagtcaaagtcttccggtagacgtaggtacgactcgtagggtaacaagtaacttctacctctaccgacgtaactaccaccgtagtcgtacggtaaaccctggtaaccgttacgtttacggtacctaacttttacttacggttaactaaccgtaaaactaccgttaccacccttacccgtaacgtaccgtttcggaaccgtacgggtacctacgggtagactactaaccgaaacgtacgtacgtacgngtacacctactacgttactcgttctaccgtacttcccgtacccgtactacg

SEQ ID NO: 11033 - DNA, 735 bp, Homo sapiens
  misc_feature: GYAE6OF02FF81X.2.87.H10.1.454.CMB.1.raw
  modified_base (285)..(285): a, c, t, g, unknown or other
  misc_feature (285)..(285): n is a, c, g, or t
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacactcccggtgacccagtcctcctccctcctgtctgcttctgttggagacagagtcaccatcacttcgccggtacaacgtcagtagttattaccaccttaattttaagttggtatacagaacaaaaacgaggaacnccccgtaggcctcctcctctactctacgacagcacgtctagctagtcgtcggttccgggaccctagtacaacggttcgttcggtcggactaggtagtactcggtacgggaactacgtaacttccactacctacgacgtactacgtaaccgtacgttaccgtaacggtaacctacggtaaccgttaacgtttcgaacccttaaactttaccgttacgtaacgttaaacgtaaaaccttacgtttaaacccctaacccccgttaacccgttaacgttaaaccggtttccgggaacccggttaaacgggggtaccctaacggggtaggaaaccgttaacgtaaacccgtaaacggttcgttacgggacggttcctacggtaaccgtaacccttacgtaccgtttccgttaacccgtttaccgtaccgtttcccccggttacccgcgttaaccg

SEQ ID NO: 11034 - DNA, 961 bp, Homo sapiens
  misc_feature: GYAE6OF02H7V44.2.87.H10.1.454.CMB.1.raw
tcagacgctcgacacacgaccggtgctcgatttagcagtactgcgttgggtttgggggagtcagtctcagtcaggacacagcatggacatggacgggtccccgctcagctccgtggggctcctgctactctggctccggaggtcgccaggatgtcgacacgtcccggtagacccagttcctccctcccttcctgtctgtcttcgtgttggacgtacagtacgtacaccgtataccgtacgttcgggtccgtactaagtacgaagtacgtttaactttaacctaccgtttaaagttttaaacgtttggtaacgttaccaacggtaaaaccgaaaaaaccggtaagggggtaaaccccgtaaccccggttagggtacccctttaccccgttcccgtttaacgttacccgtaccgtacgaaccggtaacggaccgtacggttccgttacggacctacgggttccggtccgggttaaccggggtacccctaagttaccggaaacgttcgtttacccgggaggggtaccttgggtacggtacgttacgggtacgggtaaacttcggtaaacctttaaccgaccgtttacctacggtaccggtaccgtaccgtaaccggtacgttaaccgttaaccgggtaccgtacggttaacgttacccgttacggtaacctttaacgttaccgtttaaccgtacccgttaaaacgtaaacccgtttaaccggttaaccctaacccccggttaacccggttttaaaccgtaaccgggttttaccggaccgggggttaacccgggtaaccgggttaacgggtaaccgggttaaacgtaaccgttaaacccggtaaacggttaccggtaacgggttaccggtcggtaacccgtacgttaacccgttaccgtttacccgttacggtttacccttacccggtttaacccgtttcccggtttaacccccgtagttacccg

SEQ ID NO: 11035 - DNA, 701 bp, Homo sapiens
  misc_feature: GYAE6OF02GG0J7.2.87.H10.1.454.CMB.1.raw
  modified_base (163)..(163): a, c, t, g, unknown or other
  misc_feature (163)..(163): n is a, c, g, or t
  modified_base (223)..(223): a, c, t, g, unknown or other
  misc_feature (223)..(223): n is a, c, g, or t
  modified_base (366)..(366): a, c, t, g, unknown or other
  misc_feature (366)..(366): n is a, c, g, or t
  modified_base (605)..(605): a, c, t, g, unknown or other
  misc_feature (605)..(605): n is a, c, g, or t
tcagacgctcgacacacgaccggtgctcgatttagcagtactgcgttggggtttgggggagtcagtctcagtcaggacacagcatggacatgagggtccccgctcagctccgtgggctcctgctactcgtgctccgaggtgccagatgtgacacgtcccggtnaccccagtcctccctccctcctcgtctgcctttctggtaggacacagtacgtcctaaccntactccgttcggaccggtacaagtcgaagtatttaacttaccaacgtttaattttaaagttcggactacgaacgaacctaaaaaacggcgggtaaactccccgtaaggccttcctaccgtctaccgttgcgaactagcgtacncgttacgctactcggcggttccggtacctagtactaacgtacgttccgagccgtaggtagtactggacggaactacgtattccgactcgactaacgctactaacgtcgtacgtacgtaaccgtcgtaaaccgttacgttacgtaccctaatttacgtccgtaataaacctacgtaccgttacccgtacccgttaacccgttataacgggtttccgacgggaaccggtacgtacgggtanaaacgtacgtaacccgaacgttggtgtcggtaccttacggaacccttcgtactttacggtcgtttaccctacgtacttcccttacccgacccgtta

SEQ ID NO: 11036 - DNA, 900 bp, Homo sapiens
  misc_feature: GYAE6OF02HNPQZ.2.87.H10.1.454.CMB.1.raw
tcagacgctcgacacacgaccggtgctcgatttagcagtactgcgttgggtttggggggagtcagtctcagtcaggacacagcagtggacatgacgggtccccgctcagctccgtggggctcctgctactcgtggctccggaggtcgccgagatggtacgacacgtcccggtagacccagttccctccctcccctcccttgtcctcgtctttacgtcggttaggacacaaggacgtccaaccacttaccgaccttcgggaccccggttaagaacggttccgagtacgttacttaacctacctttaatttaaagttcggtaactacgtaaacgaaacctaaaaaccgggaacggaacccgtacccccgtaggtacccttaccccgtaccttacctaccgttacgccgtacgtaacggtcgtaacggttccgtacacgttacgtaccggtccggttaccggggtacccctaaacgttaacggaaccgggtttacggttacccgggtaggggtaccggtaacgggttacggtacggtttaccggaagggaaccgttaacgggttaaccttaccggtaaccttcgtaaaccgtacccggtaaccttaacccggaaccgtaccggtttaccgggtaaccgtaacccggttacgtaaaccggtttacctttccgtaaaccctttaaccgtttacgtttaaccctaacggtaaaccttaaaccggtacgtttaacccccgtaaccccgttacccgtaacgttacccggttacgggaacccgtaacggggtaccgtaacgggtacgacggttaaacaaccgggtaagtaccggtcggttaacgcctaccggtacctaccgttacctcggttacctacgttaccaaccgttttcccacccgtacttcgg

SEQ ID NO: 11037 - DNA, 825 bp, Homo sapiens
  misc_feature: GYAE6OF02F72FB.2.87.H10.1.454.CMB.1.raw
  modified_base (199)..(199): a, c, t, g, unknown or other
  misc_feature (199)..(199): n is a, c, g, or t
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacatcccggtgacccagtcctccctccctccctgtctgtcttctgttgganacagagtccaccatccacgttgggacgtacaagtcagtaagttactttaaccaactttatttaaattggtattacagaacaaaaaccgaagggaaacgtacccctaggaccttcctaccgtctacctacttcgacgaagaccgagtcttcgactactacggccgttacgggggtacccctacgttaccaaaacggtacgtttaccccggttagggaccttagggtacggtaacgttacggtacggggtaacaaacggtaaacgtttacctaaccgtcttaaccctaacggtactacccaaccgtaccgttcgtaaccggtaacctacggtaaccgtaacgtttacaaccgttaacctttaccgttaccgttacgttaacctaaaaaaccgtacgtttaaacccctaaccccgttaaccccgttaaaccgttaacccggtttcccgggtaaacccgaccgggggttaaccccggtaacggggtcggtaaacggtaacgtaacccgtaaaaccggttaacgttacggtaaccggggtccttaaccggaacctaacccgtaacgttttccggtacccggttaccgttttacccgtaacgttcccccgttttcccggaaccccttaaccg

SEQ ID NO: 11038 - DNA, 651 bp, Homo sapiens
  misc_feature: GYAE6OF02JON4V.2.87.H10.1.454.CMB.1.raw
  modified_base (210)..(210): a, c, t, g, unknown or other
  misc_feature (210)..(210): n is a, c, g, or t
  modified_base (224)..(224): a, c, t, g, unknown or other
  misc_feature (224)..(224): n is a, c, g, or t
  modified_base (306)..(306): a, c, t, g, unknown or other
  misc_feature (306)..(306): n is a, c, g, or t
tcagacgctcgacacacgaccggtgctcgatttagcagtactgcgttgggtttgggggagtcagtctcagtcaggacacagcatggacatgagggtccccgctcagctcctgggctcctgctactctggctccgaggtgccagatgtgacactcccggtgacccagtcctccctccctcctgtctgcttcgtgtggacgacagactcacntcacgtggccgtanagtcagattacttacacttatttaagtgtatcagtacaaaacgtacggaacgtccgtagcctccgtcctacgtactccgtancaagtcagtcgttcgacgacgttcgggaccggttcgggtaccctagtacggtaacgttacggtttccggacggtacgtaacggtcggtaacgttcggtacgggtaactaaacgttacgttacaaccgttccgacgtacgtaccgtacctacgtaacgttcgtaccgtacgtacgtacgtactacgtactacttacttctacgtaacgaactacctagtaccctaccgtacgtacgttacgacggtacggtacgtacgtagtacgtactaacgtaacgtacgtagtcgtacgtcgaccgtaccgtacgtacgtacgttctccgtaccgttacctcccgtactaccg

SEQ ID NO: 11039 - DNA, 1005 bp, Homo sapiens
  misc_feature: GYAE6OF02JPD09.2.87.H10.1.454.CMB.1.raw
  modified_base (162)..(162): a, c, t, g, unknown or other
  misc_feature (162)..(162): n is a, c, g, or t
  modified_base (225)..(225): a, c, t, g, unknown or other
  misc_feature (225)..(225): n is a, c, g, or t
  modified_base (453)..(453): a, c, t, g, unknown or other
  misc_feature (453)..(453): n is a, c, g, or t
tcagacgctcgacacacgaccggtgctcgatttagcagtactgcgttgggtttgggggagtcagtctcagtcaggacacagcatggacatgagggtccccgctcagctcctggggctcctgctactctggactccgaggtgccagatgtcgacagtcccggnacccagtcctccctccctcctgtcgtgtccttctggttaggagctaggacgtccacgactacncgttacggccggtactaacgtacgtaggtaattacttaacctacttaacttttaaagttaggttacttaacgaacgtaaaccgtaaaaaccgaacgggaaccgtacccgtacggccttacccgttcctaccgttaccgtacgtacacgtaacgccacgtccttagacgagtcggtccggtaccggggttacctacgtaacgtaacgtacgtaccggtcggtactaggngtacgtcgtacggacgtacgtaacttccgtactaccgtacgtaccgtactaccccggtaactacgggtaccgtacgtaaccggtaacgggtaacttacgttaacggttaaccttaaccgtttacccgtttaaccgttaaaccgttaaaacccgtaaaacccgtttaaacccggttaacccgtaacccccgggtttaaaccccgttttaaacccgttaaacccggtttaaccccggggtaaacccggggttaaccgggggttaaaaccccgggtaccgggggttaaccggtaaaacccgggttaaccgtttaaacccgggtaaaaacccgggtttacccgggtttaacccgggggtaacccggtttaaacccccggggtaaccgtttaaacccccgggttaaaccccccgttttaaaccggggtttttacccccttttaaacccgggtttaacccccccggtttttaccccgttttaaaaaccccccggggtttttacccccgggtttaaccccccccccgggttttaaacgggtttttaacccccccccggg

SEQ ID NO: 11040 - DNA, 218 bp, Homo sapiens
  misc_feature: GYAE6OF01EHRRB.44.30.C08.1.454.CMB.1.raw
  modified_base (215)..(218): a, c, t, g, unknown or other
  misc_feature (215)..(218): n is a, c, g, or t
tcagacagtatatacacgaccggtgctcgatttagtctgacgtcaaagggaaagggaccgacggtcaccgtctcctcagcttccaccaagggcccatcggtcttcccctggcgccctgctccaggagccacctcgtgggggcacagcggccctgggctgcctggtcaaggactacttccacgtctactgctgagcgggctggcaaggcgcatagnnnn

SEQ ID NO: 11041 - DNA, 230 bp, Homo sapiens
  misc_feature: GYAE6OF01EH3YI.44.30.C08.1.454.CMB.1.raw
  modified_base (212)..(230): a, c, t, g, unknown or other
  misc_feature (212)..(230): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctgggggcacagcggccctgggctgcctggtcaaggactacttccacgtctactgctgagcgggctggcaaggcgcatagnnnnnnnnnnnnnnnnnnn

SEQ ID NO: 11042 - DNA, 215 bp, Homo sapiens
  misc_feature: GYAE6OF01DSWS5.44.30.C08.1.454.CMB.1.raw
  modified_base (212)..(215): a, c, t, g, unknown or other
  misc_feature (212)..(215): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnn

SEQ ID NO: 11043 - DNA, 159 bp, Homo sapiens
  misc_feature: GYAE6OF01C8ENC.44.30.C08.1.454.CMB.1.raw
  modified_base (154)..(159): a, c, t, g, unknown or other
  misc_feature (154)..(159): n is a, c, g, or t
tcagacagtatatacacgaccggtgctcgatttagtctgacgtcaaagggaaagggaccaaggtggaaatcaaacgaactgtggctgcaccatctgtcttcatcttcccgccatctgatatatactgtctgagcgggctggcaaggcgcatagnnnnnn

SEQ ID NO: 11044 - DNA, 155 bp, Homo sapiens
  misc_feature: GYAE6OF01BGINV.44.30.C08.1.454.CMB.1.raw
  modified_base (154)..(155): a, c, t, g, unknown or other
  misc_feature (154)..(155): n is a, c, g, or t
tcagacagtatatacacgaccggtgctcgatttagtctgacgtcaaagggaaagggaccaaggtggaaatcaaacgaactgtggctgcaccatctgtcttcatcttcccgccatctgatatatactgtctgagcgggctggcaaggcgcatagnn

SEQ ID NO: 11045 - DNA, 216 bp, Homo sapiens
  misc_feature: GYAE6OF01BNX3J.44.30.C08.1.454.CMB.1.raw
  modified_base (212)..(216): a, c, t, g, unknown or other
  misc_feature (212)..(216): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctgggggcacagcggccctgggctgcctggtcaaggactacttcctcgatcgcgtctgagcgggctggcaaggcgcatagnnnnn

SEQ ID NO: 11046 - DNA, 215 bp, Homo sapiens
  misc_feature: GYAE6OF01AGH7E.44.30.C08.1.454.CMB.1.raw
  modified_base (212)..(215): a, c, t, g, unknown or other
  misc_feature (212)..(215): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctccgagagcacagcggccctgggctgcctggtcaaggactacttcctatatactgtctgagcgggctggcaaggcgcatagnnnn

SEQ ID NO: 11047 - DNA, 215 bp, Homo sapiens; identical to SEQ ID NO: 11042
  misc_feature: GYAE6OF01AI96Q.44.30.C08.1.454.CMB.1.raw
  modified_base (212)..(215): a, c, t, g, unknown or other
  misc_feature (212)..(215): n is a, c, g, or t

SEQ ID NO: 11048 - DNA, 220 bp, Homo sapiens
  misc_feature: GYAE6OF01CERXN.44.30.C08.1.454.CMB.1.raw
  modified_base (211)..(220): a, c, t, g, unknown or other
  misc_feature (211)..(220): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctgggggcacagcggcctgggctgcctggtcaaggactacttcctcgatcgcgtctgagcgggctggcaaggcgcatagnnnnnnnnnn

SEQ ID NO: 11049 - DNA, 373 bp, Homo sapiens
  misc_feature: GYAE6OF01AUJVD.44.30.C08.1.454.CMB.1.raw
  modified_base (365)..(373): a, c, t, g, unknown or other
  misc_feature (365)..(373): n is a, c, g, or t
tcagacagtatatacacgaccggtgctcgatttagtctgacgtcaaagggaaagggccgattcatcatctccagagacaatgtcgaaaacacggtgtatttacaaatgaacagtctaagagtcgaggacacggctgtctactattgtgtgagaccttatgatttcacttgggggagttatcgtttgggcccacactggggccagggaaccttggtcgtcgtctcctcagcttccaccaagggcccatcggtcttccccctggccgccctgctccaggagcacctctgggggcacagcggccctgggctgcctggtcaaggactacttcctatatactgtctgagcgggctggcaaggcgcatagnnnnnnnnn

SEQ ID NO: 11050 - DNA, 227 bp, Homo sapiens
  misc_feature: GYAE6OF01C987O.44.30.C08.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
  modified_base (215)..(227): a, c, t, g, unknown or other
  misc_feature (215)..(227): n is a, c, g, or t
tcagacagtatatacacgaccggtgctcgatttagtctgacgtcaaagggaaagggaccacggtcaccgtctcctcagcttccaccaagggcccatcggtccttccccctggccgccctgctccgaggagcacctcgtgggggcacagcggcccgtgggctgcctggtcaaggactacttctatactactgtctgagcggntggcaggcnatagnnnnnnnnnnnnn

SEQ ID NO: 11051 - DNA, 154 bp, Homo sapiens
  misc_feature: GYAE6OF01AT9V7.44.30.C08.1.454.CMB.1.raw
  modified_base (151)..(154): a, c, t, g, unknown or other
  misc_feature (151)..(154): n is a, c, g, or t
tcagacagtatatacacgaccggtgctcgatttagtctgacgtcaaaggaagggaccaaggtggaaatcaacgaactgtggctgcaccatctgtcttcatcttcccgccatctgatatatactgtctgagcgggctggcaaggcgcatagnnnn

SEQ ID NO: 11052 - DNA, 149 bp, Homo sapiens
  misc_feature: GYAE6OF02GX0R6.44.30.C08.1.454.CMB.1.raw
  modified_base (148)..(149): a, c, t, g, unknown or other
  misc_feature (148)..(149): n is a, c, g, or t
tcagacagtatatacacgaccggtgctcgatttagtctgacgtcaaggaaggaccaaggtggaatcaacgaactgtggctgcaccatctgtcttcatcttcccgccatctgatatatactgtctgagcgggctggcaaggcgcatagnn

SEQ ID NO: 11053 - DNA, 212 bp, Homo sapiens
  misc_feature: GYAE6OF02GJ3KT.44.30.C08.1.454.CMB.1.raw
  modified_base (211)..(212): a, c, t, g, unknown or other
  misc_feature (211)..(212): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnn

SEQ ID NO: 11054 - DNA, 214 bp, Homo sapiens
  misc_feature: GYAE6OF02IRU0M.44.30.C08.1.454.CMB.1.raw
  modified_base (210)..(214): a, c, t, g, unknown or other
  misc_feature (210)..(214): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctggggcacagcggcctgggctgcctggtcaaggactacttcctatatactgtctgagcgggctggcaaggcgcatagnnnnn

SEQ ID NO: 11055 - DNA, 156 bp, Homo sapiens
  misc_feature: GYAE6OF02GD4H5.44.30.C08.1.454.CMB.1.raw
  modified_base (154)..(156): a, c, t, g, unknown or other
  misc_feature (154)..(156): n is a, c, g, or t
tcagacagtatatacacgaccggtgctcgatttagtctgacgtcaaagggaaagggaccaaggtggaaatcaaacgaactgtggctgcaccatctgtcttcatcttcccgccatctgatatatactgtctgagcgggctggcaaggcgcatagnnn

SEQ ID NO: 11056 - DNA, 213 bp, Homo sapiens
  misc_feature: GYAE6OF02IZICT.44.30.C08.1.454.CMB.1.raw
  modified_base (211)..(213): a, c, t, g, unknown or other
  misc_feature (211)..(213): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnn

SEQ ID NO: 11057 - DNA, 214 bp, Homo sapiens
  misc_feature: GYAE6OF02GEU8X.44.30.C08.1.454.CMB.1.raw
  modified_base (211)..(214): a, c, t, g, unknown or other
  misc_feature (211)..(214): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctggggcacagcggccctgggctgcctggtcaaggactacttccacgtctactgctgagcgggctggcaaggcgcatagnnnn

SEQ ID NO: 11058 - DNA, 214 bp, Homo sapiens; identical to SEQ ID NO: 11057
  misc_feature: GYAE6OF02H4UDM.44.30.C08.1.454.CMB.1.raw
  modified_base (211)..(214): a, c, t, g, unknown or other
  misc_feature (211)..(214): n is a, c, g, or t

SEQ ID NO: 11059 - DNA, 214 bp, Homo sapiens; identical to SEQ ID NO: 11057
  misc_feature: GYAE6OF02IUEAY.44.30.C08.1.454.CMB.1.raw
  modified_base (211)..(214): a, c, t, g, unknown or other
  misc_feature (211)..(214): n is a, c, g, or t

SEQ ID NO: 11060 - DNA, 213 bp, Homo sapiens; identical to SEQ ID NO: 11056
  misc_feature: GYAE6OF02GCIEM.44.30.C08.1.454.CMB.1.raw
  modified_base (211)..(213): a, c, t, g, unknown or other
  misc_feature (211)..(213): n is a, c, g, or t

SEQ ID NO: 11061 - DNA, 161 bp, Homo sapiens
  misc_feature: GYAE6OF02IMRX0.44.30.C08.1.454.CMB.1.raw
  modified_base (154)..(161): a, c, t, g, unknown or other
  misc_feature (154)..(161): n is a, c, g, or t
tcagacagtatatacacgaccggtgctcgatttagtctgacgtcaaagggaaagggaccaaggtggaaatcaaacgaactgtggctgcaccatctgtcttcatcttcccgccatctgatatatactgtctgagcgggctggcaaggcgcatagnnnnnnnn

SEQ ID NO: 11062 - DNA, 155 bp, Homo sapiens; identical to SEQ ID NO: 11044
  misc_feature: GYAE6OF02H1T7F.44.30.C08.1.454.CMB.1.raw
  modified_base (154)..(155): a, c, t, g, unknown or other
  misc_feature (154)..(155): n is a, c, g, or t

SEQ ID NO: 11063 - DNA, 216 bp, Homo sapiens
  misc_feature: GYAE6OF02I1DZ5.44.30.C08.1.454.CMB.1.raw
  modified_base (212)..(216): a, c, t, g, unknown or other
  misc_feature (212)..(216): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnnnn

SEQ ID NO: 11064 - DNA, 367 bp, Homo sapiens
  misc_feature: GYAE6OF02IGUVN.44.30.C08.1.454.CMB.1.raw
  modified_base (363)..(367): a, c, t, g, unknown or other
  misc_feature (363)..(367): n is a, c, g, or t
tcagacagtatatacacgaccggtgctcgatttagtctgacgtcaaagggaaagggccgattcatcatctccagagacaatgtcgaaaacacggtgtatttacaaatgaacagtctaagagtcgaggacacggctgtctactattgtgtgagaccttatgatttcacttgggggagttatcgtttgggcccacactggggccagggaaccttggtcgtcgtctcctcagcttccaccaagggcccatcggtcttccccctggcgccctgctccaggagcacctctgggggcacagcggccctgggctgcctggtcaaggactacttccatatactgtctgagcgggctggcaaggcgcatagnnnnn

SEQ ID NO: 11065 - DNA, 214 bp, Homo sapiens
  misc_feature: GYAE6OF02F4Y01.44.30.C08.1.454.CMB.1.raw
  modified_base (212)..(214): a, c, t, g, unknown or other
  misc_feature (212)..(214): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctgggggcacagcggccctgggctgcctggtcaaggactacttcctatatactgtctgagcgggctggcaaggcgcatagnnn

SEQ ID NO: 11066 - DNA, 214 bp, Homo sapiens
  misc_feature: GYAE6OF02HH1SX.44.30.C08.1.454.CMB.1.raw
  modified_base (211)..(214): a, c, t, g, unknown or other
  misc_feature (211)..(214): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctggggcacagcggccctgggctgcctggtcaaggactacttcctatatactgtctgagcgggctggcaaggcgcatagnnnn

SEQ ID NO: 11067 - DNA, 220 bp, Homo sapiens
  misc_feature: GYAE6OF02JJ84U.44.30.C08.1.454.CMB.1.raw
  modified_base (211)..(220): a, c, t, g, unknown or other
  misc_feature (211)..(220): n is a, c, g, or t
tcagacagtatatacacgaccggtgctcgatttagtctgacgtcaaagggaaagggaccacggtcaccgtctcctcagcttccaccaagggcccatcggtcttcccctggcgccctgctccaggagcacctctggggcacagcggccctgggctgcctggtcaaggactacttcctcgatcgcgtctgagcgggctggcaaggcgcatagnnnnnnnnnn

SEQ ID NO: 11068 - DNA, 214 bp, Homo sapiens; identical to SEQ ID NO: 11066
  misc_feature: GYAE6OF02HPXHS.44.30.C08.1.454.CMB.1.raw
  modified_base (211)..(214): a, c, t, g, unknown or other
  misc_feature (211)..(214): n is a, c, g, or t

SEQ ID NO: 11069 - DNA, 154 bp, Homo sapiens
  misc_feature: GYAE6OF02F9N9Y.44.30.C08.1.454.CMB.1.raw
  modified_base (154)..(154): a, c, t, g, unknown or other
  misc_feature (154)..(154): n is a, c, g, or t
tcagacagtatatacacgaccggtgctcgatttagtctgacgtcaaagggaaagggaccaaggtggaaatcaaacgaactgtggctgcaccatatgtcttcatcttcccgccatctgatatatactgtctgagcgggctggcaaggcgcatagn

SEQ ID NO: 11070 - DNA, 218 bp, Homo sapiens
  misc_feature: GYAE6OF02GSRND.44.30.C08.1.454.CMB.1.raw
  modified_base (213)..(218): a, c, t, g, unknown or other
  misc_feature (213)..(218): n is a, c, g, or t
tcagacagtatatacacgaccggtgctcgatttagtctgacgtcaaagggaaagggaccacggtcaccgtctcctcagcttccaccaagggcccatcggtcttccccctggcgccctgctccaggagcacctctgggggcacagcggccctgggctgcctggtcaaggactacttcctatatactgtctgagcgggctggcaaggcgcatagnnnnnn

SEQ ID NO: 11071 - DNA, 218 bp, Homo sapiens
  misc_feature: GYAE6OF02HGGEF.44.30.C08.1.454.CMB.1.raw
  modified_base (164)..(218): a, c, t, g, unknown or other
  misc_feature (164)..(218): n is a, c, g, or t
tcagacagtatatacacgaccggtgctcgatttagtctgacgtcaaagggaaagggaccaaggtggaaatcaaacgaactgtggctgcaccatctgtcttcatctcccgccatctgatatatactgtactggacgcggggctgggacaagggcgactagtacgnnnnnnnnnnnnnnnnnnnnnnnnnnnnnnnnnnnnnnnnnnnnnnnnnnnnnnn

SEQ ID NO: 11072 - DNA, 373 bp, Homo sapiens
  misc_feature: GYAE6OF01CI7Z6.39.19.B08.1.454.CMB.1.raw
  modified_base (367)..(373): a, c, t, g, unknown or other
  misc_feature (367)..(373): n is a, c, g, or t
tcagtcgcactagtcacgaccggtgctcgatttagtgagtcagtaagggccgatgcaccatctccagacacaactccaacggcttggtctttctacaaatgaacagtctggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttcccctggcgccctgctccaggagcacctccgagagcacagcggccctgggctgcctggtcaaggactacttccactagtgcgactgagcgggctggcaaggcgcatagnnnnnnn

SEQ ID NO: 11073 - DNA, 376 bp, Homo sapiens
  misc_feature: GYAE6OF01EV97Y.39.19.B08.1.454.CMB.1.raw
  modified_base (367)..(376): a, c, t, g, unknown or other
  misc_feature (367)..(376): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttcccctggcgccctgctccaggagcacctccgagagcacagcggccctgggctgcctggtcaaggactactccactagtgcgactgagcgggctggcaaggcgcatagnnnnnnnnnn

SEQ ID NO: 11074 - DNA, 378 bp, Homo sapiens
  misc_feature: GYAE6OF01DYV2F.39.19.B08.1.454.CMB.1.raw
  modified_base (368)..(378): a, c, t, g, unknown or other
  misc_feature (368)..(378): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttccccctggcgccctgctccaggagcacctccgagagcacagcggccctgggctgcctggtcaaggctacttccactagtgcgactgagcgggctggcaaggcgcatagnnnnnnnnnnn

SEQ ID NO: 11075 - DNA, 443 bp, Homo sapiens
  misc_feature: GYAE6OF01CPYNG.39.19.B08.1.454.CMB.1.raw
  modified_base (396)..(443): a, c, t, g, unknown or other
  misc_feature (396)..(443): n is a, c, g, or t
tcagtcgcactagtcacgaccggtgctcgattttagtgagtcagtaagggccgagtgcaccatctccagacacaacgtccaacggcttggtcctttctacaaatgaacagtctgggggtcatgacacggctgtactattactgtgcgaggacagtcagattgtggtgtggactgtcgacattcaaagaactacgttctaatcggacgcggacgtttggggccaaaggggacccacggtcaaccgtctcagcctccaccaagggccccatccggtcttccccctaggaccacccgtcctaccaagacgccacctcgtcggggcacagccggcctgggctcgcctggcaaggctactccactagtcgcgactgagcgggcgtggcaaggcgacatagnnnnnnnnnnnnnnnnnnnnnnnnnnnnnnnnnnnnnnnnnnnnnnnn

SEQ ID NO: 11076 - DNA, 401 bp, Homo sapiens
  misc_feature: GYAE6OF01C2539.39.19.B08.1.454.CMB.1.raw
  modified_base (259)..(259): a, c, t, g, unknown or other
  misc_feature (259)..(259): n is a, c, g, or t
  modified_base (266)..(266): a, c, t, g, unknown or other
  misc_feature (266)..(266): n is a, c, g, or t
  modified_base (378)..(401): a, c, t, g, unknown or other
  misc_feature (378)..(401): n is a, c, g, or t
tcagtcgcactagtcacgaccggtgctcgatttagtgagtcagtaagggccgatgcaccatctccagacacaactccaacggcttggtcttctacaaatgaacagtctgggggtcgatgacacggctgtatattactgtgcgaggcagtcagattgtggtgtggactgtgacatcaagaactacttctatggagcggacgtttgggccaagggaccacggtcaccgtctcctcagcctcaccaggccatcgtctccccngcgcctnctccgagacgcacctcgagacgcacgacgccgcccgtggctcgccgtggtacaaggacttacctccactagcgtacgactggacgcgggcgtggccgaaggcgacagtacgnnnnnnnnnnnnnnnnnnnnnnnn

SEQ ID NO: 11077 - DNA, 787 bp, Homo sapiens
  misc_feature: GYAE6OF01BXFB9.39.19.B08.1.454.CMB.1.raw
  modified_base (107)..(107): a, c, t, g, unknown or other
  misc_feature (107)..(107): n is a, c, g, or t
  modified_base (648)..(648): a, c, t, g, unknown or other
  misc_feature (648)..(648): n is a, c, g, or t
  modified_base (659)..(659): a, c, t, g, unknown or other
  misc_feature (659)..(659): n is a, c, g, or t
  modified_base (684)..(684): a, c, t, g, unknown or other
  misc_feature (684)..(684): n is a, c, g, or t
tcagtcgcactagtcacgaccggtgctcgattttagtgagtcagtaagggccggatgcaccatctcagacacaactcaacggcttggtctttcgtaccaaatgaacngtcgtgggggtcactgacacggctgtatattactgtgacgaggtcagtcagtacttggtggtcgtggactcgttcgaaccacgttacaaagtacttacttcgttagtggaggacggtacggtttcggggaccaacgggaccgtacggtccgtaccggtctcgacgccctaccgaacgaacgggtccctaagttccggttaccctttccccggttacgggacccgtcccgtacggtacccgtaaccggaaccgggaacgtaacccgtaacccccggttaaccgtacggaaccgttaccgtaaccggtacgggtccccgggttcccggttacggggttccggtacgggttaccccggtttacgggtaaccggtaaacgggttacccctttaacgttttacccgaacggtttaacggtcgggttaccggtaacgtttacggggaacgggtccggggtaacccggtaggggtaaaccggaaaccggtcccggtaactttaacccgtaagtcgctaactggctaacgcgaaactttcacgggttancgggtaccgtntacggtacctaactgggcacgaatncgtctcgtcgtacgtcgtcgtcgtcgtacgacgtagagacgcgacgtacgtacgtacgcgcgacgtacgtatacgtacgtacgttcgtacctactcgtcgtcg

SEQ ID NO: 11078 - DNA, 639 bp, Homo sapiens
  misc_feature: GYAE6OF01AG0MO.39.19.B08.1.454.CMB.1.raw
  modified_base (151)..(151): a, c, t, g, unknown or other
  misc_feature (151)..(151): n is a, c, g, or t
  modified_base (155)..(155): a, c, t, g, unknown or other
  misc_feature (155)..(155): n is a, c, g, or t
  modified_base (163)..(163): a, c, t, g, unknown or other
  misc_feature (163)..(163): n is a, c, g, or t
  modified_base (515)..(515): a, c, t, g, unknown or other
  misc_feature (515)..(515): n is a, c, g, or t
  modified_base (518)..(518): a, c, t, g, unknown or other
  misc_feature (518)..(518): n is a, c, g, or t
  modified_base (527)..(527): a, c, t, g, unknown or other
  misc_feature (527)..(527): n is a, c, g, or t
  modified_base (532)..(532): a, c, t, g, unknown or other
  misc_feature (532)..(532): n is a, c, g, or t
  modified_base (535)..(536): a, c, t, g, unknown or other
  misc_feature (535)..(536): n is a, c, g, or t
  modified_base (540)..(540): a, c, t, g, unknown or other
  misc_feature (540)..(540): n is a, c, g, or t
  modified_base (550)..(550): a, c, t, g, unknown or other
  misc_feature (550)..(550): n is a, c, g, or t
  modified_base (556)..(556): a, c, t, g, unknown or other
  misc_feature (556)..(556): n is a, c, g, or t
  modified_base (562)..(562): a, c, t, g, unknown or other
  misc_feature (562)..(562): n is a, c, g, or t
  modified_base (569)..(569): a, c, t, g, unknown or other
  misc_feature (569)..(569): n is a, c, g, or t
  modified_base (591)..(591): a, c, t, g, unknown or other
  misc_feature (591)..(591): n is a, c, g, or t
  modified_base (604)..(604): a, c, t, g, unknown or other
  misc_feature (604)..(604): n is a, c, g, or t
  modified_base (628)..(628): a, c, t, g, unknown or other
  misc_feature (628)..(628): n is a, c, g, or t
tcagtcgcactagtcacgaccggtgctcgatttagtgagtcagtaagggccgatgcaccatctccagacacaactccaacggctttggtctttctaacaaatgaacagtcgtgggggtcgatgacacggctagtatattactgtgcgaggnagtnagattggnggtgtggactgtgacatcaaagtaacttacttctaagtgggacggtccgggtacggttttcggggaacccgtaaacgggacccgtacgggttccaccgttctaccgacgtcccctaccaaccgaacgggcccctaagttccgggttaccctttcccccgagggtccccgaccccgtcgtccgtaccgacggaccgtacccgtaacctccgggaagaccgacgaccgtaacggtcccggaccccgtgggtccgtacggccgttacggtacgaaaccggttacctaccttaccgtacgttagtacgacgacgtaggacggtcgggcgtggaacgtaggactagactacgatacnganctacgatcncgacntannactnacgatagcanactcanctacgntacacanacgacgagagtacgtctagtanatacgtacgacgngagtatctacgacagtacgacganactagagtacg

SEQ ID NO: 11079 - DNA, 373 bp, Homo sapiens
  misc_feature: GYAE6OF02FNQ3R.39.19.B08.1.454.CMB.1.raw
  modified_base (368)..(373): a, c, t, g, unknown or other
  misc_feature (368)..(373): n is a, c, g, or t
tcagtcgcactagtcacgaccggtgctcgatttagtgagtcagtaagggccgatgcaccatctccagacacaactccaacggcttggtctttctacaaatgaacagtctggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttccccctggcgccctgctccaggagcacctccgagagcacagcggccctgggctgcctggtcaaggactacttccactagtgcgactgagcgggctggcaaggcgcatagnnnnnn

SEQ ID NO: 11080 - DNA, 375 bp, Homo sapiens
  misc_feature: GYAE6OF02GW3UZ.39.19.B08.1.454.CMB.1.raw
  modified_base (367)..(375): a, c, t, g, unknown or other
  misc_feature (367)..(375): n is a, c, g, or t
tcagtcgcactagtcacgaccggtgctcgatttagtgagtcagtaagggccgatgcaccatctccagacacaactccaacggcttggtctttctacaaatgaacagtctggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttccccctggcgccctgctccaggagcacctccgagagcacagcggccctgggctgcctggtcaaggctacttccactagtgcgactgagcgggctggcaaggcgcatagnnnnnnnnn

SEQ ID NO: 11081 - DNA, 375 bp, Homo sapiens
  misc_feature: GYAE6OF02HUP2L.39.19.B08.1.454.CMB.1.raw
  modified_base (369)..(375): a, c, t, g, unknown or other
  misc_feature (369)..(375): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttccccctggcgccctgctccaggagcacctccgagagcacagcggccctgggctgcctggtcaaggactacttccactagtgcgactgagcgggctggcaaggcgcatagnnnnnnn

SEQ ID NO: 11082 - DNA, 376 bp, Homo sapiens
  misc_feature: GYAE6OF02H7CCM.39.19.B08.1.454.CMB.1.raw
  modified_base (366)..(376): a, c, t, g, unknown or other
  misc_feature (366)..(376): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttcccctggcgcctgctccaggagcacctccgagagcacagcggcctgggctgcctggtcaaggactacttccactagtgcgactgagcgggctggcaaggcgcatagnnnnnnnnnnn

SEQ ID NO: 11083 - DNA, 369 bp, Homo sapiens
  misc_feature: GYAE6OF02IQUD8.39.19.B08.1.454.CMB.1.raw
  modified_base (351)..(351): a, c, t, g, unknown or other
  misc_feature (351)..(351): n is a, c, g, or t
  modified_base (358)..(369): a, c, t, g, unknown or other
  misc_feature (358)..(369): n is a, c, g, or t
tcagtcgcactagtcacgaccggtgctcgatttagtgagtcagtaagggccgatgcaccatctccagacacaactccaacggcttggtctttctacaaatgaacagtctggggtcgatgacacggctgtatattactgtgcgaggcagtcagattgtggtgtggactgtgacatcaagaactacttctaatggagcggacgtttggggccaagggaccaggtcaccgtctcagcctcacaggccatcggtctcccctggcgcctgctccagagcacctcgagagcacagcggcctgggctgcctggtcaaggactacttccactagtgcgactgagcgggctggcaaggcncatacgnnnnnnnnnnnn

SEQ ID NO: 11084 - DNA, 376 bp, Homo sapiens
  misc_feature: GYAE6OF02HEK2R.39.19.B08.1.454.CMB.1.raw
  modified_base (369)..(376): a, c, t, g, unknown or other
  misc_feature (369)..(376): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttccccctggcgccctgctccaggagcacctccgagagcacagcggccctgggctgcctggtcaaggactacttccactagtgcgactgagcgggctggcaaggcgcatagnnnnnnnn

SEQ ID NO: 11085 - DNA, 389 bp, Homo sapiens
  misc_feature: GYAE6OF02FNFO5.39.19.B08.1.454.CMB.1.raw
  modified_base (372)..(372): a, c, t, g, unknown or other
  misc_feature (372)..(372): n is a, c, g, or t
  modified_base (379)..(389): a, c, t, g, unknown or other
  misc_feature (379)..(389): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggccccatccggtccttccccctggccgccctgcctccaggactcacctccgagagccacagcggcccctgggcctgcctggcaaggactacttccactagtgcgactgacgcgggctggcaaggcncagtagnnnnnnnnnnn

SEQ ID NO: 11086 - DNA, 388 bp, Homo sapiens
  misc_feature: GYAE6OF02FWFOL.39.19.B08.1.454.CMB.1.raw
  modified_base (339)..(339): a, c, t, g, unknown or other
  misc_feature (339)..(339): n is a, c, g, or t
  modified_base (364)..(364): a, c, t, g, unknown or other
  misc_feature (364)..(364): n is a, c, g, or t
  modified_base (370)..(372): a, c, t, g, unknown or other
  misc_feature (370)..(372): n is a, c, g, or t
  modified_base (374)..(388): a, c, t, g, unknown or other
  misc_feature (374)..(388): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggacgtttggggccaagggaccacggtcaccgtctcagcctccaccaagggcccatcggtcttccccctggccgccctgctccaggagcacctccgagagcacagcggccctgggctgcctggtcaaggctacttccactagngcgactggagcgggctggcaaggcncatagnnngnnnnnnnnnnnnnnn

SEQ ID NO: 11087 - DNA, 411 bp, Homo sapiens
  misc_feature: GYAE6OF02JR2CA.39.19.B08.1.454.CMB.1.raw
  modified_base (392)..(392): a, c, t, g, unknown or other
  misc_feature (392)..(392): n is a, c, g, or t
  modified_base (395)..(411): a, c, t, g, unknown or other
  misc_feature (395)..(411): n is a, c, g, or t
tcagtcgcactagtcacgaccggtgctcgatttagtgagtcagtaagggccgatgcaccatctccagacacaactccaacggcttggtctttctacaaatgaacagtctgggggtcgatgacacggctgtatattactgtgcgaggcagtcagattgtggtgtggactgtgacatcaagaactacttctatggagcggtacgtttggggccaagggaccacggtcaccgtctcacgcctccaccaagggcccagtccggtccttccccctggccgtcccctgcctccacggtacgccaccctccgagacgccacaggccggccctgggctcgccctggtcaaggtcctactccactagtcgcgactgacgcggctggcaaggcgctagtagncgnnnnnnnnnnnnnnnnn

SEQ ID NO: 11088 - DNA, 848 bp, Homo sapiens
  misc_feature: GYAE6OF01B800F.30.17.B06.1.454.CMB.1.raw
  modified_base (205)..(205): a, c, t, g, unknown or other
  misc_feature (205)..(205): n is a, c, g, or t
  modified_base (839)..(839): a, c, t, g, unknown or other
  misc_feature (839)..(839): n is a, c, g, or t
  modified_base (841)..(841): a, c, t, g, unknown or other
  misc_feature (841)..(841): n is a, c, g, or t
  modified_base (844)..(844): a, c, t, g, unknown or other
  misc_feature (844)..(844): n is a, c, g, or t
  modified_base (846)..(846): a, c, t, g, unknown or other
  misc_feature (846)..(846): n is a, c, g, or t
tcagcacgctacgtcacgaccggtgctcgatttagtcgatagtgaagggtaagggggtcgtggaatgggtctcgaagtattgctggtaggtggtgataggccacatactacgccaggccacttcgtgaacgggccggttcgaccacgtcgtccgacgggacagttcgaagaacacactgtttctgccaaatcgaacagcctgagngtcgaggaccgacgggccgtatagttactgtcgcgtctttccacccgtgggacgtagggacgttaacaaggtcaacttaccttacctaaccgtacggttcgggggacccggggaccaaccccgttacgggtaccgaacgggcccggttacccttacccgtaccgtaccgtaccccttaccccgaacccgtaaacggggggtccccctaagtttcccggggttccccttttaccccccccggtaggggttccccgaacccccgttacccggttaccccggaaacggtaccggtcccgtaaccgtttcccgggtacgggggggtacccaacggtacgggaccgtacgggtcccccggttggggggtacccttacgggtcccgtttacgggtacccgtaaaccgggttaccctttaacccgtttcccgtaacggttaacggtaccggttcggtaccgttacgggtaaccgggtccgggggtacgttacggggtaaccgaaccgggttaccgtaccgttaacgttacgggactaacgtagttaacgtacgtagttcgtaccggtacgacgtacgaacgacttaagtaacgttacggacgtaggtacgctcgacgactacgttcgtctactctctctcncnctntntc

SEQ ID NO: 11089 - DNA, 623 bp, Homo sapiens
  misc_feature: GYAE6OF01CDWPE.30.17.B06.1.454.CMB.1.raw
  modified_base (216)..(216): a, c, t, g, unknown or other
  misc_feature (216)..(216): n is a, c, g, or t
  modified_base (512)..(512): a, c, t, g, unknown or other
  misc_feature (512)..(512): n is a, c, g, or t
  modified_base (534)..(534): a, c, t, g, unknown or other
  misc_feature (534)..(534): n is a, c, g, or t
tcagcacgctacgtcacgaccggtgctcgatttagtcgatagtgagggaaagggggctggaatcggtctcaagtattgctggtagtggtgatagcgaccatactacgcagccgatcgtgaggccggttcaccagtctccagggacagttcgaagaacacactgtttctagcaaactgaacagcctgacgagtcgaggacacggccgtatagttacngtgcgtcctttcacctggacgtgggagttacgaagcatacgtccaccgagtagggtccgggctaccgtggtcagcgtcgtcctacacgaccgtaccgaccgaacgggcccactccggtccttccccgtggccgaccctccgtaccaacgacgtaccgaacctcggtcggggtacacgagtcgtacggcccgtgggcgttcggccgtggtaccgaacggtaccttaacgttacctacgtacgtccgtgacccgttgaacggcgggtcctgggacctaaagggccgacgaagtaacgngtgtactcgatcgtacgtacgntacgtacgtactactactacgtcgtacgtacgtacgacgtacgtacgtacgagaacgtacgtacgtcgcgtcgtacgacactcgtgtcg

SEQ ID NO: 11090 - DNA, 638 bp, Homo sapiens
  misc_feature: GYAE6OF01CZQ6P.30.17.B06.1.454.CMB.1.raw
  modified_base (147)..(147): a, c, t, g, unknown or other
  misc_feature (147)..(147): n is a, c, g, or t
  modified_base (158)..(158): a, c, t, g, unknown or other
  misc_feature (158)..(158): n is a, c, g, or t
  modified_base (185)..(185): a, c, t, g, unknown or other
  misc_feature (185)..(185): n is a, c, g, or t
  modified_base (211)..(211): a, c, t, g, unknown or other
  misc_feature (211)..(211): n is a, c, g, or t
  modified_base (536)..(536): a, c, t, g, unknown or other
  misc_feature (536)..(536): n is a, c, g, or t
  modified_base (574)..(574): a, c, t, g, unknown or other
  misc_feature (574)..(574): n is a, c, g, or t
  modified_base (602)..(603): a, c, t, g, unknown or other
  misc_feature (602)..(603): n is a, c, g, or t
  modified_base (605)..(606): a, c, t, g, unknown or other
  misc_feature (605)..(606): n is a, c, g, or t
  modified_base (609)..(638): a, c, t, g, unknown or other
  misc_feature (609)..(638): n is a, c, g, or t
tcagcacgctacgtcacgaccggtgctcgatttagtcgatagtgaaagggaaaggggctgggaatgggtctcaagtattgctggtagtggtgatagcacatacacgcagccatcgtggacgggccgttcactatcctacgagggacngttaccgaaanaacacacttgtttctgacaaatgaacngcctgagcgcgacgacgcggtctatntctgtcgctcgtttaccaccgttggaggttacggtacgttaacgaacggtactacttacccgttccgaaccgtaccggggtcggggggccccgggtacctacccggttggaccgtaccggtccgttccctacccggtcacccggttaccccacccgaaacccggacggtacccctacggttccccggttaccccctcccccggttagcccccttaccccgtccgtaaaccgaaccggcctaccgtacccggttccgggagggaacccaacgccggccaacccggccggttcggacctcggcccgtacggtactaaccggttaccncgtttcccgaaggttcggtcgtagccgttaaggccggnggtaccgtgacccgtagccgatacggcnncnnctnnnnnnnnnnnnnnnnnnnnnnnnnnnnnn

SEQ ID NO: 11091 - DNA, 475 bp, Homo sapiens
  misc_feature: GYAE6OF02F22E6.30.17.B06.1.454.CMB.1.raw
  modified_base (429)..(429): a, c, t, g, unknown or other
  misc_feature (429)..(429): n is a, c, g, or t
  modified_base (435)..(440): a, c, t, g, unknown or other
  misc_feature (435)..(440): n is a, c, g, or t
  modified_base (442)..(442): a, c, t, g, unknown or other
  misc_feature (442)..(442): n is a, c, g, or t
  modified_base (447)..(449): a, c, t, g, unknown or other
  misc_feature (447)..(449): n is a, c, g, or t
  modified_base (455)..(475): a, c, t, g, unknown or other
  misc_feature (455)..(475): n is a, c, g, or t
tcagcacgctacgtcacgaccggtgctcgatttagtcgatagtgaagggtaaagggggtcgtggaatgggtctcaagtattgctggtagtggtgataggccacatactacgcaggccatcgtgaagggccggttcaccatctccagggacagttcgaagaacacactgtttctgccaaatgaacagccctgagagtcgaggacacgggccgtatattactgtgcgcttttcaccctgggagtgggagttacaaggtcataccttcaaccactgggccggggcacctggtcagcgtctctcagcctcaccaagggcccatcggtcttccccctggcaccctcctccgaagagcacctctgggggcacagcagccctgggctgcctggtcaaggactactccagtagcgtgctgagcgggctggcaaggcncatagnnnnnntncagtnnncatacnnnnnnnnnnnnnnnnnnnnn

SEQ ID NO: 11092 - DNA, 564 bp, Homo sapiens
  misc_feature: GYAE6OF02FRF6Q.30.17.B06.1.454.CMB.1.raw
  modified_base (250)..(250): a, c, t, g, unknown or other
  misc_feature (250)..(250): n is a, c, g, or t
  modified_base (328)..(328): a, c, t, g, unknown or other
  misc_feature (328)..(328): n is a, c, g, or t
  modified_base (355)..(355): a, c, t, g, unknown or other
  misc_feature (355)..(355): n is a, c, g, or t
  modified_base (491)..(492): a, c, t, g, unknown or other
  misc_feature (491)..(492): n is a, c, g, or t
  modified_base (494)..(495): a, c, t, g, unknown or other
  misc_feature (494)..(495): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (507)..(507): a, c, t, g, unknown or other
  misc_feature (507)..(507): n is a, c, g, or t
  modified_base (512)..(512): a, c, t, g, unknown or other
  misc_feature (512)..(512): n is a, c, g, or t
  modified_base (519)..(519): a, c, t, g, unknown or other
  misc_feature (519)..(519): n is a, c, g, or t
  modified_base (522)..(522): a, c, t, g, unknown or other
  misc_feature (522)..(522): n is a, c, g, or t
  modified_base (526)..(526): a, c, t, g, unknown or other
  misc_feature (526)..(526): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
  modified_base (551)..(551): a, c, t, g, unknown or other
  misc_feature (551)..(551): n is a, c, g, or t
tcagcacgctacgtcacgaccggtgctcgatttagtcgatagtgaagggtaagggggtcgggtggaaatgggtctcaagtagttcgctgggtaacgtggtggaatacgcgaccagtactacgtcagtccactcgtgaaggccggttcaccactctccagggacagtcgaagaacgactactgttctgcaaatgaaccagccctcgagtagttcggagtaccacgggaccgtagtacttaacctgtcccgngctttcgaccctggagtgggaattacaaggcatacgttcacctagttgggccgggcaacccgtggtccaagccgtccnccgtcccagcctccactaagggcccancggtctccccctggccaccctcctccaagtcgcacctctggggacctcgacgcaagccctggggcctggcctcggtcctaacggcctaaccttccacgtagcgtagctgagcggctggcaaggcgcagttagatgnngnngcntgngcgcgngacgngtcgacncgngtcncacgaagcncgcgtncgactctacncgtactcgtatcg

SEQ ID NO: 11093 - DNA, 572 bp, Homo sapiens
  misc_feature: GYAE6OF02F689S.30.17.B06.1.454.CMB.1.raw
  modified_base (483)..(483): a, c, t, g, unknown or other
  misc_feature (483)..(483): n is a, c, g, or t
  modified_base (488)..(488): a, c, t, g, unknown or other
  misc_feature (488)..(488): n is a, c, g, or t
tcagcacgctacgtcacgaccggtgctcgatttagtcgatagtgaagggtaaaggggtcgtggaatgggtcctcaagtattgctggtagtggtgatagcgaccatactacgcagcccagtcgtgaaggccggttcaccatctccagggacagttcgaagaacacgactgtttctgcaaatgaaccagcctgagagtccgaggacacggccgtatattactgtgcgcgtttcaccctggagtggattacaaggcatacttccaccgactgggccgggcaccctggtcaagtcgtctcctcagcctaccaccgaagggccccatccggtccttcccccgtggccaccccgtcctccaagacgcaccctcttgggggactaccgagcagacccctagggctgccgtggtcgaagggacctacgttcccgacgtacgtcgtgtacctgaacggtcgggctcgggacgaacgggcgcgtagttagctncgatntacgatcagatagagacgtacgtctctactcgtcgtcgtcgtacgacacgtacgacgacacgacgtacgtcgtcgtctcgcgtc

SEQ ID NO: 11094 - DNA, 542 bp, Homo sapiens
  misc_feature: GYAE6OF02HE0A0.30.17.B06.1.454.CMB.1.raw
  modified_base (506)..(506): a, c, t, g, unknown or other
  misc_feature (506)..(506): n is a, c, g, or t
  modified_base (509)..(542): a, c, t, g, unknown or other
  misc_feature (509)..(542): n is a, c, g, or t
tcagcacgctacgtcacgaccggtgctcgatttagtcgatagtgaaagggaaagggggctggaatgggtctcaagtattgctggtagtggtgatagcacatactacgcagccatcgtgaagggccggttcaccatctccagggacagttcgaagaacacactgtttctgcaaatgaacagcctgagagtcgaggacacggccgtatattactgtgcgcttttcaccctggagtgggagttacaaggcaatacttccacacgtggggccgggcacctggtcaggctactcctcacgcctcccaaccgaacgggtccccagtccggtcccttcccccgtggccacccctcctacccaaagtcgcctaccgtcgttggggacacgacgcgtacgccccgtgggcttcggcctacgggtacaaacgggaccttaccgttaccgaacgttacggccgttcggccgtaagacgggtcgggtccgtgggaccaaaggggtcacggattacggnagnnnnnnnnnnnnnnnnnnnnnnnnnnnnnnnnnn

SEQ ID NO: 11095 - DNA, 542 bp, Homo sapiens
  misc_feature: GYAE6OF02H49QU.30.17.B06.1.454.CMB.1.raw
  modified_base (126)..(126): a, c, t, g, unknown or other
  misc_feature (126)..(126): n is a, c, g, or t
  modified_base (178)..(178): a, c, t, g, unknown or other
  misc_feature (178)..(178): n is a, c, g, or t
  modified_base (368)..(368): a, c, t, g, unknown or other
  misc_feature (368)..(368): n is a, c, g, or t
  modified_base (370)..(370): a, c, t, g, unknown or other
  misc_feature (370)..(370): n is a, c, g, or t
  modified_base (508)..(508): a, c, t, g, unknown or other
  misc_feature (508)..(508): n is a, c, g, or t
  modified_base (514)..(542): a, c, t, g, unknown or other
  misc_feature (514)..(542): n is a, c, g, or t
tcagcacgctacgtcacgaccggtgctcgatttagtcgatagtgaagggtaaaggggctggaatgggtctcaagtattgctggtagtggtgatagcacatactacgcagccatcgtgaaggccgtnaccatctaccagggacagttcgaagaacacactgtttcgtacaaatgaacancctgagagtcgaggacacggccgttatatttactggtcgcgtcttttcccaccgttgggacgttggggtaatttaaccaaggctaagttaccttcccacgacgtggggcccgggctacccgtggtcagcgtctctcagcctaccacgacggccagtccgtccttcccctgcctaccctcctacaacgacncnccgtcgtacggggccacgacgcacgtcccgtggccgtcgccgttacggtacaaacgggtaccttaccgtccgtacgtaggccgtagtccggtgacgggcggtcgcggtacggaacggctagtaaccgtgacaggcttngtcacnnnnnnnnnnnnnnnnnnnnnnnnnnnnn

SEQ ID NO: 11096 - DNA, 505 bp, Homo sapiens
  misc_feature: GYAE6OF01DGGGB.25.15.B04.1.454.CMB.1.raw
  modified_base (497)..(497): a, c, t, g, unknown or other
  misc_feature (497)..(497): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccaacagaaacctggccagggtcccaggctcctcatccacggtgcatccaccagggccactggaattccagccaggttcagtggcagtgggtctgggacagacttctctctcaccatcagcagcctgcagtctgacgtatttgctagtttattactgtcagcagtaataaaactggtaccgttactagttttaggccgaggggaccagctaggacatcagacgaactggtggctgcaccatctntcttctac

SEQ ID NO: 11097 - DNA, 223 bp, Homo sapiens
  misc_feature: GYAE6OF01DYAKN.25.15.B04.1.454.CMB.1.raw
  modified_base (222)..(223): a, c, t, g, unknown or other
  misc_feature (222)..(223): n is a, c, g, or t
tcagactgtacagtcacgaccggtgctcgatttagacagtatatatccgcggggtggaggctgaggatgttggggtttattactgcatgcaaggcacacactggcctttcgctttgggccctgggacgagagtggatatcatacgaactgtggctgcaccatctgtcttcatcttccgccatctgaactgtacagtctgagcgggctggcaaggcgcatagnn

SEQ ID NO: 11098 - DNA, 512 bp, Homo sapiens
  misc_feature: GYAE6OF01B89B6.25.15.B04.1.454.CMB.1.raw
  modified_base (290)..(290): a, c, t, g, unknown or other
  misc_feature (290)..(290): n is a, c, g, or t
  modified_base (361)..(361): a, c, t, g, unknown or other
  misc_feature (361)..(361): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattcccactggagaaatagtgatgacgcagtctccagccaccctgtctgtgtctccaggggacagagccaccctctcctgcagggccagtcagagtattagcggcaacttagcctggtaccagcagaaacctggccaggggtcccaggctacctnatccaggtgcatccaccagggccactggaattccagccaggttcagtgcagtgggtctgggacagacttcnctctcaccatcagcagcctgacagtctgacgtatttcgctagtttatactgtcagtctaagtaataaaacgtcggaccgtacgtagttttacggacctaaggggaccaaggctaggacatcagacaactgcgctcgacacatctgtcttac

SEQ ID NO: 11099 - DNA, 511 bp, Homo sapiens
  misc_feature: GYAE6OF01CUTLZ.25.15.B04.1.454.CMB.1.raw
  modified_base (297)..(297): a, c, t, g, unknown or other
  misc_feature (297)..(297): n is a, c, g, or t
  modified_base (360)..(360): a, c, t, g, unknown or other
  misc_feature (360)..(360): n is a, c, g, or t
  modified_base (412)..(412): a, c, t, g, unknown or other
  misc_feature (412)..(412): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggaccagcagaaacctggccagggtcccaggctcctcactccacggtncactccaccaggccactggaatccagcaggtcagtgcagtggtctgggacagacttctctctnaccatccagcagcctgcagtctagagtacttttgctagtttatactgtcagntaagtaataaaactggtccgtaacgtagttttacggccgtaggggaaccaaggccgtaggacagtcgagaagaactggtagctagcacatctgtcttac

SEQ ID NO: 11100 - DNA, 514 bp, Homo sapiens
  misc_feature: GYAE6OF01COZTR.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctgggacagacttctctctcaccatcagcagcctgcagtctgacgtattttgactagtttattactgtcagcagtaataaaactggaccgtactagttttcggaccgtaaggggaccaagcgtaggactatcgagacgtaacgtgtacggctcgcacatctgtcttacc

SEQ ID NO: 11101 - DNA, 534 bp, Homo sapiens
  misc_feature: GYAE6OF01BZYSG.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtatagcggcaacttagcctggtaccagcagaaacctggccagggtcccaggctcctcactccacggtgcactcccaccgagggccacgtggaacttccgagccaggttcaggtgcaggtgggtctgggacagtacttctctctcaccatcagcagcctgcagtctgacgtatttgctagtttatactgtcagtctaagtaataaacgtcggtaccgttacgtaggtttcggaccgaggggtaccaagtcgtaggacagtacgaacgtacgaacgtgtaggcgtcgtaccacctatctgtcttacc

SEQ ID NO: 11102 - DNA, 620 bp, Homo sapiens
  misc_feature: GYAE6OF01CQ5BH.25.15.B04.1.454.CMB.1.raw
  modified_base (298)..(298): a, c, t, g, unknown or other
  misc_feature (298)..(298): n is a, c, g, or t
  modified_base (310)..(310): a, c, t, g, unknown or other
  misc_feature (310)..(310): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagcccaccctctcctgcgagggccagtcagagtattagcggactaacttacgcctggtaccagcaagaaaccgtggccgacgggtcccaggcctcctnactccgacggtncactccaccgaggccacgtggtaacttccacgcgtaggttcaggtcggacgtagggtcgggtcgtaggggactagtacctttcgtcctactaccactactcgacgccagtcctggaccaggttcctagtacgttatttgacttagttttatacgtgtacgagtataagttaaacttaaacgtcggtacccgtttagttacggtttccgggaccggtaacggggaccaaggtccgtacggactagtaaccgaacggtaaccgtaaggtcggtacggacttacgacctaccgtagttctcgttaccttaccg

SEQ ID NO: 11103 - DNA, 755 bp, Homo sapiens
  misc_feature: GYAE6OF01ES622.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtatagcggcaacttagcctggtaccagcagaaacctggccagggtcccaggcctcctcactccgacggtgccactcccgaccgacgggcccacgttacgggaaactttccaacggtaccccgtaaggtttccaaggttcggccgtaagggttcggggttacctgggggaacctaagggtacctttcgttcctcgtaccaaccctattccgaacgccaacggtcccgttgacgtaacggttctaaagggaaagtacgtttcggtttacgtaaccttaaacgttttaacgtttaaccgttaggttaaaaccttaaaaacggttaacttaaacgtttacccgtcccgtacccccctttacgttaacccgtttacccggtttaccggggaccgggtaaccgggtaaaccgtaaaggggttacgggaaaccgttaacgttaaacccggaaaacggtaccgttacgggtaccggtaccttacgggaccctaacccgttacgttacccgttcgtttaccgttaccgttacccg

SEQ ID NO: 11104 - DNA, 497 bp, Homo sapiens
  misc_feature: GYAE6OF01EHY95.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctgggacagacttctctctcaccatcagcagcctgcagtctgacgtattttgctagtttattactgtcagcagtaataaaactggaccgtactagttttggacctagggaccaagctggacatcagagaacgtgagctgcacatctgtctac

SEQ ID NO: 11105 - DNA, 573 bp, Homo sapiens
  misc_feature: GYAE6OF01B3JDO.25.15.B04.1.454.CMB.1.raw
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcgagggccagtcagagtattagcggacaacttagcctggtaccagcaagaaacctggccagggtcccaggcctcctcactccacggtgccactcccaccgacgggccacgtggaacttccgaagccaggttcagtggcaggtgggtcngggacagtcttcnctctcaccatcacgcacgctcgctagtctggacgtagttttgacttagttttacttacgtgtacagtactaagttaaactaaacgtcggtaccttacgttagtttcggaccgtaggggtaccaaggtcgtacggactacgtacgaacggtaacgtaacggtggtacgacgtcgacctacattctgttccttaccg

SEQ ID NO: 11106 - DNA, 724 bp, Homo sapiens
  misc_feature: GYAE6OF01DGXNE.25.15.B04.1.454.CMB.1.raw
  modified_base (314)..(314): a, c, t, g, unknown or other
  misc_feature (314)..(314): n is a, c, g, or t
tcagactgtacagtcacgaccggtgctcgatttagacagtatatatccggcgggaggaactgctcagttaggacccagacggaaccatggaagcccagcgcagcttctcttcctcctgctactctggctcccagtattccactggagaaatagtgatgacgctagtctccagccaccctgtctgtcgtctccgaggggacaggaggccaccctctcctgccagggccagtcagagtataggcgactaacgttgcctaggtaccagcaagaacctggaccaggggtcccaggtcctacctcacgtccgacgggtncctacgtcccaaccggacggggccaacgtgggaaacttccgaggtcccgtaggttccgaaggtcggacgtagggtgggtccgtaggggaacctaggtacctttcgtccttactaccgaaccctatacccggaacgtaccgtaacgtcccgtacgtaccgtaacgttcttacggtaacgttagttttacgtacgttaacgttttacttaacgttagtaccgtagtacctaaagttaaactaaaaccgttcggtaaccgttaacgttacggtttacgggaaccgtaacggggtaccctaaagggtccgttaacgggaaccgtaacggttaccgaaacggtaaccggtaaacgttcgggtacggtccgtaacggtaccctaaaccgttacggttaccttcgttaccgttaccg

SEQ ID NO: 11107 - DNA, 612 bp, Homo sapiens
  misc_feature: GYAE6OF01BS9XL.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtatagcggcaacttagcctggtaccagcagaaacctggccagggtcccaggcctcctcatccgacggtgcactccaccgacgggccacgtggaacttccgagcctagggttcaaggtcggcgtaggtggggtctaggggactaggtaccttctcgtcctactaaccatcagcacgccctgactagtctagacgttagtttgacttagttttactacgtgtacagtactaagttaaactaaaaccgtcggtaccgttaacgttaggtttacgggaccggtaggggtaaccctaaggtcgtacggacctaacgttacgaacggtaaccgaacgttgggtacggtactcggtaccctaacgttaacttcgttcgttcgttaaccc

SEQ ID NO: 11108 - DNA, 509 bp, Homo sapiens
  misc_feature: GYAE6OF01DZOWN.25.15.B04.1.454.CMB.1.raw
  modified_base (499)..(499): a, c, t, g, unknown or other
  misc_feature (499)..(499): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccaacagaaacctggccagggtcccaggctcctcatccacggtgcatccaccagggccactggaattccagccaggttcagtggcagtgggtctgggacagacttctctctcaccatcagcagcctgcagtctgacgtattttcgctagtttattacttgtcagctaagtaataaaacgtggaccgtactagtttggaccgtagggaccagcgtggacatagagacgaactggtggctgcaccatntcgtctctac

SEQ ID NO: 11109 - DNA, 595 bp, Homo sapiens
  misc_feature: GYAE6OF01EDWN6.25.15.B04.1.454.CMB.1.raw
  modified_base (560)..(560): a, c, t, g, unknown or other
  misc_feature (560)..(560): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagcccaccctgtctgtgtctccgaggggacagacgcccaccctctcctgcagggccagtcagagtattagcggacaacttagcctaggtaccagcaagaaacctggccagggtcccaggcctcctcactccgacggtgccactcccgaccgacgggcccacgtaggaacttccgagcctaggttcaggtggctagggtcgggtctagggacagtacttctctctcacactcagcacgcctgctacgtctgtacgttatttcgacttagtttacttacgtgtacacgtactaagtaaactaaaacgtcggtaccgttaacgttacgttttacggaccggtaacgggaaccaagtcgtacggactaagtacgaacggtaacgtaacgttcggngtcgtacgtacctactacgttctggttccttaccg

SEQ ID NO: 11110 - DNA, 821 bp, Homo sapiens
  misc_feature: GYAE6OF01EI3L6.25.15.B04.1.454.CMB.1.raw
tcagactgtacagtcacgaccggtgctcgatttagacagtatatatccggcggggaggaactgctcagttaggacccagacggaaccatggaacgccccagcgcagcttctcttcctcctgctactctggctcccagtattccacgtggagaaatagtgatgacgcagtctccagccacctgtctgtgtctccgagggacaggacggccaccctcgtccctgccgaggggcctacgtcagacgttattacggccggtactaaacgttcgccgttagggtaacccagtacctaacggaaaacccgttcgggacccgtaacgggggttccccaagggtccctccccgtccgtaacgttccccggaaccggggtcgacccgaaccgttaccccgaacccggtaacgggggaccctacggttacgggaacctttacccggaacggtccccgttaaggggtttcccgaaaggttcgggaccgtaagggtttcgggggtaccgttagggggaacctaacgggttaacctttccggtacccttcccgttaccaaccccgtacgtttaccgaaccggtaccgtaacggtccccgtacgtccgtaacggttacccgtacgtaaccgttagttttacgtacgtttacgttttaacttaacgttatccgtaagtacctaagttaaacgtaaaacgtcggtaacgttaacgttacggttttacggaccgggtaacgggaaccgtaacggtaccgtaggaccgtacgtacgtaacggtacggtaacgtcggtacggcgttacgtaccgaaccgttagtcgttcggttcttaccg

SEQ ID NO: 11111 - DNA, 789 bp, Homo sapiens
  misc_feature: GYAE6OF01DNIM8.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggcctcccagattccactggagaaatagtgatgacgcagtctccagccacctgtctgtgtctccgaggggacagacgcccaccctctcctgcgagggccagtcagtagtataggcgactaacttgcctggtaccagcaagaacctgggaccacggggtcccaggtcctccgtacactccgacgggtcaccgtactcccgaaccggacggggaccctacggtacggtaacttacccgacggtacccgtagggttccaagggtcggacgtaaggggttcgggtacgtacggggaactaacggttacctttcctaccttacttacccgaaaccctcgtaccgaacgtccgacggtcccgtacgtaccgtaacggttccgtacggtaaccgttacgtttttacggtacgtttaacggttttaacctttaacgttcggttaccgtaacggtaacttaaacggttaaacgttaaaaccggttccgggttaacccgtttaacggtttaagggttttaccgggaacccgggtaaacgggggtaaccctaaacgggtaccgttacgggaaacgttaccgtaaccggtaaaccggtaacggtaaaccggttcgggtacggtacccgttacgtacccgttaacccgtagtttacccgttcgttcccgttacccg

SEQ ID NO: 11112 - DNA, 587 bp, Homo sapiens
  misc_feature: GYAE6OF01BA40E.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacgttagcctggtaccagcagaacctggccagggtcccaggcctcctcactccgacggtgccacgtcccaccgagggcccacgtggaacttccgacgtccgaggttcaggtcggacgaggtcgggtcgtggggacaggactttctactctacaccatcagcacgtcctgacagttctgacgtagttttcgacttagtttactctcgtacgagtacaagttaactaaacgtcggtaccgttacgttaggtttacggaccgtagggtaccaagtcgtaggactacgtacgacgtaacgtaacgtgggtacgtaccgtacgacccgtaactattcgttcgttcttacccg

SEQ ID NO: 11113 - DNA, 659 bp, Homo sapiens
  misc_feature: GYAE6OF01CCPCT.25.15.B04.1.454.CMB.1.raw
tcagactgtacagtcacgaccggtgctcgatttagacagtatatatccggcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctcctgcgagggccagtcagagtattagcggacaacttagcctggtaccagcaacgaaacctggcccgagggtcccaggcctcctcacgtccgacggtcgctactcccgaccgagggaccctacgtcggaacttccgacgccgtagggttcaggtggcgtaggtcgggtcgtaggggactacgtacctttctcttctccgacactcgacgctacgcctgactagtctagtacgttagtttcgacttaagtttattacgtcgttacgaacgtacgtaaagtaacttaaacgtcggtaccgttaacggttacgggttttaccggaaccggtaacggggtaccaacgggtctacgggtaccaacggttaccgaacgtaaccggttacggttcggtaccggtacgttaaccgtcctaaccgttacgttcccgtttcgttccgtttaacccg

SEQ ID NO: 11114 - DNA, 616 bp, Homo sapiens
  misc_feature: GYAE6OF01EN07T.25.15.B04.1.454.CMB.1.raw
  modified_base (392)..(392): a, c, t, g, unknown or other
  misc_feature (392)..(392): n is a, c, g, or t
  modified_base (399)..(399): a, c, t, g, unknown or other
  misc_feature (399)..(399): n is a, c, g, or t
  modified_base (601)..(601): a, c, t, g, unknown or other
  misc_feature (601)..(601): n is a, c, g, or t
  modified_base (607)..(607): a, c, t, g, unknown or other
  misc_feature (607)..(607): n is a, c, g, or t
  modified_base (611)..(611): a, c, t, g, unknown or other
  misc_feature (611)..(611): n is a, c, g, or t
tcagactgtacagtcacgaccggtgctcgatttagacagtatatatccgcgggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcacgggccagtcagagtattagcggacaacttagcctggtaccaggcagtaaacctggacctaggtcccaggtcctacctacatccgacggtgcactccacgacgggccactggaacttccagccgagttcgagtcgcgagtgggtcgtagggactagtacttcgtctctcgacntcgatcnctccgtgacgtcgttacgtacgtacgttacgtttttcggactttaaccggtttttaagtttacccgttgtttaccgaacggttaccaaaggtttaaacttaaaccggtacggtacccggtttaagttacgggttttacggcccggtaaagggtacctaaggtccgtaggacctagtacgaagacgtatcggagcacgctacngttcgngttnttacc

SEQ ID NO: 11115 - DNA, 228 bp, Homo sapiens
  misc_feature: GYAE6OF01B387D.25.15.B04.1.454.CMB.1.raw
  modified_base (223)..(228): a, c, t, g, unknown or other
  misc_feature (223)..(228): n is a, c, g, or t
tcagactgtacagtcacgaccggtgctcgatttagacagtatatatccgcggggtggaggctgaggatgttggggtttattactgcatgcaaggcacacactggcctttcgctttgggccctgggacgagagtggatatcatacgaactgtggctgcaccatctgtcttcatcttcccgcatctgaactgtacagtctgagcgggctggacaaggcgcatagnnnnnn

SEQ ID NO: 11116 - DNA, 803 bp, Homo sapiens
  misc_feature: GYAE6OF01C1KDI.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcagggccagtcagagtattagcggacacttagcctaggtaccagccaagaaacctggccgagggtcccaggctcctcactccacggtgcactcccaccgacgggccacgtaggtaacttccgacgccgtaggttcaggtggacgtaggtggggtccgtaggggaactacggtacctttccgtccttcctaccgaaccctagttccgacgaccgtaaccgtcccgttacggaccgtacggttacccgttacgggtaacgtttaacgtttttcggtaccgtttaaacgggtttttaacttttaaccggttaggtttaccgtaacggtaaccgttaaaacgtttaaaacggtttaaaaaaccggttccggggttaaccccggttttaaaccggtttaacggggttttttaccggggaacccgggttaaacggggggtaaccccgtaaacgggtaccggttaacgggaaaccgtaacggttaacccggaaacgggtaaacccgggttaaaccggttcgggttaccgggtaccgttaaccggtaccctaaacccggttacgtttacccgttcggttttacccgtttaacccg

SEQ ID NO: 11117 - DNA, 525 bp, Homo sapiens
  misc_feature: GYAE6OF01E1P2A.25.15.B04.1.454.CMB.1.raw
  modified_base (299)..(299): a, c, t, g, unknown or other
  misc_feature (299)..(299): n is a, c, g, or t
  modified_base (355)..(355): a, c, t, g, unknown or other
  misc_feature (355)..(355): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggcaacttagcctggtaccagcagaacctggccagggtcccaggcctcctcactccacggtncatccaccgagggcccactggaattccagccaggttcagtgcagtggtctgggacnggacttctctctcaccatccagcacgcctgcacgtctgacgtatttgctagtttacttactgtcagactagtaactaaacgtggtaccgtacgtagttttacggaccgtagggacctaagcgtaggtacgatacgacgacgacgtgacgctacgcaccatctgtcttacg

SEQ ID NO: 11118 - DNA, 590 bp, Homo sapiens
  misc_feature: GYAE6OF01A3OTM.25.15.B04.1.454.CMB.1.raw
  modified_base (302)..(302): a, c, t, g, unknown or other
  misc_feature (302)..(302): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagacgccaccctctcctgcagggccagtcagagtattagcggcaacttagcctggtaccagcacgaacctggccagggtcccaggtctcctacacgtccacggtncactcccaccgagggccagtaggacttccacgccaggttcagtggcaggtgggtcgtgggacagcttctctctacacgtatcgagcgacgtccgtgcgacgttcctagtacgttattttcgcttagttttacgttactgtacctagtactaacgttaactaaaacgtggtacccgtagttacggtttcggaccgaacggggtaccaacggtctaggtaccgtactacggacgaaccgtaacgtcggtcggtccttaggaccctaccgtacttcttcgttcccttaacg

SEQ ID NO: 11119 - DNA, 679 bp, Homo sapiens
  misc_feature: GYAE6OF01EM2EC.25.15.B04.1.454.CMB.1.raw
  modified_base (201)..(201): a, c, t, g, unknown or other
  misc_feature (201)..(201): n is a, c, g, or t
  modified_base (482)..(482): a, c, t, g, unknown or other
  misc_feature (482)..(482): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctccagattccactggagaaatagtgatgacgcagtctccagccacctgtctgtgtactcgagggacagtacncccacctctcctgcgacgggccagtacaggtagttagtaggaccggtactaaaaccgttcggacccgttaggtaacccgagaccgtaaacggtaaaacccgttcgggaacccgaccgggggttcccaaggtccctaccctacgacgtaccgtaacgggtgaccgtacctacccgaccggaggtaccctagtacggaaacttccgacgtccgtaaggttcgaggtcgacgtaggtcgggtacgtacgggaactacggtaccttcgtactccgtacaacctanaccgagacgtacgtcctgacttacgactacgtaacgttagtttaccgtatttacgtttactacgtcgtacgagtaactaagtaaacgtaaacggtcgtaacgtacgttacggtttacgacgaaccgggactaggctagactactacgaacgttacaacgttgacgtacgactacctactactcgttcgtcgttaccg

SEQ ID NO: 11120 - DNA, 661 bp, Homo sapiens
  misc_feature: GYAE6OF01DJRUL.25.15.B04.1.454.CMB.1.raw
  modified_base (170)..(170): a, c, t, g, unknown or other
  misc_feature (170)..(170): n is a, c, g, or t
tcagactgtacagtcacgaccggtgctcgatttagacagtatatatccggcggggaggaactgctcagttaggacccagacggaaccatggaagccccagcgcagcttctcttcctcctgctactctggcctccagacttccactggaagaaatagtgatgacgcagtcnccagccaccctgtctgtcgtctaccgaggggacacgacgcccaccctctcctgaccgacgggccagtcagagtatagcggactaattacggccgtggaaccagcaacgaaccgtggacccgacgggtcccaggcctacctacgacttccgacggtgaccaactcccgacggtacggacctacgttacggaaacttccgacgtaccgtaggttacgaaggtggacagggttgggtacgtagggactacggttaccttctaccgttcctacgaacctgtaccaagccacggctacgactacgtcgtacgtatttacttcgacttagtttacttacgtacgtacgagtaacgttaagtaaacgtaaacgtcggtaaccgtttacggttaggtttaccggaccgggtaaggtacccgtaaggtccgtaaggacctcgaacgtacggtactaaggtccggtacgtctacgaacctacttagttctacgttctaacg

SEQ ID NO: 11121 - DNA, 868 bp, Homo sapiens
  misc_feature: GYAE6OF01B50D2.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggcctcccagtattcccactggagaaatagtgatgacgcagtctccacgccaccctgtctgtgtctccgagggacagacgcccacccgtctcctggccagggcccaggtcaaggtagttacttaggcggacctaacgttacgccgttggtaacccagaccaacgtaaacccgtcggacccgtaacggggtccccaacgggtcccttccccgtactaacgttaccccgaccgggttacgcctaaccgtaccccgaacccggtacgggtaccccctaaggttaccgggtaaaaccgtttaccccgaaccgggtaccccggttaaggggttttacccgaagggggttccggtaaccggtaaggggtttcccgggggtacggttaaccgggggaaccttaacggggtacccttttaccgtcccggttaccctaccgtaacctacgttacccgacgaccctacggtcccgtacgtacgtacgttcgtaacggttaacgttacgtttttccgaacgttttacggttttaacttaaccgttcgttaacgacgttaaccctaaaggttttaaaaccgtaaaaccgttcccggggttaacgtttaacggttttaaccggtttaccggggaaccgttaacggggaccctaagggttcccttaagggaccttaacgaccggtaaacgtaccgggttaacgtgggtacggtaccacggtaaccctacgtaatttcccgttgtttacccgttacc

SEQ ID NO: 11122 - DNA, 677 bp, Homo sapiens
  misc_feature: GYAE6OF01C8Q2Z.25.15.B04.1.454.CMB.1.raw
  modified_base (215)..(215): a, c, t, g, unknown or other
  misc_feature (215)..(215): n is a, c, g, or t
  modified_base (324)..(324): a, c, t, g, unknown or other
  misc_feature (324)..(324): n is a, c, g, or t
  modified_base (459)..(459): a, c, t, g, unknown or other
  misc_feature (459)..(459): n is a, c, g, or t
  modified_base (666)..(666): a, c, t, g, unknown or other
  misc_feature (666)..(666): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagcccaccctgtctgtgtctccgagggacagacgcccaccctctcngcgacgggccagtcagtagttattacggcggactaacttacgcctaggtaccagacaagaacccgtggaccgacggggtcccaggtcctcccactagtcccgtacggtnaccactacccgaccggacgggtaccacggttacggaaccttcccgacggtaccgtagggttcagggtcggtacggtcggggttcgggtcgtacgggggactacggtaccgtttcctccgttaccacctaaccgtnaccgtacgacctcgtccctaggcctacggtcgtacggtacgttacgtttcgtacgtttaatttacgttacgtgttaacgtacgtacttaaacgttaacgttaaaccgtcggttaaccgttagttacgttcgggacgtaccgggactaaggctacggactagtacgaacgtacgtaacggtggacggtcacgaccttactgttaccgngttactacccg

SEQ ID NO: 11123 - DNA, 715 bp, Homo sapiens
  misc_feature: GYAE6OF01CG2KE.25.15.B04.1.454.CMB.1.raw
  modified_base (147)..(147): a, c, t, g, unknown or other
  misc_feature (147)..(147): n is a, c, g, or t
  modified_base (161)..(161): a, c, t, g, unknown or other
  misc_feature (161)..(161): n is a, c, g, or t
  modified_base (163)..(163): a, c, t, g, unknown or other
  misc_feature (163)..(163): n is a, c, g, or t
  modified_base (204)..(204): a, c, t, g, unknown or other
  misc_feature (204)..(204): n is a, c, g, or t
  modified_base (340)..(340): a, c, t, g, unknown or other
  misc_feature (340)..(340): n is a, c, g, or t
  modified_base (426)..(426): a, c, t, g, unknown or other
  misc_feature (426)..(426): n is a, c, g, or t
  modified_base (683)..(683): a, c, t, g, unknown or other
  misc_feature (683)..(683): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattcccatgganaaatagtgatgacncngtctccagcccacctgtctgtcgtcaccgagggacaggacnccctcctctctgacacgggcctagtccagtagttatcggcggactaacgtttcgaccgtcggtaaccacggaccaaacggtaaaccgtcgggaccgtaccggggttccacggtccctcctacacgtccgtacggtnacctacctcccgaccgacgggtcacggttagtaacttcccgagtaccgtagttaccgaggttcgacgtggtcgggacgtggtaacncggtctctacctcgacctacatccgaagtcaccgtccgtcgatacgtgtagtacttagttccgttaagttacttttacgtccgtagttaccgaacgtaacgtttaaacgttaaacgtaaaccggttccggttaccggttaaacggtttcggtttaacggggacctaacggggtaacctaacgtacggttacggaaacctaccgttaacggaaccgtaacccgggaatttccggaaccggttacaccggtaacccttnttaaccgggtttctcccgttaacggtttaccc

SEQ ID NO: 11124 - DNA, 846 bp, Homo sapiens
  misc_feature: GYAE6OF01C912Q.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgcccaccctctccgtgaccgagggccctagtcagtagttaattacggcggactaacgttacggcctacggtaaccagaccaagtaaacccgtggacccgacgggtccccgaggtccttaccgtacacgttaccccgacggtcgacctaactcccgaacccggcggacctacgtaagggtaacttcccgacgtaccgtaggttcaaggtcggacgtagggtcgggtccgtaggggaactacgtacctttccgtacttcctaccgacgtacttaccgacgaccgtaacgtcccgtagtacgtacggtttacgttaccggttaaacggtttaacgtttttacggtaacgttttaacgtttttacgttttaaaccgtacggtttaccgtaaacggttaaccgtttaaacgggttaaaacgtttaaaaacccggttaaccggggttaaccccgggttttaaaggttaaccgggttttttaccgggaaacccggggtaaaccgggggttaccctaaaccgggttacgggtaaccggtaaaccgtaccgttaaccgtaaaaccggggtaaaccgtaacggttacgggtacccgggtcctaccggtaacccgttaaccgtactttaccggttccggtttaacgtttaccccg

SEQ ID NO: 11125 - DNA, 834 bp, Homo sapiens
  misc_feature: GYAE6OF01BRWDF.25.15.B04.1.454.CMB.1.raw
tcagactgtacagtcacgaccggtgctcgatttagacagtatatatccgcgggggaggaactgctcagttaggacccagacggaaccatggaagccccagcgcagcttctcttcctcctgctactctggcctcccagattccactggaagaaatagtgatgacgcagtctccacgcccaccctgtctgtcgtcctccgaggggacagacgccctaccctctccgtgcgacgggccagtcgaagtagttagtacggcggactaacttacgccgtaggtaccagtacgaacgaaccgtcggaccgacggtcccacggtcctccgtcacgtccgacggtcaccacctacccgacggacggtacccaacgttacgggtaacttcccggaagtcccgtacgggttaccgacgggtcggtacggtaggggtcggggttacggtacggggtaccgtaacggttacctttcccgttacccgttaccctaccctaacccgtaacgtaccggtacggtaccgtacccgtacccggttaccggacgttaccgggtttacggtaaccgggttaacgttttacgtttttacccgggtacttttaacgggttttttactttacccgtttcggtaaccgttaggttaaccgtaaacgtttaaacggttaaaccgttcccgggtaaccggtttaacggtttaccgggtttaacccgggtaaccggtaaccgggtacccgtaacgtccggttacggtaacctacgtaaccggtaacggtaaccggttacggtcgggtccgtacccgttccgaaccgttacccgttagttccgtttccgttccgtttacccg

SEQ ID NO: 11126 - DNA, 831 bp, Homo sapiens
  misc_feature: GYAE6OF01AZ535.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggcctccagattccactggagaaatagtgatgacgcagtctccagccacctgtctgtgtctcgagggacagacgcccacctctcctgcagggccagtcagattagtagcggctaacttgcctggtaccagacaagaaccgtggccacgggtcccaggcctccgtcactccgacggtcgacacgtccaccgagggccctaacgtggtaaccttccgaacggtcccgtaagggtttccaagggtcgacgtacgggttggggtcctagggggactacggtactttcccgtctaccgtaccacgttactacggacgtacccgtacgtaccgttcgaccgttaacggttcccgtttaacgggtaaccgttttacggtttttacgaccgtttttaaaggttttttaaaccgttccgttacgggtttaacctaacggtaccttaaaaacgggtttaaacttaaaaaccgggttccgggttaaaccccggtttaaacggttttaccggggttttaacccgggaaacccggggttaaccgggggtaaacccgtaaaccggtttaccgggtaaacggtaaaacccgttaacgggttaaccggtaaacccggggtaaacgtttaacccgggttgggtaacccggggtacgttaacccctaaaccccggttacgttaaacccggtttcccgtttacggttttaacccgttcccccgg

SEQ ID NO: 11127 - DNA, 805 bp, Homo sapiens
  misc_feature: GYAE6OF01AI7QV.25.15.B04.1.454.CMB.1.raw
  modified_base (93)..(93): a, c, t, g, unknown or other
  misc_feature (93)..(93): n is a, c, g, or t
  modified_base (132)..(132): a, c, t, g, unknown or other
  misc_feature (132)..(132): n is a, c, g, or t
  modified_base (157)..(157): a, c, t, g, unknown or other
  misc_feature (157)..(157): n is a, c, g, or t
tcagactgtacagtcacgaccggtgctcgatttagacagtatatatccgcggggaggaactgctcagttaggacccagacggaaccatggaanccccagcgcagcttctcttcctcctgctactctggcccncgatctccagtagaataagtagtanatagacgacgtactcctaccgaccgccctaccgttcgtcgtggttcgttccgtacgggacgggacgagccgaccctacccttcctcgtcgacggacggtaccgtagacgagtagttagtcggcgaacttacgtacgtccggtacgaacgcgtaaccgaaaccgtaccgtccggaccgggtaccggtacccgacgtcccttccactcctaaccgggtcggtcaccacccgtacccgacggaccgtactacggtacgttacctcgaccgtcggttaacgtcgtaggcgacggtggggttcggtcggtaaccggacgtacctttccgttcctccgtacctaccgtactccaacgccggtacgtaccgtcgtacgtcgtcgtacgttacggttactttacgttacgttacgttttaacgttttacgtaccgtttagtaaccgtacgttaacgttaaacgttaaaaccggtccgttaacccgggttacgtttacggggttttacggttaacccgggaaccggttaacgggtaaccgtcggtaacggttaacgtaaaccgttagtaaccgggaaccggttaagttacgggtccgtaccggttcccgtaacgtacccgttacttaccggttcgtttcccttaacccggttacccg

SEQ ID NO: 11128 - DNA, 898 bp, Homo sapiens
  misc_feature: GYAE6OF01AFA9J.25.15.B04.1.454.CMB.1.raw
  modified_base (835)..(835): a, c, t, g, unknown or other
  misc_feature (835)..(835): n is a, c, g, or t
  modified_base (845)..(845): a, c, t, g, unknown or other
  misc_feature (845)..(845): n is a, c, g, or t
  modified_base (860)..(860): a, c, t, g, unknown or other
  misc_feature (860)..(860): n is a, c, g, or t
  modified_base (870)..(870): a, c, t, g, unknown or other
  misc_feature (870)..(870): n is a, c, g, or t
tcagactgtacagtcacgaccggtgctcgatttagacagtatatatccgcggggaggaactgctcagttaggacccagacggaaccagtggaacgccccagcgcagtccttctccttccgtcctgaccttacgtctggcctccgagtacttcccgagtgggaaataaacgttggtcgaacgtcggaacccggtctacgtccctaccgacgtccctaccgttgtcctacggttcgttacccgcggaacggggactaacgtccgtacccctaccgttccgtccgtaacgggccgaccgggtaccgacgtagaaggttaaccggttagtacccggccggtaaccttaaacggttccggccgttaagtaacccgaccgaacgtaaccggtaacggtacccggacccgggttaccggacccgtccggacccttaccgtacctaaccggtccgggtaccggaccctacgtaccccgtaccccggaaacggtcggtacccgtttacgaacgggttaccctaccgggtacccggaccgtttaagggtccgtacgggttacccggacggggtacggttacggtcccgtaaaagggttccctccgtttacctcccgttaaaccgtcaaaccccgttaagccctacggagttacccgaccggcgtttccgacttacgggtttaccgtacgttaccgtttaggttaacccttgttttaaaccggtttacgcccgttaggttaaccgaacggtttaaccgtaaaacgttaaacggttccggtaccggtttaaccgttaggttacccgtaacggggtaccgaacgttaccggagttacccaggttaccnggttaaacgnggttaaccggcgttnaccgggttanacctcgttcgatttcggcttaacgtccc

SEQ ID NO: 11129 - DNA, 863 bp, Homo sapiens
  misc_feature: GYAE6OF01EL942.25.15.B04.1.454.CMB.1.raw
  modified_base (127)..(127): a, c, t, g, unknown or other
  misc_feature (127)..(127): n is a, c, g, or t
  modified_base (149)..(149): a, c, t, g, unknown or other
  misc_feature (149)..(149): n is a, c, g, or t
  modified_base (301)..(301): a, c, t, g, unknown or other
  misc_feature (301)..(301): n is a, c, g, or t
  modified_base (616)..(616): a, c, t, g, unknown or other
  misc_feature (616)..(616): n is a, c, g, or t
tcagactgtacagtcacgaccggtgctcgatttagacagtatatatccgcggggaggaactgctcagttaggacccagacggaaccatggaacgccccagcgcagcttctcttcctcctgctactcnggctcccagacttccactgganaaatagtgatgacgctagtcctaccacgccctaccgtgtctgtcgtcctccgaggggacacgtaccgccctacccttctccgtacgaccgacgggcctagtacgacgtagttacgtacggcggtactaaacgttacgccgttacggtaaccncgtaccgaacggtaacccgtcggacccgtaacggggtccccaacggttccctaccgtaaccgtaaccgtcccggaacgggttccaaccgtaccgtaccccgaccgggaaccgggtacccaagttacggtaacccttccgaacggtccgttaacgggtttaccgaggtacggtacgtaaggggttccggggtacggttaacggggacccttaacggttccctttaccggtacccttaccgtaacccaaacccgtggttacccgaacgtccgtaccggaaccgttcgtacgtaccgttacgtaccggttaacggttntttttacggacgttttaacgtttacttaccgttcgtaactacgggttaactaactttaaaacggtaacggtaaccggtaccgtttacgttaacggtttaaccgaccgggtaacggtaaccgttacggtaccggtaagtacccggtaagaacccggttaacggtaacccggttaggtcggttaccccgggtataaccccggtaccgttaacccggttaacccgttcgttttaccgtaccggttaaccc

SEQ ID NO: 11130 - DNA, 706 bp, Homo sapiens
  misc_feature: GYAE6OF01BVOUF.25.15.B04.1.454.CMB.1.raw
  modified_base (529)..(529): a, c, t, g, unknown or other
  misc_feature (529)..(529): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtcgtctccgagggacagacgcccaccctctcctgcgaggccagtcagtagttattacggcggactaacgttcgccgttggtaaccagacgaacgaaacccgtcggaccgtacggggtccccaaggtccctccgtaccacgtccccgacggtcaccgtacctcccgaacccgacgggtccctacggtaggtaacctttcccgaggtaccccgtaggttacacgggttcggacgtaggggttcggggtccgttagggactaccggttaccttcgttacctaccgtaccaccgtacgtacgacgtaccgtacggtcctacggtaccgtagttcccgtacgttaacgttntttacgtaccgtttaagttttactactttcggtaccaggttaacctaagtaaacgttaacgtcggtacgttacgttagttcggaaccggtagggtactacggtgtaacgctacgtaccgaacggtactacgggtcgtcgtccgtacgaacctaccgttacgttcgttcgttccttcg

SEQ ID NO: 11131 - DNA, 696 bp, Homo sapiens
  misc_feature: GYAE6OF01B9P9O.25.15.B04.1.454.CMB.1.raw
  modified_base (304)..(304): a, c, t, g, unknown or other
  misc_feature (304)..(304): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggaagaaatagtgatgacgcagtctccagcccaccctgtctgtgtctccgaggggacagacgccaccctctcctgcgaggccagtcagagtatagcggacaagttgccgtggtaccagcagaacctggaccagggtcccaggcctcctcactccgacggtnacactcccgacgacgggtacccagtacggaacttccgacgccgtaacggtcgaggtcggcgtagggttcggggtacgtggggaacctaggttacctttccgtaccgttcccctactaacccgtacttcccgaaggtacccgtacggtccgttcgaccgtacggttacccgtacggttaaccggtttagttttccgtacttttaaggttttttactaccggtttagtaccgtaacgtactaacgttaaaacgttaaaccgttcggtaacccgtttaacgttaggtttaccgggaacgggtaacgggtaccgtaacggtcgtacggactaacgtacgaacggtacgtaacgtcgggtacgtacgtcgtaccaccgttattcctgttcttacccg

SEQ ID NO: 11132 - DNA, 503 bp, Homo sapiens
  misc_feature: GYAE6OF02GMA32.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctgggacagacttctctctcaccatcagcagcctgcagtctgacgtattttgctagtttattactgtcagtcagtaataaaactggaccgtactagtttggccgtaggggaccaagcgtggacatacgagacgaactgtggctgcaccatctgtcttc

SEQ ID NO: 11133 - DNA, 508 bp, Homo sapiens
  misc_feature: GYAE6OF02G727D.25.15.B04.1.454.CMB.1.raw
tcagactgtacagtcacgaccggtgctcgatttagacagtatatatccgcggggaggaactgctcagttaggacccagacggaaccatggaggccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctgggacagacttctctctcaccatcagcacgcctgcagtctgacgtattttgctagtttattactgtcagtcagtaataaaacgtggtaccgtactagtttcggaccgtagggaccaagcgtaggacagtacgagacgaacgtgtggctgcacatctgtctc

SEQ ID NO: 11134 - DNA, 500 bp, Homo sapiens
  misc_feature: GYAE6OF02JBIBQ.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctggggacagacttctctctcaccatcagcagcctgcagtctgacgattttgctagtttacttacttgtcagcagtaataaaactggacgtactagtttggaccgtaggggaccaagctggacatcagacaacgtgtgctgcaccatctgtcttc

SEQ ID NO: 11135 - DNA, 505 bp, Homo sapiens
  misc_feature: GYAE6OF02F065T.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctggggacaggacttctctctcaccatcagcagcctgcagtctgacgtatttgctagtttattactgtcagcagtaataaaactggaccgtactagttttggaccgagggaccaagcgtaggacatcgagacgaacgtgtggctcgcaccatctgtcttc

SEQ ID NO: 11136 - DNA, 615 bp, Homo sapiens
  misc_feature: GYAE6OF02H2IZ3.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagacttccactggagaaatgtgatgacgcagtctccagccacctgtctgtgtctccgaggggtacaggagcccaccgtcgtcctggccgagggccgagtcaggagtattaggcggcaacttgcctggtaccagtccaagaacctggaccagcctacccagacctcctcctctacgtcggtcgcttccaccgacggcccctagaactactccccgacgaggttcaggtggacaggtggtctagggacagtacgttcacgtcgtcacctatcgacgcgacgccgtgactagtccgtagtaacgtagtttacgacttagtttacttacgttagtacaactagtaataaactacgtacggtaccgtcggtacggtacgtttacggaccgtaacggacgtaagggtacgaaacggacgtaaacggacgtggtacggtacgtacgtacctacgtcgtacgtacgttaccgttactacctccgttcccg

SEQ ID NO: 11137 - DNA, 489 bp, Homo sapiens
  misc_feature: GYAE6OF02HHDWZ.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctgggacagacttctctctcaccatcagcagcctgcagtctgacgtatttgctagtttattactgtcagcagtaataaaactgaccgtatagtttgctagggaccagctgacatcgagacgactgtgctgcacatctgtcttac

SEQ ID NO: 11138 - DNA, 495 bp, Homo sapiens
  misc_feature: GYAE6OF02HI9N6.25.15.B04.1.454.CMB.1.raw
  modified_base (362)..(362): a, c, t, g, unknown or other
  misc_feature (362)..(362): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtccccaggctcctcatcccacggtgcatccaccagggccactggaattccagccaggttcagtggcagtgggtctgggacagacttcnctctcaccatcagcagcctgcagtctgacgtatttgctagtttattactgtcagcagtaataaaactgaccgtatagtttgccgagggacaagctaggacatcgagacgaacgtgtgctgcaccatctgtctc

SEQ ID NO: 11139 - DNA, 618 bp, Homo sapiens
  misc_feature: GYAE6OF02F4NBQ.25.15.B04.1.454.CMB.1.raw
  modified_base (379)..(379): a, c, t, g, unknown or other
  misc_feature (379)..(379): n is a, c, g, or t
  modified_base (384)..(384): a, c, t, g, unknown or other
  misc_feature (384)..(384): n is a, c, g, or t
  modified_base (400)..(400): a, c, t, g, unknown or other
  misc_feature (400)..(400): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagagccaccctctcctgcagggccagtcagagtattagcggcaacttagcctggtaccagcagaaacctggaccagggtcccaggcctcctcactcccgacggtcgcactcccaccgacgggccacgtggaacttccgagcctaggttcaggtggcaggtggctagggactaggtacttcncttcncacctagtcagcgacncctgcgtagttctagtacgtagttttcgcttagtttattacgttcgtacacgtactaagttaaacgtaaaacgttcggtaccgttaacgttacggttttacggaccggtaacgggtaaccgtaacgtaccggtacggactacgtacgtaaacggtaaccgtaacgtcggtacggtacgtacgtaccgtaaccgtagttaccgttacggttaccttacg

SEQ ID NO: 11140 - DNA, 552 bp, Homo sapiens
  misc_feature: GYAE6OF02I3YWE.25.15.B04.1.454.CMB.1.raw
  modified_base (386)..(386): a, c, t, g, unknown or other
  misc_feature (386)..(386): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcactccaccagggcccactggaacttccagccaggttcagtggcaggtgggtctgggacagacttctctctcaccatcagcagcctgcngtctgacgtatttgctagtttattactgtcagtcaagttaataaaacgtcggtaccgtacgtaggtttcggaccgtaagggacctaagtccgtaggactagtacgaacggtaaccgtaacgtggtacggtcgtacgaccgtacccgtagtccttcgttccttaccg

SEQ ID NO: 11141 - DNA, 561 bp, Homo sapiens
  misc_feature: GYAE6OF02I2NM9.25.15.B04.1.454.CMB.1.raw
  modified_base (298)..(298): a, c, t, g, unknown or other
  misc_feature (298)..(298): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccagggacagagccaccctctcctgcagggccagtcagagtattagcggcaacttagcctggtaccagcagaaacctggccagggtccccaggctcctcactccacggtncatccaccgagggccactggaacttccagccaggttcagtggcaggtggtctgggacagtacttctctctcacctatcagcacgcctgcgtagtctgtacgtattttgcttagtttattacgttgtacagtctaagttaactaaaacgtcggtaccgtacgttaggtttacggaccgtaacggggacctaaggccgttagggacctagtacgaagtaaccggtaacgtggtagcgtacgccaccgtacgtctcgttcttaccg

SEQ ID NO: 11142 - DNA, 516 bp, Homo sapiens
  misc_feature: GYAE6OF02HV4OQ.25.15.B04.1.454.CMB.1.raw
  modified_base (303)..(303): a, c, t, g, unknown or other
  misc_feature (303)..(303): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccacctgtctgtgtctccaggggacagagccaccctctcctgcagggccagtcagagtattagcggcaacttagcctggtaccagcagaaacctggccagggtccaggctcctcatccaggtgcatccaccnggccactggaattccagccaggtcagtgcagtggtctgggacagacttctctctcaccatcagcagcctgcagtctgacgtattttgctagtttacttactgtctagtcaagttaataaaacgtcggtaccgtatacggtttcgaccgtaggggacaagctaggacatacgaagacgtaacgtgtacgcgtcgcgaccatcgtgttcttaccg

SEQ ID NO: 11143 - DNA, 542 bp, Homo sapiens
  misc_feature: GYAE6OF02F2TGO.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtccccaggctcctcatccacggtgcatcccaccagggccactggaacttccagccaggttcaggtggcaggtgggtctggggacaggtacttctctctccaccatcagcacgcctgcagtctgacgttatttgctagtttattacttgtcagtctagtaataaaacgtggtaccgtataggtttcggaccgtaagggacctaagccgtaggacagtacgaagtaacgtaacgtggtacgtcgtcgaccaccagttccgtgtcttaccg

SEQ ID NO: 11144 - DNA, 505 bp, Homo sapiens
  misc_feature: GYAE6OF02GTJI5.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccaccagggccactggaattccagccaggttcagtggcagtgggtctgggacagacttcgtctctcaccatcagcagcctgcagtctgacgtatttgctagtttattactgtcagctagtaataaaacgtggtaccgtactagtttcggccgagggaccaagctgacatacgagacgaactgtagcgtgcaccatctgtcttacg

SEQ ID NO: 11145 - DNA, 564 bp, Homo sapiens
  misc_feature: GYAE6OF02IV7NZ.25.15.B04.1.454.CMB.1.raw
  modified_base (405)..(405): a, c, t, g, unknown or other
  misc_feature (405)..(405): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagacgccaccctctcctgcaggccagtcagagtattagcggcaacttgcctggtaccagcagaaacctggccagggtcccaggctcctcactccacggtgcatcccaccgagggccactggaatccagccaggttcagtggcagtgggtctgggacagagttcacgtctacgaccactcacgtcagtccctgcagttctagaaagttntttagactagtttaattacttgtacacagtaataactaactgtacctcgttaggtacgtttcggaccgtaaagggaccaaagggtaggaacgaccgaaaacggtaactcggtacggctacggaccaactacgtaccgttagtccttacacgtttacccg

SEQ ID NO: 11146 - DNA, 546 bp, Homo sapiens
  misc_feature: GYAE6OF02GQEFQ.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcactccacggtgcatccaccagggccactggaattccagccaggttcagtggcagtgggtctggggacagacttcgtctctcaccatcagcagcctgcagtctgacgtatttgctagtttatactgtcagctagtaataaaactggtaccgtaactagttttacggaccgtaggggaccaagtccgtaggacatcgaacgtaacgaaccgttggtacggtacttcggacctaaccgacttccgttagttacctttacccg

SEQ ID NO: 11147 - DNA, 540 bp, Homo sapiens
  misc_feature: GYAE6OF02IPZF0.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcaagaaacctggccagggtcccaggctcctcactccaggtgcaactccaccagggccactggaacttccagccaggttcagtggcaggtgggtctgggacagtacttctctctcacctatccagtcacgacctggcacgtctcgacgtattttgctagtttacttactgtcagtcaagtaataaaactcggtaccgtagtacgtttacggccgagggacaagcgtagactacgtcgaacgacgtaacgtgtacgtcttacgactacccattcgtcgtcttacg

SEQ ID NO: 11148 - DNA, 580 bp, Homo sapiens
  misc_feature: GYAE6OF02HBBVI.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccaacagaaacctggaccagggtccccaggctcctcatccacggtgcactccaccagggccactggaacttccgagccaggttcagtggcagtgggtctgggacagcttctctctcaccatcagcagcctgcagtctgtacgtatttgctagtttattactgttcagtactaagtaactaaaacgttcggtaccgttacgtagttttcggaccggtaacggggtaaccgtaaggtaccgtagggactagtacgaaggtaacgtaaacgttcggtacgggtcttacggaccgtaccgtaacgttccgttacgttaccttaccgtaccg

SEQ ID NO: 11149 - DNA, 518 bp, Homo sapiens
  misc_feature: GYAE6OF02FNIV6.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatcccacggtgcatccaccagggccactggaattccagccaggttcagtggcagtgggtctgggacaggacttctctctcaccatcagcagcctgcagtctgacgtatttgctagtttattacttgtcagcagtaataaaacgtggtaccgtactagtttcgccgagggacctaagggtgagtatacgaacgaacgtagtaggctgacaccactctcgtcttacattcccg

SEQ ID NO: 11150 - DNA, 606 bp, Homo sapiens
  misc_feature: GYAE6OF02JRMXU.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgacagggtccagtcagagtattagcggacaacttagcctggtaccagcagaacctggccacgggtcccaggctcctcactccgacggtgcacgtcccaccgagggccctacgtaggaacttcccgaacgccctagggttaccaggttcggaccaggttcggggtacgtggggaacacggtcctttcgtcttcctaccgaccagtttcgacgacacgtcctgcctacgtactgtaccgttagtttcgctagtttacttacgttcgtaccgtgactagttaactaaacgttggtacctacgtacggtttcggaccgtaacgggtaccaaaggtcgtacggactagtacgacgacgtacgtggtacgtcgtacgtcacgtactcgtacgtcttacg

SEQ ID NO: 11151 - DNA, 527 bp, Homo sapiens
  misc_feature: GYAE6OF02IM865.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcaagaaacctggaccagggtcccaggcctcctcactcccacggtgcactcccaccagggccacgtggaacttccagccaggttcagtggcaggtgggtctgggacagacttctctctcacctatcagcagctgcagtctagtacgtatttgactagtttattactgtacagtcaagttaataaaactcggtacgtactaggtttcgaccgtaacgggacagtcgtgacagtcgaagacgacgtgtacgcgtgaccactgtcttcgtctac

SEQ ID NO: 11152 - DNA, 638 bp, Homo sapiens
  misc_feature: GYAE6OF02H4WFH.25.15.B04.1.454.CMB.1.raw
  modified_base (238)..(238): a, c, t, g, unknown or other
  misc_feature (238)..(238): n is a, c, g, or t
tcagactgtacagtcacgaccggtgctcgatttagacagtatatatccgcgggaggaactgctcagttaggacccagacggaacatggaagccccagcgcagcttctcttcctcctgctactctggctcccagattccactggagaaatagtgatgacgcagtctccagccaccctgtctgtgtctccaggggacagagccaccctctcctgcacgggccagtcagagtattagcggnaacttgaccttggtaccagcagaaactggccaagggtcccaggctcctacactccacggtgccatccacgacggccactaggaacttccacgccaaggttcaaggtcggactagggtcgggtcgtagggaacctaggtacctttcgtcctacgtccaccatcgtagcacgtccgtagcgtagtcctagtaccgttaacgttttgtaccttagttttaactttacgttgtacctagtactaagttaacgtaaaacgtcggtaccgtaacgttaggttttacggaccgaacgggtaacgaacggtacgtacggtactacgttacgacggtaaccgttaacggttacggttacggtccgttacgaccgtaacccgttacgttacgttaccgttactttacccg

SEQ ID NO: 11153 - DNA, 614 bp, Homo sapiens
  misc_feature: GYAE6OF02IFWM3.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagcccaccctgtctgtgtctccgaggggacagagcccaccctctcctgcagggccagtcagagtattagcggcaacttagcctggtaccagcaagaacctggccagggtcccaggctcctcatcccgacggtgccactccaccgacgggccacgtggtaactccacgcctaggttcaggtggccaggtcgggtcgtcgggacagtaccgttctctctaccaccatcagcacgtcctcgcacgttcgttacggacgttacgttttcgacttagttttaactttactgtacaagtactaaagtaaacttaaaacgtcggtaccgtacgtttaacggttttcggaccgaacgggaacctaacggtacgtaggacctacgtacgaaggtaaccgtaacgtcggtacggacgtcggacctaaccgttacgtaccttcgttacgttacccg

SEQ ID NO: 11154 - DNA, 586 bp, Homo sapiens
  misc_feature: GYAE6OF02HATVH.25.15.B04.1.454.CMB.1.raw
  modified_base (301)..(301): a, c, t, g, unknown or other
  misc_feature (301)..(301): n is a, c, g, or t
  modified_base (311)..(311): a, c, t, g, unknown or other
  misc_feature (311)..(311): n is a, c, g, or t
  modified_base (358)..(358): a, c, t, g, unknown or other
  misc_feature (358)..(358): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattaggcggacaacttagcctggtaccagcagaaacctggccgaggtcccaggctcctcactccacggtcncatccaccgngggccacgtggaacttccgagtccaggttcaggtggcaggtgggtcngggacagtcttctctcacaccatcacgcacgcctgctagtctagacgttattttcgacttagtttacttacttgtacagtactaagttaactaaaacgtcggtaccgttacgttacggttttacggaccgtaacgggtaaccgtaacgtcgtacggtacgtacgtacgaacggaaccgtaacgtggtacggtcgtacgaccgtaccgtacgtcgttacgtccttaccg

SEQ ID NO: 11155 - DNA, 734 bp, Homo sapiens
  misc_feature: GYAE6OF02I53K4.25.15.B04.1.454.CMB.1.raw
  modified_base (203)..(203): a, c, t, g, unknown or other
  misc_feature (203)..(203): n is a, c, g, or t
tcagactgtacagtcacgaccggtgctcgatttagacagtatatagttccggcggggaggaactgctcagttagggacccagacggaaccatggaagcccagcgcagcttctcttcctcctgtctactctggctccagattccactggagaatagtgatgacgcagtctccagccacctgtctgtgtctccgagggacagacnccacctctcctgcaggccagtcagagttattacgcggactaacgttacgaccgttaggtaccagtacaacgtaaaccgtcggaccgtacgggtaccccaggtacctccgtacacgttcccgacggtcactactcccaacgacggtccacggtaggtaaccttccgacgtccgtacggttcacggtcggacgtaggttcggtcgtacggggactacggttacttacctcgttactccaaccctagtccgacgtaccgacgtcccgtgacctacggttccgtagtaaccgttgttttacgacgttttaagtttacgtacgttacgttagtacgttacgttaaacggttaaactaaaccggtcggttaaccctttaacgtttacgggttttaccggaaccggtaaacggggtaacctaacgggttcgtaaccggtacgtaacggtaaccggtaaacggtaaccgtaacgttaccgggtacggtaacgtacggtaaccgttacccgtagttcccgtttaccgttaccttaacccg

SEQ ID NO: 11156 - DNA, 759 bp, Homo sapiens
  misc_feature: GYAE6OF02G335V.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcgagggccagtcagagtattagcggcaacttcgcctggtaccagcaagaacctggccacgggtcccaggcctcctcacgtcccgacggtcgccacgtcccacccggacgggacccctacggtacgggtaaccttcccgacggtacccgaagggtttccgaggttcggaccgtagggttggggttaccggtagggggaaccctacggtaccctttccgttaccgtcccgtaccgtacccgtactccgaacgccgtaccggtcccgtacgtccgtacggttaccgttacggtaacggtttacgtttttcgaccgtttaagttttaacgtttactcgttacctaacgttagtttaaacttaacgttaaccgttccggtacccgttcgggttaaccgggttacggtttaccggaaccggttaaacgggaaaccgtaacggggttaaggaaccggaacgtaaaccgggtaaacttcgggtacggtaccgtacgaccgttaaccggttacccgttacgttaccggtttccttacgttcctttacccccg

SEQ ID NO: 11157 - DNA, 661 bp, Homo sapiens
  misc_feature: GYAE6OF02ICPB9.25.15.B04.1.454.CMB.1.raw
  modified_base (198)..(198): a, c, t, g, unknown or other
  misc_feature (198)..(198): n is a, c, g, or t
  modified_base (216)..(216): a, c, t, g, unknown or other
  misc_feature (216)..(216): n is a, c, g, or t
  modified_base (602)..(602): a, c, t, g, unknown or other
  misc_feature (602)..(602): n is a, c, g, or t
  modified_base (610)..(610): a, c, t, g, unknown or other
  misc_feature (610)..(610): n is a, c, g, or t
tcagactgtacagtcacgaccggtgctcgatttagacagtatatatccgcgggaggaacgtgctcagttaggaccacgacggaaccatggaagcccacgcgcagcttctcttcctcctgctactctggctccagattccactgagaaatagtgatgacgcagtctcagccaccctgtcagtgtctaccgaggggacanagtcccaccctctctcgngacgggccagtcagagtattaggcggactaaacttgccgtgtaccagctagaaaccgtggccgtacggtcccgacggatcccctcgtaacgtcccgtaacgggtcgtccaaacgttccccaaaccggtaacgggccctaaccgttacggggaactttaccccgaggaaccccgtagggttacaacggtacggtccgtaaggtcggggttcgtacggggaactacggactttccgtccttcgtacccacgtaactccgagtacgtacgtacctcggacgtacgtctacgtacgttacgtttgtactacgtttaattaccgtagtcgtagtacaagttaaataaaccgtacggtacgtacgtagtttacggcgtaacgggacgaacgngtacgganacgtacgaagtaacgacgtgtacgtgtacgcgactatcgttacgtcgttac

SEQ ID NO: 11158 - DNA, 631 bp, Homo sapiens
  misc_feature: GYAE6OF02H4OTO.25.15.B04.1.454.CMB.1.raw
tcagactgtacagtcacgaccggtgctcgatttagacagtatatatccgcgggggaggaactgctcagttaggacccagacggaaccatggaagccccagcgcagcttctcttcctcctgctactctggctcccagattccactggagaaatagtgatgacgcagtctccagccaccctgtctgtgtctccgaggggacaggacgcccaccctctcctgcacgggccagtcagtagtattagcggactaacttgcctggtaccagacagaacctggccagggtcccaggctcctcactcccgacggtgcactcccaccgacggccaacgtcggaacttccagccctagggttcaggtcggctaggtgggtcgtgggacgtagtacgttctctactccacctactcacgcacgtcctgctacgtctagtacgttatttcgacttagttttactttacgtcgttaccgtaacgtacgtaaacgttaaacgttaaaaacgttcgggtacccgttaacgttacgggtttacggaccggtaacggggaaccgtaacgtacgtagacgtacgtacgtacggaaccggtacgtcggtacggtcgtacgaccgaccgtacttcgttcgttaccttaccg

SEQ ID NO: 11159 - DNA, 612 bp, Homo sapiens
  misc_feature: GYAE6OF02G352B.25.15.B04.1.454.CMB.1.raw
  modified_base (303)..(303): a, c, t, g, unknown or other
  misc_feature (303)..(303): n is a, c, g, or t
  modified_base (378)..(378): a, c, t, g, unknown or other
  misc_feature (378)..(378): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcagggccagtcagagtatagcggcaacttagcctggtaccagcagaacctggaccagggtccccaggcctcctcactccgacggtcncactccaccgacgggccagtggaacttccagcctaggttcaggtcgcaggtcggtcgtgggacagtactctctcncacctatcacgcacgctcgctacgtcgtacgtacgttattttcgacttagttttaactacgttcgtctaacgtacgtaaagttaaactaaaacgttccggtaaccgtacgtttaaggtttccgggaccgtaacggggtaaccaagggtccgtacgggtactaacggtaccgaaggtaaccgtaacgtcggtacggtacgtacgtactaccgtacttccgttacgttccttaccg

SEQ ID NO: 11160 - DNA, 526 bp, Homo sapiens
  misc_feature: GYAE6OF02FJ5FZ.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagagccaccctctcctgcagggccagtcagagtattagcggcaacttagcctggtaccagcagaaacctggccagggtcccaggctcctcatccacggtgcatccacagggccactggaattccagccaggttcagtggcaggtgggtctggggacagacttctctctcacctatcagaagcctgcagtctgacgtagtttgctagtttattactgttacacgactagtaataaaacgtggtaccgttactacggttttggaccgtaggggaccaagcgtagactatacagtacgactaggtcgcgtagaccacctagtctgtctctac

SEQ ID NO: 11161 - DNA, 711 bp, Homo sapiens
  misc_feature: GYAE6OF02JWZ1P.25.15.B04.1.454.CMB.1.raw
  modified_base (434)..(434): a, c, t, g, unknown or other
  misc_feature (434)..(434): n is a, c, g, or t
  modified_base (453)..(453): a, c, t, g, unknown or other
  misc_feature (453)..(453): n is a, c, g, or t
  modified_base (471)..(471): a, c, t, g, unknown or other
  misc_feature (471)..(471): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtcctgtcgtcctaccgaggggacaggacgcccacccgtctcctgaccgacggggcccagggtccaaggacgttaagttacggccgggtactaacgttagcccgtaggtacccaaggcaaggtaaaccctgggacccgtaaggggtcccccaagggtcctccctacacgttcccgacggtggccaactcccaaccgtacgggcccctagtccgggaattccgaagccgagttccgaggtgccgtagtcgggttacngggacacggtacttcgacncgtaccaccgtatcgaancgacgcgtgacacgtctcggtacctaggtttcacgttagtttacttaccgtgtaccgtagtacgtacgttaaagttaaaaccgtgtaccggttaacgttacggttttacggaccggtaacgggtaacccgtaacggtaccggtaggaccgtacggttaccggaacggtaccggttaaacgtacggtaccggttacgtaccggtaccgtaccgtaacgttaccgggttctaccgtttaccg

SEQ ID NO: 11162 - DNA, 779 bp, Homo sapiens
  misc_feature: GYAE6OF02FX9ZY.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccaggggacagacgccaccctctcctgcagggccagtcagagtattagcggacaacttagcctggtaccaacagaaacctggaccagggtccccaggcctccgtcatcccacggtgccactcccaccgacggggcccaacgtcgggaaacttcccgacggcccgtaagggtttccaagggttcggggacctagggttcgggggttacgtggggaacctaggtaaccttttccgtaccttccgttaccaaccccgtattcccgaacgtccgaacggtccccgttgtacccgaaggttccgttacggtaaaccgtttagtttttacgggccctttaaaggtttttaacttacgttcggttaccaaggtcctaaggtttaaacttaaacgtttaaccgtaccgggttccctttacccggggttacgggttaaccgggtttttcggggaaacccgtaaacgggggtaaccctaaaagggggttacggaaaacggtaccgaaaaaccggttaacggttacggtacgggtaaccgttaccggaccctaaccgtaacggttcccgtttaggtaccctttacgacccgttttaccccgg

SEQ ID NO: 11163 - DNA, 714 bp, Homo sapiens
  misc_feature: GYAE6OF02I55XU.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatgtgatgacgcagtctccagcccaccctgtctgtgtctccgagggacaggacgcccaccctctccgtgccgagggcccagtccagtacgtattaggccggacaacgttcgccgttaggaccagcaacgaaacctggaccgacgggtccccaggtcccttcctcactcccggacgggttcacgacctacccgaccgacgggtccctagtacggaaccttcccgacggtccgtaagggttcaggttcggacgtagggttgggtaccgtagggacaggttacctttcgtcctacgtaccacctaagtccgacgtaccgtaccgtccgtaacggtacctacggttccgttacgggtacctttaagttttccgaacgttttaaggttttaactttccgtcgttaacgtacgtactaaagttaaaacgttaaacggttcggtaaccgtttagtttacggttacggaccggttaacggggacttaacggtacgttacgacgtttacgacgaacggttaacctagtcggttacgacgtcaccgttaacgtcgttaccgttcgttacttaccg

SEQ ID NO: 11164 - DNA, 721 bp, Homo sapiens
  misc_feature: GYAE6OF02I7JKS.25.15.B04.1.454.CMB.1.raw
  modified_base (231)..(231): a, c, t, g, unknown or other
  misc_feature (231)..(231): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggcctcccagattccactggagaaatagtgatgacgcagtctccagcccaccctgtctgtgtctccaggggacagcgccaccctctcctgcaggccagtcagatntagcggcaacttgcctggtaccagcacgaaacctggcctacgggtcccaggtcctcctactactcccgacgggtgcctactacccgaccgagggccccaagtcggtaacttccgacgcccgtaggttcaggttcggcgtaggtgggtaccgtaggggtaccaggtaccctttctccgttaccgttacccaaaccctgttccgacgtaccgacgtcccgtcgactacggttacctacggtaaccgtttacgtttacgtaccgtttagttttaaacgtttacgtttacgttaccgtaacgttaccgtaaacggttaaaacgttaaaaccggtaccgtaccgtaaccgtaaccgttaacgggttttaccggaccggtaaacgggtaacccgtaacggtaccggtacggtactaaccgtcgaaaccggtaccggtaaccgtacggtacggtaccgtcggtacccgtaaccgttcttaccggttccgttaacccg

SEQ ID NO: 11165 - DNA, 791 bp, Homo sapiens
  misc_feature: GYAE6OF02HL4NI.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtcctcagggacagacgccaccctctacctgcgacgggccagtcagacgtattacgcggtacaaaccgttagcctagggtaacccaggaccaaggaaaaccctcggacccgtaacgggtaccccagggtcctccgtaccgaactaccccgaacgggttcgaccgtaacctacccgaacccgaacggggccctaacgtagggtaacctttcccgacggaccccgtaagggtttaccaaggtcggacccgtagggttcggggtacgtacggggaacccaaggtaccgtttctacccgtttacctaaccgaaacccgtagttacaaccggtaccgaaccgtacccgtacggtccgtaaacgttaccggttacggtaacggtttacgttttacgtacgttaacgttttaacgtttaccgttacgttaccgtacggtaacttaaacgttaaacgttaaaaaccggttccgggttaacccgttaacgttacgggttttacggaccgtaacggggtaacctaaacggtcgtacgacgtacgtaacgaacggaacgtaaccgtgtacggtacgtaccgaacgtaaccgtacgttacgttacgttaccgttaaccg

SEQ ID NO: 11166 - DNA, 872 bp, Homo sapiens
  misc_feature: GYAE6OF02GZS8V.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctccagattccactggagaaatagtgatgacgcagtctccagccaccctgtctgtgtctccgagggacagacgccaccctctcctgcgacgggccagtcaagagtagttacggcggtactaaacgttcgccgttacggtaaccacggaccaaacggaaaaccccgttgggacccgtaaccggggttccccgaacgggtcccttaccgtacctaacgttccccgaacgggttcgaccaccttacccgaaccgtaccgggaccctaccggttacgggtaaacctttcccgaaccggtcccgtaacgggttaccgaagggttccggtacggttacggggttcggggtaccggttacggggaacccgtaagggttaccggtttaccaaccggtttccctaccgtaaacccgtaagtttcccggaacggtaccggtaaccggtttaccggtacgggtaaccggttaccgttaacggtaaacgtttacggtttacggtaccgtttaagttttaacgtttaccgttacggttaccgttaacggtccgtaacggtaccggttacggtaccggttacgggtttaccgggttacccgggttaaccggggtttaaccgttaccggggtttttccgggaaccggtaaccggggtaccgtaagggtaccggttaacgggtaacgtaacgtaacccggtaaacgttaacgtacgggttcggtacgtacggtccgtaaccgtcgttaccgtcttaaccg

SEQ ID NO: 11167 - DNA, 233 bp, Homo sapiens
  misc_feature: GYAE6OF02F024G.25.15.B04.1.454.CMB.1.raw
  modified_base (224)..(233): a, c, t, g, unknown or other
  misc_feature (224)..(233): n is a, c, g, or t
tcagactgtacagtcacgaccggtgctcgatttagacagtatatatccgcggggtggaggctgaggatgttggggtttattactgcatgcaaggcacacactggcctttcgcttttgggccctgggacgagagtggatatcatacgaactgtggctgcaccatctgtcttcatcttcccgccatctgaactgtacagtctgagcgggctggcaaggcgcatagnnnnnnnnnn

SEQ ID NO: 11168 - DNA, 689 bp, Homo sapiens
  misc_feature: GYAE6OF02JIOCC.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgaggggacagacgccaccctctcctgcgagggccagtcagacgtattagcggacaacgttagccttaggtaccaaacgacgtaaaccgtgggacccaacggggtccccagggccttcccgtacaacgtcccgtacgggtgacctacgtcccaccgacgggcccacgtcggaacttccgagccgtaggttcagtggctagggtcgggtcgtacgggactacggtactttcgtactcctaccaaccgtactacgaacggtccacggtacccgtcgtccgtaacgtcgttacgtacgttagtttcggtacttaagtttacgttacgttcgttactacgtacgtaacgttaaacgttaaaacgtcggtaacgttacggttacggttttacggaccggtacgggtaaccacggttacgtacggtactacgtacgaacggtaacgtacgttggtacgtaccgtacgaccgtaccgtacgttaccgttcggttcttaccgttaccg

SEQ ID NO: 11169 - DNA, 689 bp, Homo sapiens
  misc_feature: GYAE6OF02GILTB.25.15.B04.1.454.CMB.1.raw
  modified_base (252)..(252): a, c, t, g, unknown or other
  misc_feature (252)..(252): n is a, c, g, or t
  modified_base (298)..(298): a, c, t, g, unknown or other
  misc_feature (298)..(298): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccacctgtctgtgtctccgagggacagagcccaccctctcctgcgacgggccagtcagagtatagcgcaatcgctgtaccngacagaacctggccacgggtcccaggcctcctacactccgacggtncactcccacgacggccagtagtaacttccgagtaccgtacggttacaggttcggacgtaggggttcggggtacgtacgggaacaggttaccttcgtttacccgtccgtacctacccaaacgttccgaacgtaccgaaccggtcccgtcggacgtacgttaccgtacgttaaccggtttacgttttaccgacgttttaaggtttactttaacgttcgttaccgtaacgtacttaaagtaaactttaaaacggtcggtaacccgttaacgtttacggtttaccgggaacggtaaccgggtaacgtaacgtacggtacgacgtacgtaacggtaacgaaggttaacgtcggtacggtactacggtacctacgtacttccgttacgttcttaccg

SEQ ID NO: 11170 - DNA, 783 bp, Homo sapiens
  misc_feature: GYAE6OF02G0S7O.25.15.B04.1.454.CMB.1.raw
  modified_base (428)..(428): a, c, t, g, unknown or other
  misc_feature (428)..(428): n is a, c, g, or t
tcagactgtacagtcacgaccggtgctcgatttagacagtatatatccgcggggaggaactgctccacgttaggacccagacggaaccatggaagccccagcgcagcttctcttcctcctgctactctggcctcccgagtattcccagtggagtaaagttagttgatgacgtcgtagtcctccagtcccaccgtgtctgtcgtctccggaggggacaggacgcctaccctctccgtggcggacggccagtcagtagtagttcggcgtactaaccgttcgcgttcggtaccagaccaacggtaaccttcggaccggacggtcccacggtcctcccgtacgtaccgcccgaccggttcgcctaaccggacccgaccggacgggtacccctagtttacggaaaccgttccgaacggtaccgtaaggttacngggttacggacgtagggttcgggtcgtaggactacgtacctttcgttaccctctacctaaccgtcgtaaccgtacgtaccgaccgtccgttacgtacccgtaccggttacgtaccggttacgtttacgtttacgttacgtttacgttttaacgttacgttacggttacctaacggtaacgttaaacggttaaagtaaaaccgggttccggttaaccggttacgtttacggggttaaccggtaccgggtaaccgggtaaccgaacgttaccgttagaccttacggttaacggaacggtaacggtaggtggaccggtagtaccgtacgtaccgttaggttaccgttcgaccgttccg

SEQ ID NO: 11171 - DNA, 797 bp, Homo sapiens
  misc_feature: GYAE6OF02HNM1V.25.15.B04.1.454.CMB.1.raw
tcagactgtacagtcacgaccggtgctcgatttagacagtatatatccgcgggggaggaactgctcagttaggacccagacggaaccatggaagccccagcgcagcttctcttcctcctgctactctggctcccagattccactggagaaatagtgatgacgcagtctccagccacctgtctgtgtctccgaggggacagacgccaccctctcctgcgagggccagtcaagagtattagcggctaacttagcctggtaccagaccaagaaaaccgtcgggaccgacggggttccccaacgggcctaccccgtacacttcccgaacgggttcaccaactcccgaaccgacgggcccaacgtaggaacttccgacggtccgtaaggggtttccagggttcggccgtaggggttcgggggtacgtaggggacaacggttacctttccttaccgttaccctaccaacccgtaagttacccgaacggccgtacggtcccgttaggccctaacggtttccgttacggtaaccggtttagttttcggtaccgtttagttttaacgttttaccgttacggttaccgaacgtacgttaaacgttaaacttaaaaaccggttcgggtacccggtttaacgttacgggttttaccgggaccggtaaacggggggtaaaccctaacgggtaccgtaacgggaccgttaacggtaacccgtaacgggtaaaccggttacggtaacgggtttacggaccggtttacgaaccgtacccgttaaccgtaccgtttacggttacctttaacccg

SEQ ID NO: 11172 - DNA, 718 bp, Homo sapiens
  misc_feature: GYAE6OF02G9085.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccacctgtctgtgtctccgaggggacaggacgcccacccttctcctgccgaggccagtcaggactattacgcggactaagttacgccgtggtaaccagacaacgaaaccgtcggaccgacgggtcccaggcctccgtcacgtccgacggtcgccactacccgacgacggccacgtaggaacttccgagccgtaggtcaggtcggacaggttcgggtacgtaggggactaacggtaccgtttacttccgtaccttaccgaccgtaacgttaccgacggtaccgtcgtcccgttaaggacttcggtaccttggtaacggtttagtttcgtacgtttaagttttaacgttacgttcggtacgtaaacgtcgttaaacggtaaacgtaaaccgttacgggtacccgtttaaggttacggttttaccggaaccgggttaaccggggaaacctaccggtacggttacggtacctacggacgaacggtaaccggacggttcggtacggtacccgtcgaaccgtccgttaacgtcggttaccgttccttacccgg

SEQ ID NO: 11173 - DNA, 776 bp, Homo sapiens
  misc_feature: GYAE6OF02GUFK0.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtctgtgtctccgagggacagacgccacctctcctgcacgggccagtcagagtattagcggcaacttgcctggtaccagcaagaaccgtgccgagggtccccaggcctcctcactcccgacggtgcacgtcccaccgacggccacgtcgaacttcccgacgtccgtacggttcaggttcggacgagggttcggggtaccgtggggactaacggttcctttaccgtccttcctacccgtaacctacgttaccgaccgaccgtaccggtacccgttcggaccgtacggttcccgttacggtacgtttaacggttttttccgaccggttttagtttttaaccgttacggtttccgttaacgtacggtaaaccgtttaaagttaaaaaccgttaaaaaccggttcgggttaaccccggtttaacggtttaaaccgggttttaccggggtaaccccggtaacggggggttaaaccctaaaccgggtacggttaaccgggaccttaacggttaccggaaacggttaaccggtaacggttacgggttaccggtacggttacgtacccgtaccttaaccgtcggtttcccgttacctttaacccgg

SEQ ID NO: 11174 - DNA, 703 bp, Homo sapiens
  misc_feature: GYAE6OF02H40RX.25.15.B04.1.454.CMB.1.raw
  modified_base (219)..(219): a, c, t, g, unknown or other
  misc_feature (219)..(219): n is a, c, g, or t
tcagactgtacagtcacgaccggtgctcgatttagacagtatatatccgcgggggaggaactgctcagttaggacccagacggaaccatggaagccccagcgcagcttctcttcctcctgctactctggcctccagaattccactggaagtaaatagtgatgacgacagtctccacgccacctgtctgtcgtcctccgagggacaggacgcccaccctntcctgcgacgggccagtcaaggtagttacgttacgcggactaacgttacgcctaggtaccaggacaacgaaccgtggaccgacgggtcccaggtccttctacgactcccgaggtcgacctactacccgacgacggacctacgtaacggtactccgagtaccgtaggttacgaggttcggacgtagggtcgggtccgtacgggaactacggttaccttcccttacgtcctaccgacctacgtacccgagtctacgtacctcggacttacggtcgtacggtacgttagtttacgagtttaacgtttacgttaccgttgtaccgtagtaactaaggttaacgttaaacgtcggtaaccgttagtttacggttacggaccgtacggtacgtaacgtcgtacgtacgtaccgtacgtaacggaaccgttaggtaacggtcgtacttaccggaccttaaccggttacttcgttaccggtttacctaaccg

SEQ ID NO: 11175 - DNA, 633 bp, Homo sapiens
  misc_feature: GYAE6OF02IUXUW.25.15.B04.1.454.CMB.1.raw
  modified_base (161)..(161): a, c, t, g, unknown or other
  misc_feature (161)..(161): n is a, c, g, or t
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
  modified_base (479)..(479): a, c, t, g, unknown or other
  misc_feature (479)..(479): n is a, c, g, or t
tcagactgtacagtcacgaccggtgctcgatttagacagtatatatccggcggggaggaactgctcagttaggacccagacggaaccatggaagccccagcgcagcttctcttcctcctgctactctggctccagattccatggagaaatagtgatgacgnagtctcagccaccctgtctgtgtctcagggacngacgccacctnctgcagggccagtcagtagtattagcggacaacttcgcctaggtacaggtacaacgtaaacctggaccgagggtcccaggactccgtactaactccgacggttgaccacgtacccgaccgaagggtccacgttacggaaactttccgaaggtcccgtaaggttccgaaaggttcggaccaggtttacggggtacgttaggggaactacggtaaacctttccgtacttaccgaccgtaacctacgtttacgacgtacaccggtctacgctacgtntacgagtactttagacgttactttaacgtatcgtactacgtataacgttaactaaaacgtggtaccgtaagttacggttttacgaccgtaacgggactaaacgtctaggacatacgagtaacgacgtagtcgacgtgccagtatctgtactacg

SEQ ID NO: 11176 - DNA, 735 bp, Homo sapiens
  misc_feature: GYAE6OF02IL2ZP.25.15.B04.1.454.CMB.1.raw
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagcccaccctgtctgtgtctccgaggggacagacgccaccctctcctgcagggccagtcagacgtattacggccggactaacttagcccgttcggtaaccaagtccgaacgtaaacccgttcgggacccgtacgggggtaccccaagggtccctccctaccgtacgtcccgaacgggttcgctaaccgtccccgaaccgacggggccctaaccgtcgggtaaacctttcccgacggtaccccgtaagggtttccgacgggtggtacgtaagggttcgggtacgttacggggaacgtacggtaactttccgtaccgttcctaccaacccgtatccgaacggtcctacgtcccttgacgtacgtccgtacggtacgttagtttcgacgtttacgtttaacttacgttgtaccgtagtacgtaaacgttaaagtaaacgttcggtaccgtttaacgttaggtttccgggaaccgtacgggacctaaaggccgtacggactacgtacggtaagaaccgtagttggacggtaccttacgacctaccgtacgttcttacgttaccttacccg

SEQ ID NO: 11177 - DNA, 824 bp, Homo sapiens
  misc_feature: GYAE6OF02JS4SS.25.15.B04.1.454.CMB.1.raw
  modified_base (217)..(217): a, c, t, g, unknown or other
  misc_feature (217)..(217): n is a, c, g, or t
tcagactgtacagtcacgaccggtgctcgatttagacagtatatatccgcggggaggaactgctcagttaggacccagacggaaccagtggaagccccagcgcagcttctcttcctcctgctactctggcctccagattccacgtggagtaaatagtgatgacgcagtctccagccacctgtctgtgtctccgagggacaggcaccaccttctccgngccagggtccagtccgagtacgtattaggccggtactaacgttacgcctcgggttaccacggcaacggtaaaccgtcgggccgaacgggtcccgaacgggcccttcctacgaccgttcccgaacgggtgacctacgtacccgaccggacgggtaccctaccgtagggaacctttccgacggtaccgtagggtttaccgaggtacggaccgtaggttacgggacggttacggggtactaaacgggttccgtttaaccgttccgtaccttaccggtaaccttacgtacccgttaagcccgacgtacccgttcggaccgtcgttaccgtacggtacgggttacttttaacgacgttaacggttttaacgttaccgttcgttaaaccggtcgtaacccgtaaacggtttaaaaccgttaaaacggtttaccggggtaacccgtttaaacgggtttacgggtttacccggaacccggggttacgggttaaacccgtaacgggttaccgtaagggtacctacggttaacggacggtttaaacccggagtaccgggttacggaaccgtttgggaaccctaacggtccctttacgttacggttacccgttaccgg

SEQ ID NO: 11178 - DNA, 667 bp, Homo sapiens
  misc_feature: GYAE6OF02FJ7GJ.25.15.B04.1.454.CMB.1.raw
  modified_base (532)..(532): a, c, t, g, unknown or other
  misc_feature (532)..(532): n is a, c, g, or t
tcagactgtacagtcacgaccggtgctcgatttagacagtatatatccggcggggaggaactgctcagttaggacccagacggaaccatggaacgccccagcgcagcttctcttcctcctgctactctggcctcccagacttccactggaagaaatgtgatgacgcagtctccagcccaccctgtcctgtcgtctaccggagggacagacgcccaccctctcctcgacacgggccagtcaggtagtagttacggcggactaacgtttcgccgtcgggtaccagacaacggaaacctcgggaccacggggtccccaacgggccttcccgtctactacccgtacggtacaccactcccgaaccgacggggtcccacgtacggtaacttccgacgtccgtaggttcaggtcggcgtacgggtgggttccgtaggggacagtaccttcgtcttaccgtcaccctatcgacgcctacgccgtcgcgtacgtcgttacgtacgttagtttcgactttagtttacttacgttcgttacngtactaagttaaacgtaaacgtacgtaccgtagttacggtttcgaccggtaggacctagggtaccacggtactacgtacgaacggtaacgtacgttcggtcgcgtacgaccgtcgtacgtcttacgtctttaccg

SEQ ID NO: 11179 - DNA, 706 bp, Homo sapiens
  misc_feature: GYAE6OF02IWEM0.25.15.B04.1.454.CMB.1.raw
  modified_base (230)..(230): a, c, t, g, unknown or other
  misc_feature (230)..(230): n is a, c, g, or t
  modified_base (317)..(317): a, c, t, g, unknown or other
  misc_feature (317)..(317): n is a, c, g, or t
  modified_base (325)..(325): a, c, t, g, unknown or other
  misc_feature (325)..(325): n is a, c, g, or t
  modified_base (501)..(501): a, c, t, g, unknown or other
  misc_feature (501)..(501): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggcctcccagattccacgtggaagaaatagtgatgacgcagtcctcacgcccaccctgtctgtgtctcgagggacagacgccaccctctccgtgcgacgggccngtacgagtagtagttaggacgtactaacttcgccgtaggtaccagacgaacgaaccgtcggaccgacggtcccgacgtcctcctacncgtaccgnggtccgctaccgccgaccggaccggtcctacggtacggtaactccgacggtaccgtacggttcgaggtcgacggtacgggttcggtcggacgggtacgtacgttaccttcccgtactaccgtaccaaccgtacgccgtaacgcccgtacgccgtcgacgtgttccgtagtacgttntttagacgtttaagtttacttcgtacgtacgtaacgtagaaacttaaaacgttaacggttcggaaccctttaacggttccggttaaccgggaaccgggtaaccgggaaatccggtaacgtaccggataacggtaccgtaacggtaaccgtagtcggtacgacccttacggactttaaccccgtgtttcgtaccgttccttaaccg

SEQ ID NO: 11180 - DNA, 743 bp, Homo sapiens
  misc_feature: GYAE6OF02G6SCA.25.15.B04.1.454.CMB.1.raw
  modified_base (172)..(172): a, c, t, g, unknown or other
  misc_feature (172)..(172): n is a, c, g, or t
  modified_base (505)..(505): a, c, t, g, unknown or other
  misc_feature (505)..(505): n is a, c, g, or t
  modified_base (719)..(719): a, c, t, g, unknown or other
  misc_feature (719)..(719): n is a, c, g, or t
tcagactgtacagtcacgaccggtgctcgatttagacagtatatatccgcggggaggaactgctcagttagggacccagacggaaccatggaacgccccagcgcagcttctcttcctcctgactactcgtggcctcccagattccactggagaaatgtgatgacgcagttcnccagcccaccctggtcctagtcgtctaccgagggggacagaacgtcccaccctcctctgcagggtccaatcaagtctaattacgccggactaacttacgccttaggtacccaggacctaaacggaaaacccgttgggaccccgtaacggggtccccaagggtcctccccgtaacacttaccccggacggggtcacccgtactaccccgaccggaacgggtacccacggtaagggtaaccttcccgacggacccgtagggttaccaggtttcggacgacggggttggttaccccgtagggacgtaagttcccgttgtccctcttcccgaacctnttacgacgacacgccctagacgtagttcgaccgtaggttaactttcgacctttaggtttaacttagcgttactaagcccgtaaagttaaacaaaaccggtcggttaccgtaacgggtttccgttaacggaaccgggaacggttaaaccgaacgtccgttaagggacctaagttaccgaaaccggtaacgtggtaagtaccgtacggtcgaaccncgttaacggtctacttactacccg

SEQ ID NO: 11181 - DNA, 688 bp, Homo sapiens
  misc_feature: GYAE6OF02G7EAZ.25.15.B04.1.454.CMB.1.raw
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
tcagactgtacagtcacgaccggtgctcgatttagacagtatatatccgcggggaggaactgctcagttaggacccagacggaaccatggaagccccagcgcagcttctcttcctcctgctactctggctcccagattccactggagaaatagtgatgacgcagtctccagccaccctgtcctgtgtctccgaggggacagacgccacccttctcctgaccaggggccctagtccagagtattagcggcaacttagcctggtaaccaacgagaaacctggccagggtcccaggcctcctcatccacggtncactccaccagggccactggaacttccngccaggttcaggtcggctaggtgggtacgtacgggacctaggacctttctcgttcctaccaaccgtattccgaagcccgtacgcccgttcgacgtacgttcgtacggtacgttacgttttgacgttacggttttactttacgttcgttacgtacgtaccgtaacgtttaaagttaaaaaccgtcggtaaccgtttaacgtacggttttcggtacccgtaacggggtaaccgtaaaggtaccgttaacgggtaccgtacggtaactaacgggtaaccgtaaaccgttagggttacggtaccgtacggtaccaaccggttactacccggtttagttcccgtttacttaaccg

SEQ ID NO: 11182 - DNA, 504 bp, Homo sapiens
  misc_feature: GYAE6OF01DCLO5.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtgggtccccccaaggttcagtggcagtggatctgagacagatttcagtcttactatcagcaatctgcaacctgaagtattttgcgtacttactactgcctacagacttacgacttcccgtggtaccgttcggcctaaagggaccaaggtggaaatcaaacgactgtggctgcacatctgtcttcatcctcccgctac

SEQ ID NO: 11183 - DNA, 511 bp, Homo sapiens
  misc_feature: GYAE6OF01DGZ2I.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagtggtatcagcagaaaccagggaaagcccctagactcctgatctatactgcgtccactttgcaaggtcgggtcccccaaggttcagtgcagtggatctgagacagatttcagttcttactatcagcaatctgcaacctgaagattttgcgtacttactactgacctactacgacttacgtacttcccgtaggtaccgtttcggaccgaagggaccaaggtggaaatcgaaacgactgtggctgcaccatctgtcttcattcctcccgctac

SEQ ID NO: 11184 - DNA, 598 bp, Homo sapiens
  misc_feature: GYAE6OF01CHKIL.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatccctccctgtctgcatccggtagggacagagtcaccatcgcttgccgggcaagtcagcccatcgaccaatcatttaagttggtatcagcaagaaaccagggaaagcccctagactcctgatctatactgcgtccactttgactaagggtcgggtacccccaaggttccagtcggcaggtgatcgtgagacagtattacagttcttactatcagcaatctgacaactagaagtatttcgacgtacttactactagccctacgacgtacttacgacttcccggtacggtaccgtttaccggaccgtaaacgggtaccgtaaaggtacggaaaactaccgaaaacgtacgttacgggtacggtaccgtaggacccaaccgttagttacccgttacgtttaccttaccttaaccttcccttaccccggccttaaccg

SEQ ID NO: 11185 - DNA, 515 bp, Homo sapiens
  misc_feature: GYAE6OF01BDJX0.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtcgggtcccccaaggttcagtggcagtggatctgagacagatttcagtcttactatcagcaatctgacaacctgaagtattttagcgtacttactactgcctacagtacttacgactttcccgtggtacgttcggaccgaagggaccaagggtagaaatacgaaacgtaactggtggctgacaccatctgtcttcatctcccgctacg

SEQ ID NO: 11186 - DNA, 504 bp, Homo sapiens
  misc_feature: GYAE6OF01D65E8.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtcgggtcccccaaggttcagtggcagtggatctgagacagatttcagtcttactatcagcaatctgcaactgaatatttgcgtacttactactgtcctacacgtacttacgacttcccgtggtacgttcggaccaagggaccaaggtacggaaatacgaaacgactgtggctgcaccatctgtctcatctccgctac

SEQ ID NO: 11187 - DNA, 514 bp, Homo sapiens
  misc_feature: GYAE6OF01EPO0D.40.63.F08.1.454.CMB.1.raw
  modified_base (495)..(495): a, c, t, g, unknown or other
  misc_feature (495)..(495): n is a, c, g, or t
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagtggtatcagcagaaaccaggaaagcccctagactctgatctatactgcgtccactttgcaaggtgggtcccccaaggttcagtggcagtggatcgtgagacagatttcagttcttactatcagcaatctgactaacctgaaagtattttgacgtaacttactactcgacctacagtacttaccgacttcccgtggacgtttcgggaccaagggaccaaggtacgaaatcaaacgactgtaggctagcaccatcngtcttcatcttcccgctac

SEQ ID NO: 11188 - DNA, 577 bp, Homo sapiens
  misc_feature: GYAE6OF01CNWTN.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaacgcccctagactcctgactctatactgcgtcctacttttgcgtaacgggtcgggtacccccctaaagggttccgagtcggcaggtggatcgtgagacagacttttcgagtctttactatcacgctaatctacgacaacccgttgtaaacgtattttacgacgttacttaactactcgaccttacgacgtacttaaccgtcttcccgtcggtaccgttccggaccgaacgggaccaagggtagaaactacgaaaccgtaatggtacggtactggacacctatcttcgttcttacattcccttcccgctaacg

SEQ ID NO: 11189 - DNA, 553 bp, Homo sapiens
  misc_feature: GYAE6OF01EYOOV.40.63.F08.1.454.CMB.1.raw
  modified_base (386)..(386): a, c, t, g, unknown or other
  misc_feature (386)..(386): n is a, c, g, or t
  modified_base (406)..(406): a, c, t, g, unknown or other
  misc_feature (406)..(406): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccggcaagtcagcccatgaccaatcatttaagttggtatcagcagaaaccaggaaacgcccctagactcctgatctatactgccgtccactttgcaaggtcgggtcccccaaggttcagtgcagtgatctgagacagtatttcagttctactatcagacaatctagcaactgaaagtntttcgactacttactactcncctaacacgtaacttaccgacgtttcccgtagggtacccgtttcgggaccgtaaacggggacctaaagggtacggaaataccgaaaacgtaccgtaggtacggcctagccacaacttctacgttcttactattcccttcccgctacg

SEQ ID NO: 11190 - DNA, 558 bp, Homo sapiens
  misc_feature: GYAE6OF01B2CPY.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtcgggtcccccaaggttcagtggcagtggatcgtgagactagatttcagtcttactatcagactaatcgtgacaacctgaagtattttgacgtactttactactgaccttacgacgtactttaaccgccttcccggtggaccgttccggaccgaacgggtaccgaacggtaggaaactaccgaaacggactaggtacggcttgacctaccatccgttacgtccttactaactcccgtttccccgcttaccg

SEQ ID NO: 11191 - DNA, 667 bp, Homo sapiens
  misc_feature: GYAE6OF01CXJNM.40.63.F08.1.454.CMB.1.raw
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatccctccctgtctgcatccggtaggggacagagtcaccatcgcttggccgggnaagtcacgcccatcgaccaatctattaagttgtatcagcaagaaaccagggaaacnccctagactcctagactctatactgccgtctactttgacgtaagggtccgggtaccccctaaggtccaggtcggacaggtaggattcgaggagacgtagtactttcacggttacttaactatacgtacgacctaagttctacgaaccgtaaacctaggtaacgttagttttcgacgttaacctttacgtactccgtacctaacgacgtaactttaccgtaacccgtttccggtacggtacccggttaccggggaaccgaaacggggtaaaccgtaaacgggttaacgggaaaaccgtaacgtaaaaccggtaccgttaggtaccggtacgttacgacctaccgtacttccgttcgttacccttacttaaccttcccgttccccgccttaaccgg

SEQ ID NO: 11192 - DNA, 515 bp, Homo sapiens
  misc_feature: GYAE6OF01B1F5O.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactctgatctatactgcgtccactttgcaaggtcggggtcccccaaggttcagtggcagtgatctgagacagatttcagtcttactatcagcaatctgcaacctgaagtatttgcgtacttactactgtctacagtacttacgacttcccgtggaccgttccggaccaagggaccaaggtaggaaactcgaaacgacgtgtaggctagcacactctcgttcttcacttccttcccgctacg

SEQ ID NO: 11193 - DNA, 656 bp, Homo sapiens
  misc_feature: GYAE6OF01EFI7L.40.63.F08.1.454.CMB.1.raw
  modified_base (217)..(217): a, c, t, g, unknown or other
  misc_feature (217)..(217): n is a, c, g, or t
  modified_base (283)..(283): a, c, t, g, unknown or other
  misc_feature (283)..(283): n is a, c, g, or t
  modified_base (310)..(310): a, c, t, g, unknown or other
  misc_feature (310)..(310): n is a, c, g, or t
  modified_base (597)..(597): a, c, t, g, unknown or other
  misc_feature (597)..(597): n is a, c, g, or t
tcagtctagcgactcacgaccggtgctcgatttagcgatcgtataaggggagccagtctcagtcaggacacagcatggacatgagggtccccgctcagctcctggggctcctgctactctggctccgaggtgccacatgtgacatccagatgacccagtctccatcctccctgtctgcatccggtaggggacaggacgtcaccatcgcttgccgggnaacgtcacgcccatcgaacctaatctaagtttaagttggtatcagacaacgaaaccgagggaaacnccctagaccgtcctagactctatacgngtccgtacctactttcgacgtaagggtccgggtaccccctaaggttcaggtcgcgtaggtggattcgtaggaagacgtagtatttcgacgttaccgttaactatacacgtactaactctacgacctaacgtaggaaacgttagttttacgacttaacgttactaaccgtccgtaactaccgtaacgtacctttaaccgtacgttcccggtaggtacccggttggaacccgtaacgggaacgtaacggaaggtaaaccaacgtaaacgtaaccgtgggtaggccgtanaccgtaaccctagttacccgttcgttaccttactacctttccccgttcccgacttaccg

SEQ ID NO: 11194 - DNA, 541 bp, Homo sapiens
  misc_feature: GYAE6OF01BOBNJ.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccggtaggggacagagtcaccatcgcttgccgggcaagtcagcccatgaccaatcatttaagttggtatcagcagaaaccagggaaagcccctagactcctgatctatactgcgtccactttgcaaggtcgggtcccccaaggttcagtggcagtggatctgagacagatttcagttcttatatcagcaatctgactaacctagtaaagtattttgacgtactttactactcgacctacagtacttaccgtacctttcccggtggtaccggttcggaccgtaacgggaaccgaagggtaggaaactacgaaacgtaactggtggctagactacatctgttcttctactccttccgcctacg

SEQ ID NO: 11195 - DNA, 550 bp, Homo sapiens
  misc_feature: GYAE6OF01B5I3B.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtcggggtcccccaaggttcagtggcagtggatctgagacagatttcagtcttactatcagcaatctgcaacctgaagtattttgacgtacttactactgacctacagtacttaccgactttccccgtaggtaccgtttccgggacccgtaacggggacctaagggtaggaaactaccgaaaaccggtactaggtcggctagccacccagtcctggttcttctattcccttccccgcttaaccg

SEQ ID NO: 11196 - DNA, 696 bp, Homo sapiens
  misc_feature: GYAE6OF01BZ8MZ.40.63.F08.1.454.CMB.1.raw
tcagtctagcgactcacgaccggtgctcgatttagcgatcgtataagggggagtcagtctcagtcaggacacagcatggacatgagggtccccgctcagctcctggggctcctgctactctggctccgaggtgccacatgtgacatccagatgacccagtctccatccctccctgtctgcatccggtaggggacaggagtcaccatcgcttggcccgggcaacggtcacgcccatcgaccaatctaatttaagttggtatcagacaagaaaccgaagggaaacgcccctagtacctcctgacttctatacgtcgcgtcctactttcgacgtaacggggtcccggggtacccccgtaagggttccgtaggtcggactacggtggtactccgtagaacggacgtaagtatttacgtacgttactttaactaattaccgagtacctaattaccgtacgaacccgtaaacgtaggtaaacgtttagttttacgaccgtttaacctttaacttaccgtacgtacccttaacgtacgttacctttaaccgtaccgtttcccggttaagggtacccggttacgggacccggtaaggggaacccgtaagggtacggaaaactaccgaaaacgtacgtcggtaggccgttacgacctaccacgttcgttcgttaccttactacctttccgttcccgtcttaacgg

SEQ ID NO: 11197 - DNA, 695 bp, Homo sapiens
  misc_feature: GYAE6OF01C700Z.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccggtaggggacagagtcaccatcgcttcgccgggcaagtcacgcccatcgaaccaatctaatttagtggtatcagacaagaaaccgaagggaaacgacccctagacctcctagacttacgtactactcgtaccgtcctactttcgacgtaacgggtccggggtacccccctaaggttcgaggtcggcgaggtgtactcgtaggaagtaccgagttaacttcgtaacgtttaccttaactactacgaagactaactcgtacgtacctaaaccgttgtaaagtttagtttacgaccgttaacttaacttactaccgaaccttacgtaacgtaccttaccgttaacccgttcccggttacggtaccggttaccggaaccgtaaacggggaaccgtaaaggggtacgtaaaacgtaaccgtaaaaccgtacgtaggtaccggacttaccggacctaacccgtacttccgttacggttacctttaccaaccgtttccccgttccccgtaccgttaaccg

SEQ ID NO: 11198 - DNA, 680 bp, Homo sapiens
  misc_feature: GYAE6OF01CTAMQ.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccggtagggacagagtcaccatccgcttgccgggcaagtcacgcccatcgaacctaatctaagtttaagttggtatcaagtcaagaaaaccgagggaaacgcccctagactctgactctatactgcctcctactttcgacgtaacggtccgggtaccccctaggttccagtggcagtgatcgtgaagtacagtactttcagtccttactagtccagactaacgtctacgactaaaccgttagtaacgttacttttacggaccttaacttaaccgttacgtccgtaacccttaacgtaacgttaaccctttaccgtacccgttttcccggtaggttacccgggttacccgggaacccgtaaacgggggtaacccttaaacggggtagtaaaaaccctaccggtaaaaccgtaaccgttagggtaaccgggtccgttacgacccgtaacctacgttccttacgttcctttacccgttacttccccgttccccgaccttaccg

SEQ ID NO: 11199 - DNA, 749 bp, Homo sapiens
  misc_feature: GYAE6OF01BV7VR.40.63.F08.1.454.CMB.1.raw
  modified_base (255)..(255): a, c, t, g, unknown or other
  misc_feature (255)..(255): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcagtccggtagggacagagtcaccatcgcttcggccgggacaagtcacgcccatgacaatctaatttagtgtatcagnaacgaaacagggaaaccgcccctagacctcctagacttactatactcggtcctacctacgtttacgacggtaacgggttcccggggtacccccctaagggtttcgaaggttcggacacgggttggacttcgtaggaacgtacctaaggttacttttacgacgtttaccttaacgttactactaacggtacctaaacgttcctaacgtacccgtaaaaccgtttagggtaaaacgtttacgttttaccggaaccgtttaaccctttaaccttaccgttaccggtaacccttaaccgtaacgtttaacccgtttaaccgtacccgtttacccggttacgggtacccggttaccgggaaccggtaaacgggaaccgtaaacgggtacgtaaaaccgtacggtaaaacccggtagtacgggtacgtccgtacggtaccctaccgtacgttacgttacgttacctttaccgtacttccccttacccgccgttaaaccgg

SEQ ID NO: 11200 - DNA, 620 bp, Homo sapiens
  misc_feature: GYAE6OF01EP6WE.40.63.F08.1.454.CMB.1.raw
tcagtctagcgactcacgaccggtgctcgatttagcgatcgtataagggggagtcagtctcagtcaggacacagcatggacatgagggtccccactcagctcctggggctcctgctactctggctccgaggtgccacatgtgacatccagatcgacccagtcctccatccctccctgtctgcagtccggtaggggacagacgtcacatcgcttcgccggacagtcacgcccatcgaccaatctatttaagttggtatcagacaacgaaaccgaggaaacgccctagacctccgtgatctactacgtcgtccgtacctacgttcgacgtaacgggtcccggggtacccccgtaaggttcgtaggtcggacgtaggtcgagtcgtaggacgacgtagtactttacgtacgttacttactatcgtacactactctacggactaacgtagtaagttcttcgactacttactactacgactaatacgtacttacgtaccgttccggtacggtaccgttcggaaccgacgggaacctaagggtaacgtaaacgaccgtaaacgtacgtaggtcgacgtacaccgtactcgttactcgtttcctactacctcccttcccgacttacg

SEQ ID NO: 11201 - DNA, 729 bp, Homo sapiens
  misc_feature: GYAE6OF01EFW6Q.40.63.F08.1.454.CMB.1.raw
  modified_base (211)..(211): a, c, t, g, unknown or other
  misc_feature (211)..(211): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcagtccgtagggacagagtcacatcgctgccggnagtcagccatcgaccaatctagtttaagtgtatcagacaacgaaacgaggaaccgccctagacctcctagtactactactacgtcgtaccgtcctacgtttcgacgtaacgggttcccgggtaccccctaaggttccgtaggtcggtactagggtcgactcgtaggaacgaacgtagttacgtttacgtagtttaccttaacgtaacttaccgaacgttacgtaacgttccgtacgtaccgtaaaccgttaaggtaaacgtttacgttttcggaccgttaaccttttaaccgtaacgtaccgttacccgtaacgtaacggtttaacccttacccggtaccgtttccccgggtacgggttaacccggttaccgggacccggtaaacgggtaaccgtaacgggtacggtaaaactacccgtaaaagtaccgtacggtaccggtacttacggaaccttacccgtaacgttccctacgtttacccttaccttaacccgtttcccgtaccccgtccgttaccg

SEQ ID NO: 11202 - DNA, 783 bp, Homo sapiens
  misc_feature: GYAE6OF01CWIOX.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtcgccactatgtgacatccgagatcgacccagtcctccactcctccctgtctgctacgtccggtaggggacagacgtaccacctagtccgcgttcggcccggacgaaacgtcaccggtaccccaagtacgaacctaactacgttaatttaacggttaggtactacgacgacgaaacgaaaccggagggaaacccaccccgtagtacctacctagtacttactacgtaccgtcgtaccgttacctagttacggacggttaaccggggttcccgggtaccccccgtaaggtaccgtaggtacggtacgtaggtgtaactccggagtaacgaacgtacgttactttaccgtagtttacttacttaacgacgtacgtaactacgttactacgtaccctaaacgttacggtaagtttacgttacgtaccgttaacttaccgtacgtacctaccgtacctaacggttaccgttaacccgttaccgttccggtaccggttaccggtaaccgggtaccggtaaaccggtacggttaaaccgggagtaaaccgtaaacggtaaaccgtacgtaccggtacgggtctaccggaacccgttaccgttcttcgttaccgttacccgttaactacccgtttccccctaccgggttaacctaccggg

SEQ ID NO: 11203 - DNA, 669 bp, Homo sapiens
  misc_feature: GYAE6OF01BSUT0.40.63.F08.1.454.CMB.1.raw
  modified_base (282)..(282): a, c, t, g, unknown or other
  misc_feature (282)..(282): n is a, c, g, or t
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccggtagggacagacgtcaccatcgcttggccgggacaacgtcacgcccagtcgaccaatctagtttaagttggtactcagcaacgaaaccgaagggaaccncccgtaagtacctcctagtactctacgtacgtcgccgttacctacgttcgacgtacgggtcccgggtacccccgtaaggttcgaggtcggactacggtcggtactcgtagaacgacgtaagttactttaccgtaggtttaccttaacggtactcgaacgtacctaacgtccgttacgaccgtaaccgttaggtaaactttcgtttacgtaccgttaactttaccgtactccgtaccgtactacggttaaccttaccggtaccgttccgggacggttaccggtaccggtaaccgaacgggtaccggtaaggtaacgaactaaccgtaacggtcgtacggtcgccgtacgactctacgttcgttcttctctactccctccgtacgtacg

SEQ ID NO: 11204 - DNA, 545 bp, Homo sapiens
  misc_feature: GYAE6OF01BAMG8.40.63.F08.1.454.CMB.1.raw
  modified_base (378)..(378): a, c, t, g, unknown or other
  misc_feature (378)..(378): n is a, c, g, or t
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatcctccctgtctgcatccgtaggggacagagtcaccatcgcttgccgggcaagtcagcccatcgaccaatcatttaagtggtatcagcagaaccagggaagcccctagactcctgatctatactgtcgtcctactttcgcgaacgggtcgggtacccccctaaggttccaggtggcagtggatcagacgactagtatttcgagttcttactatnagcaatctagactaactgtaatatttcgacgtacttactactcgtcctacagtacctacgtaccttcccggtagtaccggttcggaccgtaacgggacctaagggacgaaacgtacaaacgactgtcggcctgctacccatcttgtctcaattcccttcccgctacg

SEQ ID NO: 11205 - DNA, 764 bp, Homo sapiens
  misc_feature: GYAE6OF01CI92U.40.63.F08.1.454.CMB.1.raw
  modified_base (285)..(285): a, c, t, g, unknown or other
  misc_feature (285)..(285): n is a, c, g, or t
  modified_base (314)..(314): a, c, t, g, unknown or other
  misc_feature (314)..(314): n is a, c, g, or t
  modified_base (756)..(756): a, c, t, g, unknown or other
  misc_feature (756)..(756): n is a, c, g, or t
tcagtctagcgactcacgaccggtgctcgatttagcgatcgtataagggggagtcagtctcagtcaggacacagcatggacatggagggtccccgctcagctccgtggggctcctgctactctggctccgaggtcgccacatggtgacatccagatcgacccagtcctccatccctccctgtctgcacgtccggtaggggacaggacgtaccaaccatccggtcttcgggaccgggacaacggtccacgccagtacgacctaatactaacgttttaagttcgtanctagacgaacggtaaaccgagggaaaccncccgtaacgacctccgtagtactcgtaactacgtcgtaccgttaccgtacgtttacggacccggtaaccgggggttccccggggttaaccccccgtaaggggttaccgacgggttccggggacgttaagggtacgggtactacggttagacgaactacggtaactttcgtaacgtttacttaactactcgtaacgacctaatcgtacctactaacgtagtaagttacttacgacgttactacgtcgtactaccgtaacgtaaacgtcgttaacccggtcgttacccggtacggttacccgggttaccgaaccgggtaaccgggtaacgggtaacgggtaacgaaacccgtaacgggaaaccgtacggttggggtaacgtcccggtaagtcccgtaaacttacgtccgttacgttacccttaacgtcctccccggttaacccncgttaacg

SEQ ID NO: 11206 - DNA, 789 bp, Homo sapiens
  misc_feature: GYAE6OF01AQW2W.40.63.F08.1.454.CMB.1.raw
  modified_base (351)..(351): a, c, t, g, unknown or other
  misc_feature (351)..(351): n is a, c, g, or t
tcagtctagcgactcacgaccggtgctcgatttagcgatcgtataaggggagtcagtctcagtcaggacacagcatggacatggacgggtccccgctcagctccgtggggctcctgctactcgtggctccgaggtcgaccacagtgtgacactaccgagactcgaccctagtcctacctactcccttccgtgtcctcgacgtacggtaccgggtagggacgacggtacgtaccgacctagtcgtaccgttcgggaccggactaacgtccgaccgtccacgtacgaacctattacgttaagttttaaggtcgtactagacgtaaccaaccggaaacggaacggtaaaccccnccgttaacgaccgtccgttagactttaaccgtacgttcgtccggttacttaccggttacgttcggaaccggttacccgggttacccggtaccccgtaggtacggcggtacgacggtaggtcgtacgtagtacgagtaccgtagtttacttccgtagttaaccgtactaccgaagaccgttagtaccgttaacgactaaccgttaacggtagttacgtttacgttacgtaaccgttacgttacctcgtaccgtacctaacggttccgttaacgggttacccgttccgggttacggtacccggttaaggtccggtaaacggtaacgggaagtttaacgggaacttaaacggacggtaaccgtggttaccggaatccggtaacgtacttacgcgttttacccgacgtttaccaccgtacccgtttcccgtacgacgtttcg

SEQ ID NO: 11207 - DNA, 515 bp, Homo sapiens
  misc_feature: GYAE6OF02IIWME.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactctgatctatactgcgtccactttgcaaggtgggtcccccaaggttcagtggcagtggatctgagacagatttcagtcttactatcagcaatctgcaacctgaaagtatttgcgtactttactactgaccctacagtaccttacgacttcccgtaggaccgttcggccaagggaccaaggtggaaaactcgaaacgactggtaggctgcaaccatctgtctttcatcttccccgctacg

SEQ ID NO: 11208 - DNA, 507 bp, Homo sapiens
  misc_feature: GYAE6OF02JEDD5.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccaggaaagcccctagactcctgatctatactgcgtccactttgcaaggtgggtcccccaaggttcagtgcagtgatctgagacagatttcagtcttactatcagcaatctgcaacctgaagtatttgacgtacttactactgacctacagtacttacgacttccgtagaccgttcgccgtaaggaccaaggtagaaatcgaaacgacgtagtggctagcacctatctgtccttcactcttcccgctacg

SEQ ID NO: 11209 - DNA, 513 bp, Homo sapiens
  misc_feature: GYAE6OF02G5ZCR.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccaggaaagcccctagactcctgatctatctgcgtccactttgcaaggtgggtcccccaaggttcagtggcagtggatctgagacagatttcagtcttactatcagcaatctgcaacctgaatatttgcgtacttactactgcctaacagtacttacgacttcccgtaggtacgttcgggaccaacgggaccaagggtagaaaactccgaaacgtactcgtggctgcaccatctgttcttcatccttcccgctacg

SEQ ID NO: 11210 - DNA, 572 bp, Homo sapiens
  misc_feature: GYAE6OF02I1E53.40.63.F08.1.454.CMB.1.raw
  modified_base (340)..(340): a, c, t, g, unknown or other
  misc_feature (340)..(340): n is a, c, g, or t
  modified_base (527)..(527): a, c, t, g, unknown or other
  misc_feature (527)..(527): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtgggtccccccaaggttcagtggcagtggatcngagacagatttcagtcttactatcagcaatctgacaacctgaaagtagtttgcctactttacctactcgcctacagacctttacgaccttcccgtaggtaccgtttcgggacccgaagggacccgtaaagggtacggtaaaactaccgaaaaccgtacgtaggttacgggcttacggacaacccgtnttaccgttcgttcctttaccgacttccttccccgtaccctaaccg

SEQ ID NO: 11211 - DNA, 514 bp, Homo sapiens
  misc_feature: GYAE6OF02FOTAG.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccacttttgcaaggtgggtcccccaaggttcagtggcagtggatctgagacagatttcagtcttactatcagcaatctgcaacctgaagtatttgcgtacttactactgcctacatacttacgacttccgtagacgttcgccgaagggaccaaggtcgaaatacgaaacgactggtcggtctggaccaaccattcctgtcttccatcccttcccgctacg

SEQ ID NO: 11212 - DNA, 535 bp, Homo sapiens
  misc_feature: GYAE6OF02G95DE.40.63.F08.1.454.CMB.1.raw
  modified_base (372)..(372): a, c, t, g, unknown or other
  misc_feature (372)..(372): n is a, c, g, or t
  modified_base (504)..(504): a, c, t, g, unknown or other
  misc_feature (504)..(504): n is a, c, g, or t
tcagtctagcgactcacgaccggtgctcgatttagcgatcgtataagggggagtcagtctcagtcaggacacagcatggacatgagggtccccgctcagctcctggggctcctgctactctggctccgaggtgccacatgtgacatccagatcgacccagtctccatcctccctgtctgcatccgtaggggacagagtcaccatcgcttgccgggcaagtcagcccatgaccaatcatttaagttggtatcagcagaaaccaggaaacgcccctagactcctgatctatactgcgtccactttgctaaggtcgggtcccccaaggttccagtggcagtggatcgtgagacagtatttcagtcttactatcanacaatctgacaactgaagtatttgacgtacttactactcgacctacacgtacttacgacttcccgtggtacgttaccgccgtaacgggccaaagggtcgaaatacgaaacgacgtgtacggctacgcaaccnttacctgtccttacactccttacccgctacg

SEQ ID NO: 11213 - DNA, 545 bp, Homo sapiens
  misc_feature: GYAE6OF02IU3WQ.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatgaccaatcatttaagttggtatcagcagaaaccagggaaagcccctagactcctgatctatactgcgtccactttgcaaggtcgggtcccccaaggttcagtggcagtggatctgagacagtatttcagttcttaactatcagcaaatctagcaacctgaaagtatttagcgtacttacttaactcgacctactagtaccttaacgactttcccgtagggtaccgtttccggaccgaagggacctaaagggtacgaaaactcgtaaaagactaggtggactcgaccaccatcttcgtcttcgattcccttcccgctacg

SEQ ID NO: 11214 - DNA, 550 bp, Homo sapiens
  misc_feature: GYAE6OF02FG7I7.40.63.F08.1.454.CMB.1.raw
  modified_base (525)..(525): a, c, t, g, unknown or other
  misc_feature (525)..(525): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccgtaggggacagagtcaccatcgcttgccgggcaagtcagcccatcgaccaatcatttaagtggtatcagcagaaaccgagggaaacgcccctagacctcctgatctatactgcgtcctactttgcaagggtcgggtcccccaaggttcagtggcaggtgatcgtgagacagatttcagttcttactatcagcaatctgacaacctgaagtatttcgcgtacttactactcgtcctaacacgtaccttaccgtacctttcccggagtaccgttacggaccgtaagggtaccaaggtacggaaactacgaaacgacgtagacggtctacggaccacgtactcgtnttctaccgtatcccttccgcctacg

SEQ ID NO: 11215 - DNA, 673 bp, Homo sapiens
  misc_feature: GYAE6OF02JAPQN.40.63.F08.1.454.CMB.1.raw
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatgacccagtctccatccctccctgtctgcatccgtaggggacagagtcaccatcgcttggccgggcaagtcacgcccatcgaaccaatctatttaagttggtatcagacaagaaaccaagggaaacgcccctagacctcctagatactatactgcgtccactttgcgaagggtcgggtaccccctaaggttcagtcggcagtggatcgtgagacgagtactttacgtagttactttaactactacacgtactaactactacgacctaaaccgttagtaaagttacgttttacggccgttaaccgtttaaccttacgttaccgtacccttaacctaaccgttaccgtttaacccggttaccctttacccgggttacgggttacccggtttaccggggaacccggtaaccgggaacccgtaaaggggtaacgtaaaacgttaccgaaacgtaacgtcggtacggtcgttacggaccaccgtaagttccgtagttccttacctactttaccctaccccgtactacg

SEQ ID NO: 11216 - DNA, 735 bp, Homo sapiens
  misc_feature: GYAE6OF02HLQJ0.40.63.F08.1.454.CMB.1.raw
  modified_base (284)..(284): a, c, t, g, unknown or other
  misc_feature (284)..(284): n is a, c, g, or t
tcagtctagcgactcacgaccggtgctcgatttagcgatcgtataaggggaggtcagtctcagtcaggacacagcatggacatgagggtccccgctcagctccgtgggctcctgctactctggctccgaggtcgccacatgtgacatccagatcgacccagtctccatcctccctgtctgcagtccggtaggggacagacgtcaccactcgcttggccgggcaacgtcacgcccatacgaccaatctatttaagttggtactcagcaacgaaaccgaaggaacncccctaagtacctcctagacttctactactcgcctcctacgttcgacgtacggggtacccgggtacccccgtaagggttcgagggtacggactaagggttgaacgttaccgtaggaagtaccgtaaggttacttttaccgtaacggtttacctttaacgtaacgtacgtaacggtaccaaacgtttccgtaccggtaaccgtaaacccgtaggtaacgtttaactttaggaaccgttaaccttaacgttaccttacgtacccgtaacgtacgttaaccgtaacgtaacccggttccggttaaccgggtaccggttaccgggaaccgtaaccgggaaccgtaaggggtacgtaaaacgtacgaaacggtacgttacgggtcggactacggtccaaaccgtccgttacgtcggttacctttaccgacctttacccgttcccgtacccgttacg

SEQ ID NO: 11217 - DNA, 685 bp, Homo sapiens
  misc_feature: GYAE6OF02H85YJ.40.63.F08.1.454.CMB.1.raw
  modified_base (226)..(226): a, c, t, g, unknown or other
  misc_feature (226)..(226): n is a, c, g, or t
tcagtctagcgactcacgaccggtgctcgatttagcgatcgtataaggggagtcagtctcagtcaggacacagcatggacatgagggtccccactcagctcctgggctcctgctactctggctccgaggtcgccacatgtgacatccagatcgacccagtctccatccctccctgtctgcacgtccggtaggggacagacgtccaccatccgcgttcggccggganaagtcacgcccatcgaccatctattttaagttgtatcagacgaagaaaccgaagggaaacctcccgtaagtacctcctagtacttactatacgtcgtccgtcctacgtttcgacgtaacggggtcccgggtacccccgtaaggttcgaggtggaccgtagggtagtactccgtagacgtaactaggttactttacgtacgttacctttaacgtactacgtacgactaacgttccgtacgtaacctaaaccgtagtaacgttacgtttcgacgttaccttactacgtcaccgtaacacgtacttaccgtaccgttcccggtacggttaccgtaccggaccggaacggtaaccgtaacggtacggtaaaacgtacgaaccgttacgtcgggtacgtcgtaccgtactacccgtgttccgttacgttccgtaccttcccttacccgtacccgtacctaaccg

SEQ ID NO: 11218 - DNA, 639 bp, Homo sapiens
  misc_feature: GYAE6OF02HAD0L.40.63.F08.1.454.CMB.1.raw
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatgacccagtctccatcctccctgtctgcatccggtaggggacagagtcaccatcgcttcggccggacaacgtcacgcccatcgaccaatctatttaagttggtatcagacacgaaaccgagggaacacccctagacctctagactactatacgtcgccgttcctacgttttacgacggtaacggggttccccggggtaaccccctaagggttacctagggtcgactaggagtatccgtagaacgactagtatttacacgttacttacttactcgaagtactaactcgtacgacctaacgtacggtaaagttctttagaccgtaacttacacgtctacctaactacgtaccttacgtacccgttcggtacgtaccgttacggaaccgtacgggaacgtacggaagtaaacctacgaacgtacgtcggtacggactaccgaccacttacttccgtacgttacttaccgaccgtttccctaccgtactacgg

SEQ ID NO: 11219 - DNA, 683 bp, Homo sapiens
  misc_feature: GYAE6OF02G52VS.40.63.F08.1.454.CMB.1.raw
  modified_base (285)..(285): a, c, t, g, unknown or other
  misc_feature (285)..(285): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacatgtgacatccagatcgacccagtctccatccctccctgtctgcacgtccggtaggggacagacgtccaccatccgtcttcggcccggctaagtccacgcccatcgaaccatctatttaagttggtatcagcaagaaaccgagggaacncccctagacctcagactctactacgcgtcgtcctacgtttcgacgtacgggtcccgggtacccccaaggttccgaggtcggacgtaggtacggattccgaggacgtactacggtatttcgaacgttaccgttacttacgtcctaacgtacctaacgttaccgtacgtacctaacgtaggtaaacgttacgtttcgacgttaaccttaccttacgtaccgtaccctacgtacgtaacccgtttaccgtacccgttaccgggttacggtacccggttaccggacccggtaacgggtaaccgaagggtaacgaaaccgtacgaaacgggtactcggtacggaccgtacgacccgtacgtacttcgttacggttctaccctactcccgttacccgtctaacg

SEQ ID NO: 11220 - DNA, 714 bp, Homo sapiens
  misc_feature: GYAE6OF02IT5FB.40.63.F08.1.454.CMB.1.raw
  modified_base (137)..(137): a, c, t, g, unknown or other
  misc_feature (137)..(137): n is a, c, g, or t
  modified_base (150)..(150): a, c, t, g, unknown or other
  misc_feature (150)..(150): n is a, c, g, or t
  modified_base (180)..(180): a, c, t, g, unknown or other
  misc_feature (180)..(180): n is a, c, g, or t
  modified_base (216)..(216): a, c, t, g, unknown or other
  misc_feature (216)..(216): n is a, c, g, or t
tcagtctagcgactcacgaccggtgctcgatttagcgatcgtataaggggagtcagtctcagtcaggacacagcatggacatgagggtccccgctcagctcctggggctcctgctactctggctccgaggtgccacntgtgacatccagntgacccagtctccatcctccctgtctgacntccggtagggacagacgtcacatcgcttggcccggnaagtcacgcccatcgaccatctagtttagttgtatcgacgcgaacgtaaaccgagggtaaacgccccgtaacgaccttcctagtacttactatactcggaccttacctactttcggacgtacgggtccgggttaccccccaagggttccgagtcggtacgtaagtcgggtaactcgtcgtaagacgtagttacgtttcgaacgttaccttaacgtacgttacgaacggtactaacgttaccgtacggaactaaccgtacggttaaagtacgttttaccggaccggttaacctttaacggtaccttacggtacccttaacgaacgtttacctaccgttaccggtttacccggttacgggttacccggtttaccgggaccggtaacgggtaacgttaaacggggtacgtaaactaccggaaacgtacgttcggtaccgagttccggaccaccgtagttaaccgttgttaccttccgtacgtacccggttcccacttaccg

SEQ ID NO: 11221 - DNA, 818 bp, Homo sapiens
  misc_feature: GYAE6OF02JUVTD.40.63.F08.1.454.CMB.1.raw
  modified_base (197)..(197): a, c, t, g, unknown or other
  misc_feature (197)..(197): n is a, c, g, or t
  modified_base (207)..(207): a, c, t, g, unknown or other
  misc_feature (207)..(207): n is a, c, g, or t
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatcgacccagtcctccactccctccctgtctcgcactcggtacggganagagtcaccntccgtcgttcggccggataacgcgacgacccagtcaccgaatctatttaaggttgtataccagaccaaggaaaccgaacgggtaaaccgccctagacccttacctcgacttacgtaactacgtcgtcctacctacgtttcggaccggttacggggtacccgggtaccccctaagggttcgtaggtacggcgtacggtaggtctacgtaggtacgtagtacgttatttacgtaacgttaccgtttactagtacgtacgacgttaactccgtaacgtaacccgtaacgttaagttaacggtttaactttacggtaacccgttttaactttaacccggttcccttaaacccgggtcccttaaaccggttaaccgtttaaccctttaacccgggttaccccgttttacccgggggtacccgtttacccccgggttaaaccgggtaacccggggttaaacgggaaaccccgtttaaagggggtaaaaccctaaaccggttaaaaccgggtaaaccttacggggtacgttaccggggcctttaaccggacccttaacggtcctttaccggttacttaccgttaccttcccgtttacccccgtacccgttaccttcgg

SEQ ID NO: 11222 - DNA, 674 bp, Homo sapiens
  misc_feature: GYAE6OF02GH7F9.40.63.F08.1.454.CMB.1.raw
  modified_base (667)..(667): a, c, t, g, unknown or other
  misc_feature (667)..(667): n is a, c, g, or t
tcagtctagcgactcacgaccggtgctcgatttagcgatcgtataaggggagtcagtctcagtcaggacacagcatggacatgagggtccccactcagctcctggggctcctgctactctggctccgaggtgccacatgtgacatccagatcgacccagtctccactccctccctgtctgcactccggtagggacaggagtccaccatccgtcgttggccgggacaacggtcacgccccatacgaaccaatctaagttttaaggttggtaactcgaacgacaaacgaaaaccggaagggaaaccgtacccctaagtaccctccgtagacttacttaactacgtcgtccgtacctacgtttcgacggtaccgggttcccggggtaccccccgtaaggttccgaaggtcggacgtaggtcgtactccgtaggactaacgtagttacttcgacgtttcttacgtactacacgtactatcgtcgacctaacgtagtattacgttcgacgttaccttactacgtcaccgtactacgtaccttacgtccgttccggtacgtcggttaccgaccgaacgggtaccgtaaggtacggaaactacgtaacgtacgtaggtcggacctacgaccgaacttcttacgttcgttccttacgtacccgtccgttaccccncttaccg

SEQ ID NO: 11223 - DNA, 746 bp, Homo sapiens
  misc_feature: GYAE6OF02FJI1Q.40.63.F08.1.454.CMB.1.raw
  modified_base (174)..(174): a, c, t, g, unknown or other
  misc_feature (174)..(174): n is a, c, g, or t
  modified_base (198)..(198): a, c, t, g, unknown or other
  misc_feature (198)..(198): n is a, c, g, or t
  modified_base (296)..(296): a, c, t, g, unknown or other
  misc_feature (296)..(296): n is a, c, g, or t
tcagtctagcgactcacgaccggtgctcgatttagcgatcgtataaggggagtcagtctcagtcaggacacagcatggacatgagggtccccactcagctcctggggctcctgctactctggctccgaggtgccacactgtgacatccagatgacccagtctccatcctccctntcctgcatcccgtaggggaccagngtcgaccatcggcttgccgggcagtcacgccatcgaccatcattaagtggtatcagctagaaaccagggaaagcccccgtagactaccgtgtaacttnaactaactcgtaccgtcctaacttttcgcgaacgggttcggggttacccccccaaggggtttaccacggttcggggccacggttgggaattccgtggaaggtaccgaaggtaacgttttaccgagttaccgttactaacgtacgtacgtacctaaactccgtttaacggccctaaaccttcggaaaacggtattttaccgacgtaaacccggttttaactaaccgttacgacccgttaacgacgtaaccctttaaccggacctttaccccggtagggtaaccccggttttaccggaccccgaaacgggggttaccccctaaaaggggttacggaaaacttcccgaaaaacggtaccccgtaagggttacggtaccgtaccgtacccgaacccgttaacgtacccgttacgttaccgttaccgtacctcccgttaccccggtaccctaacg

SEQ ID NO: 11224 - DNA, 715 bp, Homo sapiens
  misc_feature: GYAE6OF02JUN8K.40.63.F08.1.454.CMB.1.raw
  modified_base (121)..(121): a, c, t, g, unknown or other
  misc_feature (121)..(121): n is a, c, g, or t
tcagtctagcgactcacgaccggtgctcgatttagcgatcgtataaggggagtcagtctcagtcaggacacagcatggacatgagggtccccactcagctccgtggggctcctgctactcnggctccgaggtgccacatgtgacatccagatacgacccagtcaccactcccttccctcgtctacgcctacgttcccgggtaggggacaaggacgtaccctaccactccgtcgttcggacccgggacgaacgtcaccgccctagacgacctaatacttaacgtttaagttggtatcaacgtacaacggaaaccggaacggaacctccctagacctcgtacgatctaacgtctcgtccttcgacttcggacggtacgggtcccgggaccgtaggtcgtcgtacgtacaggtagtacttacgagacgtaacgtcttacgttaattacccgttaacttcgtactacgaacgtacttaccgtacgtccgaaacgtaacgtagttacgtttagttaaccgttaccttaccttacgttacgtacttaacgttaccgtaactaccgtccgttaccggttaccgaccggttaccgtacgtaaccggtacggaaaccggttaacggagtaaaccgtaacgttaaccgtacggtacgtcgcggtaccaccgtacctacgtttcgtaccgtttaccggtcctacccgttccgtaccctacgtacgg

SEQ ID NO: 11225 - DNA, 611 bp, Homo sapiens
  misc_feature: GYAE6OF01BPSU6.9.16.B05.1.454.CMB.1.raw
  modified_base (217)..(217): a, c, t, g, unknown or other
  misc_feature (217)..(217): n is a, c, g, or t
  modified_base (245)..(245): a, c, t, g, unknown or other
  misc_feature (245)..(245): n is a, c, g, or t
  modified_base (259)..(259): a, c, t, g, unknown or other
  misc_feature (259)..(259): n is a, c, g, or t
  modified_base (429)..(429): a, c, t, g, unknown or other
  misc_feature (429)..(429): n is a, c, g, or t
  modified_base (432)..(432): a, c, t, g, unknown or other
  misc_feature (432)..(432): n is a, c, g, or t
tcagtgatacgtctcacgaccggtgctcgatttagagctcacgtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcgctgganccacaatgactttggtgtttaatctgtntctgtaccaaaacnccaagcaaacgccccaaactcctactatttatcacgtccactaacgccggccctcgacggggtccctggtcgcttctctggctctagtctgacgacacggcctcccgtgacccgtctcgtcgggcctccgaggctggaggatggagctagtatttattactcgctacctnatntcgcgaggctacggctagtctagttggtagtagttaggttccgggacgggacgggtaaccaacggcttaccggtacccgttaccgttaacggtccgaacggtaccccgaaagggtcccctacccggtaccccccgttcgggtaccctaacccgttccgttcccgttccccccgtccccg

SEQ ID NO: 11226 - DNA, 637 bp, Homo sapiens
  misc_feature: GYAE6OF01CEPV0.9.16.B05.1.454.CMB.1.raw
  modified_base (299)..(299): a, c, t, g, unknown or other
  misc_feature (299)..(299): n is a, c, g, or t
tcagtgatacgtctcacgaccggtgctcgatttagagctcacgtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcgctggagccaccaatgactttggtgttttaatctgtgtcctggtaaccaaaaacacccaagacaaacgcccccaaactcctcatttancagtccaactaagccggccctcgacggggtccctggtcgcttctctggctctaagtctgacgacacggccctccctgacccgtctcgtgggcctccgaggctggaggtatggaggtctagtatttattactgccactcatatgcaggctacggctagtcagtcgtgtattacggttccgggacgggtaacgggaccaaaggtccgttacgggaaccccgttaccgttaaacggtcccgaaccggacccccgtaaaggggtccccttaccccgggtccccccccgttacggttaccctaacccgtttccccgttacccggttcccccccctaacccccg

SEQ ID NO: 11227 - DNA, 775 bp, Homo sapiens
  misc_feature: GYAE6OF01CFL7U.9.16.B05.1.454.CMB.1.raw
tcagtgatacgtctcacgaccggtgctcgatttagagctcacgtaaggggggggtctcaggaggcagcgctctcaggacgtcaccaccatggcctgggctctgctcctcctcaccctcctcactcagggcacgagggtccgtgggcccagtctgcccctgactcagccctccctccgcgtccgggtctcctggacagtcagtccaccatctcctgcgctggacgccaaccaatgtactttggtaggttttaatctgtgtcctagtaaccaaaaacgaccaaagacaaaacgacccccaaactcctactatttactcacgtccaactaacgccggtccctcgacggggtccctggtcgtacttcgtcgtggccttctaagtctcggaaccgacgaccggtccctccctacggtacccgtctcgttcggggacctaccgaggtcctagggacggtacgtacgggtacggtaccgttagttaaacgttttaacgtttaacgtcggtaccttaaacccgtttcgaaactttacgttccggaccgtaacgggtacccgtttaaccgggacttaagggttctaaacggttcgttaacgggtaattttaccgggttccggggggaacgggtaacgggaaccccgtaaagggtcccgttaccggaaaccccgggttactttaaccgggccctaaaccggtacccgaaacggggttccccttacccggcccccccggtttcggacccttacccgtttcccttaacccgtttccccccgaacccc

SEQ ID NO: 11228 - DNA, 667 bp, Homo sapiens
  misc_feature: GYAE6OF01BL6MR.9.16.B05.1.454.CMB.1.raw
  modified_base (218)..(218): a, c, t, g, unknown or other
  misc_feature (218)..(218): n is a, c, g, or t
  modified_base (245)..(245): a, c, t, g, unknown or other
  misc_feature (245)..(245): n is a, c, g, or t
  modified_base (261)..(261): a, c, t, g, unknown or other
  misc_feature (261)..(261): n is a, c, g, or t
  modified_base (294)..(294): a, c, t, g, unknown or other
  misc_feature (294)..(294): n is a, c, g, or t
  modified_base (332)..(332): a, c, t, g, unknown or other
  misc_feature (332)..(332): n is a, c, g, or t
  modified_base (388)..(388): a, c, t, g, unknown or other
  misc_feature (388)..(388): n is a, c, g, or t
tcagtgatacgtctcacgaccggtgctcgatttagagctcacgtaaggggggggtctcaggaggcagcgctctcaggacgtcaccaccatggcctgggctctgctcctcctcaccctcctcactcaggcacagggtcctgggcccagtctgccctgactcagcctccctccgcgtccggtctcctggacagtcagtcaccatcctcctgcgctggacnccacaatgactttggtgtttatctgtntctagtaaccaaaacnccaagacaacgacccccaaactcctactattancacgtccactaagccggccctcgacgggtccctggtcncttctctgctctagtctgacgacgacgcctcctcgaccgtctcgtcggcctaccgnggtctaggaggacgtggagtcgtagttaattacttacgtacgtacctaacctcgtacttagtacgaccgtacgggtaccgttacggctaacgtacgtaacgttggtacgtagtttacgggtaccgggtaccggggtaacgggaacctaaacggtccggtaaccggtacccgttaaccggtaacgtcccgaaccggacccggtaaacggcccgttaccccgtccccccggttccggtacccttaacccgtttccgttacccccgttccccccgtaccccg

SEQ ID NO: 11229 - DNA, 596 bp, Homo sapiens
  misc_feature: GYAE6OF01DF7I3.9.16.B05.1.454.CMB.1.raw
  modified_base (284)..(284): a, c, t, g, unknown or other
  misc_feature (284)..(284): n is a, c, g, or t
  modified_base (404)..(404): a, c, t, g, unknown or other
  misc_feature (404)..(404): n is a, c, g, or t
  modified_base (415)..(415): a, c, t, g, unknown or other
  misc_feature (415)..(415): n is a, c, g, or t
  modified_base (441)..(441): a, c, t, g, unknown or other
  misc_feature (441)..(441): n is a, c, g, or t
tcagtgatacgtctcacgaccggtgctcgatttagagctcacgtagttgggtttggggggggaagcctgagaacacttagccttcatgagtgtccccaccatggcctggaggatgcttctcctcggactccttgcttatggatcaggagtggattctcagactgtggtcgacccaggagccatcgttctcagtcgtccccgtggagggacagtcacactcacgttgtggcttgagctcgtggctcagtccttcttacctttttacctacccctactcggtaccncgcacgacccaggccaggcctcccacgtatgactcactctacagaccaacaaactacctcgcttccgtcgtcgggtcctgactcgtcttctcgtcgtctcactcgttaggaaacaagtcncgcctccaccnctacgggaccggggccaggcgagtanagtactagaattcgtagttaatttacgttcgttgttcttataattagtacgttgacgttcgtgtagttgtttggtagtcgtcggggaggaacggtaccgtaaggttccgtaccgtcgtacggtcgaaccgtccgacggtcctcccgggtcccccg

SEQ ID NO: 11230 - DNA, 821 bp, Homo sapiens
  misc_feature: GYAE6OF01C7PDZ.9.16.B05.1.454.CMB.1.raw
  modified_base (223)..(223): a, c, t, g, unknown or other
  misc_feature (223)..(223): n is a, c, g, or t
tcagtgatacgtctcacgaccggtgctcgatttagagctcacgtagttggggtttgggggggaagcctgagaacacttagccttcatgagtgtcccaccatggcctggaggatgcttctcctcggactccttgcttatggatcgaggagtggtattctcagtactggtggtacgacccgaggagacctatcgttctcgacgttcgtccccgtgggacgggacngtacacactcacgttggtggtcttggacgtctcgtcggcttacgacgttccttacctttaccttttttaaccctacccccgtaccgttacgggtaacccacggacccgtaaccggaaccccgaacggtccccgtaaggggtcccttacccggaaccgttaaggttacgtaactacgtacttaccgtaacgacgacctaaccaaaactaccgtaccgccttaccgttcggtcgggtaccctgtacgtcgtcttcctacgtcggtcctacctacgtccgttaacgggaaactaacggtctcccgaccctacgaacccgtaccgtacccggggaccggggacccctaggactaaggtaacgttcgaagttacgtaagttaccgttaagttaactttttaacgtacgtttacggtttcgttaacttaacgtttaaaggtttacggtacgggtcgtttacggtacggttattacgggtttaggttagggttcggggttacggggaccgggtaaccggggttaaccttaacggggttcctacccgggtttacgtacggaacccgtaacggcccgtaacggtccccgtccgttaacccccccggg

SEQ ID NO: 11231 - DNA, 509 bp, Homo sapiens
  misc_feature: GYAE6OF02IKBC8.9.16.B05.1.454.CMB.1.raw
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
  modified_base (439)..(439): a, c, t, g, unknown or other
  misc_feature (439)..(439): n is a, c, g, or t
  modified_base (461)..(461): a, c, t, g, unknown or other
  misc_feature (461)..(461): n is a, c, g, or t
tcagtgatacgtctcacgaccggtgctcgatttagagctcacgtaaggggggggtctcaggaggcagcgctctcaggacgtcaccaccatggcctgggctctgctcctcctcacccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctcgtgggtccctgatcgcttcnctggctccaagtctggcaacacggcctccctgaccgtctcgtgggctccgaggctgacgatgaggctgattattactgcagctcatatncaggccaccanaatgtacttggaagtggacccncggtcaccgtctagcacgacccgaagcccaacccatcgctactctccg

SEQ ID NO: 11232 - DNA, 530 bp, Homo sapiens
  misc_feature: GYAE6OF02IXEFK.9.16.B05.1.454.CMB.1.raw
  modified_base (297)..(297): a, c, t, g, unknown or other
  misc_feature (297)..(297): n is a, c, g, or t
tcagtgatacgtctcacgaccggtgctcgatttagagctcacgtaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcgctggagccaccaatgactttggtggttttaatctgtgtcctggtaccaaaaacacccaagcaaagccccccaaaatcctcatttancagtccaactaagcggccctcgaggggtccctggtcgcttctctggctctaagtctgacgacacggcctccctgacccgtctctgggctcaggctgagatgagctgattattactgcactcatatgcaggctacggcagtcatgtagattagttcggacggaggaccgaaagccgtgaccgtcctaagtcacgccgaaggcctcgcccctcggtccactcgttcgtccctccc

SEQ ID NO: 11233 - DNA, 627 bp, Homo sapiens
  misc_feature: GYAE6OF02H3GD4.9.16.B05.1.454.CMB.1.raw
  modified_base (218)..(218): a, c, t, g, unknown or other
  misc_feature (218)..(218): n is a, c, g, or t
  modified_base (268)..(268): a, c, t, g, unknown or other
  misc_feature (268)..(268): n is a, c, g, or t
tcagtgatacgtctcacgaccggtgctcgatttagagctcacgtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcgctggancccacaatgactttggtggttttaatctgtgtcctaggtaaccaaaaacnccaaagcaaacgcccccaaactcctcattttatcagtccactaagccggccctcacggggtccctggtccgtcttctctcggtctacgtaagtctgacgaccacggtccctccctgacccgtctcgtcgggctccgaggtctgaggtatggagtctgtaattattactgcctactcgatatgactaggccgtacggctacggtctaagttgtagtagttacgttccgggacgggacgggaaccaacgtcgttacggacccgttaccgtaacggtcaaccggtacccgaaagggtccctaccggtccccccgttcgggtaccctacccgttacccgtttcccgttacccccctaaccccc

SEQ ID NO: 11234 - DNA, 612 bp, Homo sapiens
  misc_feature: GYAE6OF02GP4H3.9.16.B05.1.454.CMB.1.raw
  modified_base (300)..(300): a, c, t, g, unknown or other
  misc_feature (300)..(300): n is a, c, g, or t
  modified_base (340)..(340): a, c, t, g, unknown or other
  misc_feature (340)..(340): n is a, c, g, or t
  modified_base (447)..(447): a, c, t, g, unknown or other
  misc_feature (447)..(447): n is a, c, g, or t
tcagtgatacgtctcacgaccggtgctcgatttagagctcacgtaaggggggggtctcaggaggcagcgctctcaggacgtcaccaccatggcctgggctctgctcctcctcaccctcctcactcagggcacagggtcctgggcccagtctgccctgactcagcctcctccgcgtccgggtctcctggacagtcagtcaccatctcctgcgctggagccaccaatgactttggtggttttaattctgtgtcctggtaaccaaaaacacccaagcaaacgcccccaaactcctacatttancagtccaactaacgcggccctcgacggggtccctggtccncttctctggctctaagtctgacgacaccggtcctccgtcgacccgtctccgtgggcctccgaggtctggaagtatggacgtcttagtattagttactcgcctacctntactagtcgacaggcctacgctaggtcagttgagtattacggttcgggacggaacgggacctaaggctaccgtacccgttcgtaacgtccgaacggtacccgaacggtccgttcccggcccccgttagggtcccacccgtttcccttacccgttacccctacccc

SEQ ID NO: 11235 - DNA, 698 bp, Homo sapiens
  misc_feature: GYAE6OF02HU87Q.9.16.B05.1.454.CMB.1.raw
tcagtgatacgtctcacgaccggtgctcgatttagagctcacgtaaggggggggtctcaggaggcagcgctctcaggacgtcaccaccatggcctgggctctgctgctcctcaccctcctcactcaggacacagggtcctgggccctgtctgccctgactcagcctgcctccgtgtctgggtctcctggacagtcgatcaccatcctcctgcactcggacccaccactcgattagttgggactattactaaccttgtcctctgtatcaacaccgccagaacaaacgccccactactacttaattatagtacggtacactaacgccggaccctcgtagggttctggtcgtcttctctacgtccctacctaagttctcggtacaaccgtacccggtccctacccgtacgtaacctaacgtccgtcgtacgggtcctaccgtaacggttcctacggaaccggtaaccggtaacgggtccttaagggttaactttaacgttaaccgtgtacctaggtaccttacaagtttacgtcgtaccgaacggtacccaaacccgtaagtaacgtttcgttaccgttaacggggaacggttaccgggaacccgttaccgggtacctaccccggtacgtaccggtaccgacccggtaccccaaacggtcccccaacccttacgtcccgtacctacccgttcctacccccg

SEQ ID NO: 11236 - DNA, 748 bp, Homo sapiens
  misc_feature: GYAE6OF02JKN97.9.16.B05.1.454.CMB.1.raw
  modified_base (216)..(216): a, c, t, g, unknown or other
  misc_feature (216)..(216): n is a, c, g, or t
  modified_base (234)..(234): a, c, t, g, unknown or other
  misc_feature (234)..(234): n is a, c, g, or t
  modified_base (293)..(293): a, c, t, g, unknown or other
  misc_feature (293)..(293): n is a, c, g, or t
  modified_base (621)..(621): a, c, t, g, unknown or other
  misc_feature (621)..(621): n is a, c, g, or t
  modified_base (746)..(746): a, c, t, g, unknown or other
  misc_feature (746)..(746): n is a, c, g, or t
tcagtgatacgtctcacgaccggtgctcgatttagagctcacgtaaggggggggtcgtcgaggaggcagcgctctcaggacgtcaccgccatggcctgggctcgtgctcctcctccaccctcctcactcgagggcacgagggtcctgggcccagtctgccctgactcagcctccctccgcggtcccgggtctccgtggactaggtcacgtcaaccntcctcgtgcgagtggacnccacctaatgtactttgggttagttttaatcgtggttctccttaggaaaaccaaaaccnccctaagacctaaaccggacccccaaacttcctacgtaattttacaccagttaccccaagttaaccggccggtacccctaggtaccggggtccctgggtccgtcttacgtcgtaggtctaccgttaagtccgtggaacccgtacgtaccggtccctcccggtagtaccccgttcgtccggtttacggggccttcccggaggggttacgtacggggaacggtacgtacggggacgggttaccttaagggttaaactttacgttacggtaccgccttaaccggttactagttacggtcgacggggaacctacgggtacgacgttaacttnaaaggtttccggaagttttaccggtgggttaccgggacgggtaacggtaaaccagggttcgtaccgtacgtcgtaacgacgtcgaacgcgttccgctcccgtgaccttcgtacgtccgttacccncg

SEQ ID NO: 11237 - DNA, 1046 bp, Homo sapiens
  misc_feature: GYAE6OF02I7Z9S.9.16.B05.1.454.CMB.1.raw
  modified_base (256)..(256): a, c, t, g, unknown or other
  misc_feature (256)..(256): n is a, c, g, or t
tcagtgatacgtctcacgaccggtgctcgatttagagctcacgtaaagggggggggtctcaggaggcagcgctctcaggacgtcaccaccatggcctgggctctgctcctcctcaccctcctcactcacgggcacgacggggtccctcggggaccccgaggttcctcggtcccccttaggaaccttccacggtcccccttcccccgttccccggccggttcccggggtcccttcccgtacggggtacacggttccncgtaccgaccctacttcctcccgtacgcgtccgttgggaccgacccgtaaccaacgttcggttacggtttttacggggttttacggttttttaacgtttcgtttcggttacggttaccctttacggggttaaaaccccaaaaaaacccgtaaccccaaaacggaaccctaaaaacccgaaaccccccccttaaaacgtccccctttaacctaccttttaacctccgtaccgttaccctaaacgtaccggttcccgaccccgtaccggttaccggggtcccggttcggttaccgtccttccgtcgttcggtccgttaacgttaacgtcgtacggaccgaccgtacccgggtcccgttaccgtacgttaccccgttcgtaaccggtcggggtacccctaccggtacgggtaccgttagggacggtacggttagggtacggggtacgtcgggtttaaactttaaggtttacccgttaccgtcccgttaaaccttccgtaaaccttacggttaccggaccggttaacggtccggaacccggttacgtacggttaacgtacgttacggggttaacctaggtttaaccggggtccggggtaaccgggtaaaccgggacccgttaaccgggtaccgaacccgggtttaccgggttaacccttaaccgggtaaccccgtaacccggggtaccccggttaaccggtcccccggtttacccccggggtaccccgttacccgggttacccgttacccccgttttacccgggtttacccccgtttaccccccggttaccccg

SEQ ID NO: 11238 - DNA, 507 bp, Homo sapiens
  misc_feature: GYAE6OF01CJHVH.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgtcttagtgtgctggtatcagcagaaccgggaagccctaaatcttgatctatgagcctctggtttacaaagtgggtccatcaagattcagcgcagtgatctggacagaatcactctcacatcagcagtctgcagcctgatgattttgctaacttattactgaccaactagtaattaatagttaatccgtaggactagtttggaccgaagggaccgagggtaggaaagtaccaaacggtaacgtggtaggctggccaccgaattctagttccttctacgttccccg

SEQ ID NO: 11239 - DNA, 499 bp, Homo sapiens
  misc_feature: GYAE6OF01C2H8O.9.75.G09.1.454.CMB.1.raw
  modified_base (494)..(495): a, c, t, g, unknown or other
  misc_feature (494)..(495): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgtattttgctaactttattactgaccaactagtataatagttatccgtgactatttggaccagggaccgaggtggaagtcgaaacgactgtaggctgcacatctgtcttnnttcc

SEQ ID NO: 11240 - DNA, 512 bp, Homo sapiens
  misc_feature: GYAE6OF01BVIKS.9.75.G09.1.454.CMB.1.raw
  modified_base (505)..(505): a, c, t, g, unknown or other
  misc_feature (505)..(505): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgctaactttattactgaccaactagtaataatagttatccgtggactatttgggaccgaagggaccgtaggtaggaagtacgaaacgtactggtggctgcacctatctgtccttncttcccg

SEQ ID NO: 11241 - DNA, 556 bp, Homo sapiens
  misc_feature: GYAE6OF01CRZXG.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaagcccctaaatcttgatctatgaggcctctggtttacaaagtgggtcccatcaagattcagcggcagtggatctgggacagaattcacctctcaccatcagcagtctgcacgcctgattgttatttgacttaactttattactcgtaccaactagttaattaattagttaacgtccggtagtacttagttcggaaccgaacggggtaccggagggtaggaaacgtaaccgaaacggtaacgtggtacggcgtcgaacacctaacgttcttagttccttcgtactttccccg

SEQ ID NO: 11242 - DNA, 546 bp, Homo sapiens
  misc_feature: GYAE6OF01CP96T.9.75.G09.1.454.CMB.1.raw
  modified_base (267)..(267): a, c, t, g, unknown or other
  misc_feature (267)..(267): n is a, c, g, or t
  modified_base (371)..(371): a, c, t, g, unknown or other
  misc_feature (371)..(371): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaancccctaaatcttgatctatgaggcctctggttacaaaggtgggtcccatcaagattcagcggcagtggatcgtgggacagaattcactctcacatcagcagtcngcagcctgatgtattttcgactaactttattaactgtaccctaaactagttaataattaagttactaccggtaggtactagtttggaccgtaagggaccgtagggtaggaaagtacgaaaacggtaacgtggtacggctacgaccaacctacttactgttccttcgacttccccg

SEQ ID NO: 11243 - DNA, 559 bp, Homo sapiens
  misc_feature: GYAE6OF01BPXV9.9.75.G09.1.454.CMB.1.raw
  modified_base (262)..(262): a, c, t, g, unknown or other
  misc_feature (262)..(262): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagaatgttcttagttggtgcctggtatcagcagaaaccgggaanccctaaatcttgatctatgaggcctctggttacaagtgggtcccatcaagattcagcggcagtggatcgtgggacagaattcactctcacatcagcagtctgcagcctgatgtattttgactaacttattactcgaccaatagttaataatagtttactccgtaggtactagtttacggaccgtaagggaccggaagggtacggaaacgttaccgaaaacggtaacgttaggtacgggtaccgtacggtaccgaacccgtacgttaccttagttacctttacgtacgtttacccccg

SEQ ID NO: 11244 - DNA, 507 bp, Homo sapiens
  misc_feature: GYAE6OF01A5YFB.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttgcctggtatcagcagaaaccgggaagcccctaaactcttgatctatgaggcctctggtttacaaagtggggtcccatcaagattcagcggcagtggatctgggacagaattcactctcaccatcagcagtctgcagcctgatgattttgctaacttattactgccaactagtataatagttatccgtgtactatttggaccaagggaccgagggtaggaagttaccgaaacgtaactggtaggctgcacctatctgtcttcattcccg

SEQ ID NO: 11245 - DNA, 560 bp, Homo sapiens
  misc_feature: GYAE6OF01B8TV6.9.75.G09.1.454.CMB.1.raw
  modified_base (427)..(427): a, c, t, g, unknown or other
  misc_feature (427)..(427): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagatgttctagtggtgctggtatcagcaggaaaccgggaagccctaaactctgatctatgagcctctggtttacaaggtgggtcccatcaagattcagcggcagtggatcgtgggacagaatcactctcaccatcagcagtctgcagctgatgtatttgactaactttattacgtcgacctaaactagttaactaattaacgtttanaccggttaggtacctagtttacgggaccgaaggggtacccggtagggtaggtaaacgtaccgaaaacggtacgttaggtagggtcctaggacctaacccgtagttaccttggttactttccgacgtttccccg

SEQ ID NO: 11246 - DNA, 545 bp, Homo sapiens
  misc_feature: GYAE6OF01CR2C6.9.75.G09.1.454.CMB.1.raw
  modified_base (256)..(256): a, c, t, g, unknown or other
  misc_feature (256)..(256): n is a, c, g, or t
  modified_base (309)..(309): a, c, t, g, unknown or other
  misc_feature (309)..(309): n is a, c, g, or t
  modified_base (396)..(396): a, c, t, g, unknown or other
  misc_feature (396)..(396): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgtctagtgtgctggtatcagcagaaaccgggaanccctaaactcttgatctatgaggcctgtggttacaaaggtgggtccatcaagntcagcggcagtggatcgtggacagaattcactctcacctatcagcagtctgctagcctgattgtaattttcgactaacttattaccngtaacccaaatacgttaattaagttaacgtttactacccggttaggtaccttagttttacggaccgtaagggtaccgagggtaggaactacgaaaacgtaacgtggtacggctacgaccaccgtatcttagttcttcgtaatttccccg

SEQ ID NO: 11247 - DNA, 611 bp, Homo sapiens
  misc_feature: GYAE6OF01C38GQ.9.75.G09.1.454.CMB.1.raw
  modified_base (190)..(190): a, c, t, g, unknown or other
  misc_feature (190)..(190): n is a, c, g, or t
  modified_base (261)..(261): a, c, t, g, unknown or other
  misc_feature (261)..(261): n is a, c, g, or t
  modified_base (286)..(286): a, c, t, g, unknown or other
  misc_feature (286)..(286): n is a, c, g, or t
  modified_base (370)..(370): a, c, t, g, unknown or other
  misc_feature (370)..(370): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccgggccagtcagatgttcttagttggtgctggtatcagcagaaccgggaancccctaaatctgatctatgagcctntaggtttacaaaggtgggtcccatcaagattcgagcggcaggtggatcgtgggacagtaattcactctacaccatcagcagtcngaccagtcctagtattgttattttacgactttaactttattaacctcgtaaccctaaactaaggttaacttaaagtttaacgtttaacgttcccgggttaggtaaccgttaaggttttacgggaacccggtaacggggtaaccggtaggggttaaggtaaacgtaacgaaaacggttacgtggttacggccgttagacctaccgtaacgtttcctaggttcccttcgtacgtttacccccg

SEQ ID NO: 11248 - DNA, 502 bp, Homo sapiens
  misc_feature: GYAE6OF01C4SIV.9.75.G09.1.454.CMB.1.raw
  modified_base (261)..(261): a, c, t, g, unknown or other
  misc_feature (261)..(261): n is a, c, g, or t
  modified_base (498)..(498): a, c, t, g, unknown or other
  misc_feature (498)..(498): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggccagtcagaatgttctgttggtgctggtatcagcagaactggggaaancccctaaatcttgatctatgagctctggtttacaaagtgggtcccatcaagattcagcggcaggtgatctgggacagaattcactctcacatcagcagtctgcagcctgatgtattttgactaactttatactgaccctaatagtaataattaagttatccgtagactagtttacggacgaagggtaccgagggtaggaagtacgaaacgagtggtggcttgactaccatctgtctntacg

SEQ ID NO: 11249 - DNA, 679 bp, Homo sapiens
  misc_feature: GYAE6OF01C52LH.9.75.G09.1.454.CMB.1.raw
  modified_base (192)..(192): a, c, t, g, unknown or other
  misc_feature (192)..(192): n is a, c, g, or t
  modified_base (286)..(286): a, c, t, g, unknown or other
  misc_feature (286)..(286): n is a, c, g, or t
tcagtgatacgtctcacgaccggtgctcgatttagtatagacatcagggggagtcagacccagtcaggacacagcgtggacatgagggtccccgctcagctccgtggggctcctgctgctctggctcccaggtgccaattgtgacatccagatgacccagtctccttccaccctgtctgcatcgtgtggganacagagtcaccatctcgttcggccgggccaggtcagtattgtttcttaggttggttggccttggtatcgagacgaaaggaaacccggggaaacncccctaaatcgttagattactagtggacggtccttagttacggtttaacgaaaggttcgggtaccctatacaagtattcgagcggcgtaaggtggacttcggacgggaactagtaacttccgacttcacccgacatccgagtacgtacgtctgacctagtcctagtagttgttaacgttttcaacgttaacctttattacctacggtaaccctaaagttaggttaaacttaaaggtttacggtttaactccgggttaacgtaacgtttacggtttaaccgggaacccggtaaggggtaccgggtaaagggtacgggtaaaaccgtaccgtaaaacggtaccgtggtacggcgttcgacctacgtcttacttagttccttcgtccgttaccccg

SEQ ID NO: 11250 - DNA, 588 bp, Homo sapiens
  misc_feature: GYAE6OF01AKB93.9.75.G09.1.454.CMB.1.raw
  modified_base (561)..(561): a, c, t, g, unknown or other
  misc_feature (561)..(561): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctcgttcggcccgggcagtcagtaattgtttcttaggttggttggccttggtatcgagacgaaggaaaccgggaacacccttaaactcttagactcgtagtgacgtccttgttacggtttacaaacggtcgggtacccagtaccaagtattcgaggcggcaggtggactcggtaggactaagtattcaactcctacacatcagctagtcagcacgtctagtagttgtactttcgacttaacgtttactacgtcgaacctaatagttaattaattacgttatccggtagtacgttacgttcggacgtagggacgtaggtgaaacgtacgaaacgtgtggtacgcgtacgctaaccgtnttaccgtcttacttccgtcgttccccg

SEQ ID NO: 11251 - DNA, 564 bp, Homo sapiens
  misc_feature: GYAE6OF01DDBFJ.9.75.G09.1.454.CMB.1.raw
  modified_base (191)..(191): a, c, t, g, unknown or other
  misc_feature (191)..(191): n is a, c, g, or t
  modified_base (268)..(268): a, c, t, g, unknown or other
  misc_feature (268)..(268): n is a, c, g, or t
  modified_base (340)..(340): a, c, t, g, unknown or other
  misc_feature (340)..(340): n is a, c, g, or t
  modified_base (358)..(358): a, c, t, g, unknown or other
  misc_feature (358)..(358): n is a, c, g, or t
  modified_base (366)..(366): a, c, t, g, unknown or other
  misc_feature (366)..(366): n is a, c, g, or t
tcagtgatacgtctcacgaccggtgctcgatttagtatagacatcagggggagtcagacccagtcaggacacagcgtggacatgatggtccccgctcagctcctggggctcctgctgctctggctcccaggtgccaattgtgacatccagatgacccagtcctccttccaccctgtctgcatctgtggganacagagtcaccatctcttgccggccagtcagtatgttcttagtggttggctggtatcagcaaggaaaccggggaacncccctaaatctgatctatgacgcctcgtaggtttacaaaggtcgggtcctatcaagattcagcgcagtgatntagggacagattcactcncaccatcngcagtctgctagcctgattgtattttgacttaactttagttacctcgaacctaatagttaattaattacgtttaacgtcccggtagtaccttagtttacggaccgtaaggggacccgtagggtacggtaaagtaacgaaacggtacgttggtgggaccttagacctaaccgtacttccttagttccctttcgtacccg

SEQ ID NO: 11252 - DNA, 547 bp, Homo sapiens
  misc_feature: GYAE6OF01EYAXQ.9.75.G09.1.454.CMB.1.raw
  modified_base (190)..(190): a, c, t, g, unknown or other
  misc_feature (190)..(190): n is a, c, g, or t
  modified_base (225)..(225): a, c, t, g, unknown or other
  misc_feature (225)..(225): n is a, c, g, or t
  modified_base (258)..(258): a, c, t, g, unknown or other
  misc_feature (258)..(258): n is a, c, g, or t
  modified_base (341)..(341): a, c, t, g, unknown or other
  misc_feature (341)..(341): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcacatctcttgccggccagtcagatgtnttagtggtgctggtatcagcagaaaccgggaanccctaaactctgatctatgagctctggtttacaagtgggtccatcaagattcagcgcagtgatcgtggacagaattcaactcnctacatcagcagtctgcagcctagatgtattttgctaactttattactcgaccaaacaagttactaaattacgtttacaccgttaggtaacttagtttacgggacctaaaggggtcccgaagggttaggaaacgttacgaaaacggtacgttaggtacggcttacggacctacctaacttcgttagttccttcgtacgtttccccg

SEQ ID NO: 11253 - DNA, 769 bp, Homo sapiens
  misc_feature: GYAE6OF01A9IP4.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgggagacagagtcaccatctcttcggccgggccagtcagtaattgttcgttaggttggttggccttggtatcgagacgtaacggaaaaccggggaaacacccctaaacttcttagactctagtcgacggtcctcgttaggtttaacgtaaaggttcggggtacccctagtacgtaaaggtacttaccggacggtccggtacgtaggttacgggtacgttaccgggtaggggtaactaaaggttaaacctttacaccgtttacctacccaacccttagtaccgtagtccgttaacgtccgttacggaccgtaccgtacccgttaggtaactttaggttaaccgtttttagaacccttttaaactttaacgtttacccgtacgtaaccctaaagttaacgtttaattaaacggtttacgtttaacggttacccgttagggtaaccttacgggttttacggaaccgggtaacgggaccggttaagggtaacggttaaacgtaaccggaaaacggtacgttagggtcggtaccgtacggtaccctaacgtcgttaccgtttcggacctttcgtacccgtttaccccg

SEQ ID NO: 11254 - DNA, 558 bp, Homo sapiens
  misc_feature: GYAE6OF01EKEHB.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagtatgttcttagtggtgctgtatcagcaagaaccgggaacaccctaatcttgatctatgacgctcgttaggtttacgaaaggtcgggtaccctagtacgtaagtacttcgaggcggcgaggtggagtcgtagggacagtaacttcactctaccgacatcagctagtcgtcgctacgcctagtattgtacgttttcgactaactttattacctcggtacctaactaagttaataagttagttacgtcgtagtacttagttcgaccgaagggtaccgaggtacggaacgtacgaaacgtacgtggtagcgtagaccacgtactctattcctctcgtacccg

SEQ ID NO: 11255 - DNA, 561 bp, Homo sapiens
  misc_feature: GYAE6OF01E1Y27.9.75.G09.1.454.CMB.1.raw
  modified_base (261)..(261): a, c, t, g, unknown or other
  misc_feature (261)..(261): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgttcttagttggtgctggtatcagcagaaaccggggaanccctaaatctgatctatgagctctggtttacaagtgggtccatcaagattcagcggcagtggatctggacagaattcactctcacatcagcagtctgcagcctgatgtattttgactaactttattactcgacctaatagtaataattacggttaatccggtaggtactagtttcgggaccgtaaaggggacccgtagggtacgggtaaacggtaccgtaaaacggtacttagggtagggtacctacgggaccctaacccgtacgttaccgttacggtttcctttccgacgtttcccccg

SEQ ID NO: 11256 - DNA, 586 bp, Homo sapiens
  misc_feature: GYAE6OF01CAYG7.9.75.G09.1.454.CMB.1.raw
  modified_base (190)..(190): a, c, t, g, unknown or other
  misc_feature (190)..(190): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccattctcttgccgggccagtcagtaattgttcttaggttggttggcctggtatcgagacgaacggaaaaccggggaaactaccccgtaaactcgttagatctatggacggtccttgttaggtttaacgaaaggttcgggtacccatacgaagtattcgagcggctaggtggatcgtaggactagtaatcactctacaccatcagctagtctagctcgctgtagtgttattttgacttaaactttattacgtcacctaactagttaattaattagttacttacggtagtacttagtttacggacgtaagggccgtaggtagaacggtacaaacggtatggtacggtctacggactacccgtatcgttacttccttctccgttccccg

SEQ ID NO: 11257 - DNA, 640 bp, Homo sapiens
  misc_feature: GYAE6OF01AKX9O.9.75.G09.1.454.CMB.1.raw
  modified_base (616)..(616): a, c, t, g, unknown or other
  misc_feature (616)..(616): n is a, c, g, or t
  modified_base (633)..(633): a, c, t, g, unknown or other
  misc_feature (633)..(633): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtcctccttccaccctgtctgcatcgtggtgggagacagagtcaccatctcttgcccgggcagtcagtaatgtttcgttagttggttcggcctggtatcgagcgaaggaaaccggggaaacgacccctaaactcgttgacttctaagtggacggtccttcgttaggtttaaccgaaaggttcggggtacccaagtacgaaagtaacgttccgaaggtccggacgaggttacgggagtccgtaggggacaagtaacttcaactcctacgaccatacacgcacgtctgaccagtaccgtgagttgttaattttgaccttaagtttacttacctagaaccctaaatagttaataaagtttacgttaacgttccgtagggttaacttaggttacggaccgtaacggaccggtagggtacgaacgtaacgtaaacgacgttaggacggtcagtaccgtacctnttcgttagttcttcgtntttcccg

SEQ ID NO: 11258 - DNA, 648 bp, Homo sapiens
  misc_feature: GYAE6OF01BSS40.9.75.G09.1.454.CMB.1.raw
  modified_base (195)..(195): a, c, t, g, unknown or other
  misc_feature (195)..(195): n is a, c, g, or t
tcagtgatacgtctcacgaccggtgctcgatttagtatagacatcagggggagtcagacccagtcaggacacagcgtggacatgagggtccccgctcagctccgtggggctcctgctgctctggctccaggtgccaattgtgacatccagatcgacccagtcctccttccaccctgtctgctatcgtggtggganacaggactccaccattctcgttcggccgggaccagtcagtattgttcgttaggttggtcggcctggtatcgagacgaacggaaaccgggaacaccctaatctgatctagtcgacgtctcgtaggttacaacggttcggaccagtacgagtatacgcggcgcgtaggtgacttcggacggtaacaaggttaacttccaccgttacacctaaacgtcgtacgacggtactacggttcacggacgtacgtccgttagtacgttagttacgtttacgactttaacgtttactaccgtacgtacctaaagtagtttaactaacgttacgttacgtacggtaacggttacgttaacggtcgggaaccgtacgggacgttaagggtacgtaaccgtaacggaacgttcggtagtcggctacggacctaactacgttcttacttacttcgtcgttaccccg

SEQ ID NO: 11259 - DNA, 664 bp, Homo sapiens
  misc_feature: GYAE6OF01APC34.9.75.G09.1.454.CMB.1.raw
tcagtgatacgtctcacgaccggtgctcgatttagtatagacatcagggggagtcaggacccagtcaggacacagcgtggacatgagggtccccgctcagctccgtggggctcctgctgctctggctcccaggtgccaattgtgacaatccagatgacccagtctcccttccaccctgtctgcatcgtgtcgggagacaggactccacctatctcgttcggccggcagtcagtaattgttcttaggttggtcgctgtatcagacgaaggaaaccgggactaccctaaactctagtactctagtgtacggtcctacgttaggtttaacaagggtcgggtacccatacgaagtacttacggacggcggtcgtaggttacgggtacgtcggtaaggggaccaaggttaacttctaacccgtcctacgaaccacgttacacgtaccgtaacgtctcggactaccgtcgttagtagttagttacgtttacgtaaccttaactttacttaccgtacgtaactaagttaaatttacgttaaacgtcgttaacggttcgtaacgggtattaccgggttacggaacggtaacggtacggaagtacgggaaactaacgtaacggtagtggtcgtacctgaaccaccgtatcggttactcgttcctacggttccc

SEQ ID NO: 11260 - DNA, 562 bp, Homo sapiens
  misc_feature: GYAE6OF01CJ2PO.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgcccgggccagtcagaatgttcttagttggttggcctggtatcagcaaggaaaccggggaaagcccctaaactcttgatctatgaggcctcgtggtttacaaaggtgggtcccatcgaagattcgagcggcagtggatctgggacagaattcactctcaccatcagcagtctgcagcctgatgtattttgactaactttattactgtacccaatagtaattaatagtttactccggttagtactagtttcgggaccgtaggggaccgtagggtaggaaacgtaccgaaacggtaacgtggtacgggcttacgccgtaaccgtacttccgttaggtttccttctacgtttccccg

SEQ ID NO: 11261 - DNA, 686 bp, Homo sapiens
  misc_feature: GYAE6OF01CDV00.9.75.G09.1.454.CMB.1.raw
tcagtgatacgtctcacgaccggtgctcgatttagtatagacatcagggggagtcagacccagtcaggacacagcgtggacatgagggtccccgctcagcctccgtggggctcctgctgctctggctcccaggtcgcctaattgtgacatccagatcgacccagtccttccttccaccctgtctgccatcgtggtgggacacgaggacgtcaccattctcgtcggccgggtccagtcagtaagttgttacgttaggttggttcgtccgtaggtactcgagacggaaacgggaaaccgggtaaccgaccccttaaagtctagtacttactagtcgacgtccttcgttaaggttaacgaaggttcggtacccagttacaagttacgtacgacggcgtcgaaggtgacgttcggacggactagtacttccactctacacgtatacgacgctacgtctacggaccgtcgtcctagttacgtcgttaacgttttcggtaacttaacgtttcgtaacctaacgtacctaaaagtaagtttaaacgtaactttaggttaccgtaccgggtaacgtaaacgtttcggtaacggaccgggtaacgggaacggttagggtaaccgaaacgtaaacggtaacggaacgttggtcacgttacggctacgttactcttcgttcgtactcccttacccgg

SEQ ID NO: 11262 - DNA, 743 bp, Homo sapiens
  misc_feature: GYAE6OF01ER7E9.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccacctgtctgctatctggtgggagacagagtcacctatcctcgttcgcccgggtcagtccaagtattgttcttaggttggttcggtccgtggtattcgaggaccgaaacgggaaacccggggtaacaccccttaaacgtcgttacgaacttcgtaagtcggtacgtccgttacgttaaggtttaacgaaacgggttccgggtacccaagtacgaaacgtacgttacgagggtccggtactaaggttcgggaacttacgggtacgggtaacgtaacggtaaaccttcgaacctttccgaaccaaaccctagtaccgaaggtacctaggttacctacgaccgtaagtcccttaaggtaccgttagttaagttttaccacgtttaacctttagttaaccgtacgtaacccgtaaagtaacgtttaattaaaacgttcgttattaacccgggtagtaacttacggttacgggtaccgtaacggggtaaccgtaagggtaacgtaaacggttaccgaaaacggtgtaggttccggactacggacttaccgtattcgttaagttccttaacgctttccccgg

SEQ ID NO: 11263 - DNA, 582 bp, Homo sapiens
  misc_feature: GYAE6OF01AFCQD.9.75.G09.1.454.CMB.1.raw
  modified_base (242)..(242): a, c, t, g, unknown or other
  misc_feature (242)..(242): n is a, c, g, or t
  modified_base (257)..(257): a, c, t, g, unknown or other
  misc_feature (257)..(257): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgttcttagtggtgctggatnagcagaaccgggaanccctaaactcttgatctatgacggtcctcgttaggtttacgaaggtcgggtacccatcaagtattcgaggcggcagtggactcgtagggacagtaacttcactctacactatcagctagtctgcacgtcctgattcgttattttgaccttaactttattaccgtacgaccctaaactagttaataagttacgttaacgttccggtaggtacttagtttacgggacccgaaggggtaccggtagggtacggaaacggttacgaaacgtacgttggtacggccttacggacctaccgtacttcgttagttccttcgtcgttaccccg

SEQ ID NO: 11264 - DNA, 664 bp, Homo sapiens
  misc_feature: GYAE6OF01A88CQ.9.75.G09.1.454.CMB.1.raw
  modified_base (139)..(139): a, c, t, g, unknown or other
  misc_feature (139)..(139): n is a, c, g, or t
  modified_base (200)..(200): a, c, t, g, unknown or other
  misc_feature (200)..(200): n is a, c, g, or t
  modified_base (212)..(212): a, c, t, g, unknown or other
  misc_feature (212)..(212): n is a, c, g, or t
  modified_base (444)..(444): a, c, t, g, unknown or other
  misc_feature (444)..(444): n is a, c, g, or t
  modified_base (471)..(471): a, c, t, g, unknown or other
  misc_feature (471)..(471): n is a, c, g, or t
  modified_base (526)..(526): a, c, t, g, unknown or other
  misc_feature (526)..(526): n is a, c, g, or t
tcagtgatacgtctcacgaccggtgctcgatttagtatagacatcagggggagtcagacccagtcaggacacagcgtggacatggagggtccccgctcagctccgtggggctcctgctgctcgtcggctcccgaggtcncctaattgtgacatccagatcgacccagtcctccttccacctgtctgcatcgtggtggganacagagtcaacntctcgtcggccggcagtcagtattgttacgttgttggttgccttaggtactcgagacgaaacgggaaacccggggtaaacgtaccccttaaagttcgttacgtactacgtagtacggacgtcctacgtttaggtttaacgtaacgggtccgggtacctacgtactaaacgtacgttacgacggcggtcgagtacggtatcgtaaggactagtaacttccactctaccactancgtacgctgtcgtcgactacgcgttancgttagttagtttacacgttaattactccgtactacctaattattaacttaagtnttaacccgtacgttacggaacgtttacgttacggaaccgggtaaggtaccgggtaggacgttaaaccgataaacggcgttggaccggtctaccgaccggtattaacgtccttaacggtccttacgacgtttccccccg

SEQ ID NO: 11265 - DNA, 576 bp, Homo sapiens
  misc_feature: GYAE6OF01ESUL0.9.75.G09.1.454.CMB.1.raw
  modified_base (278)..(278): a, c, t, g, unknown or other
  misc_feature (278)..(278): n is a, c, g, or t
  modified_base (312)..(312): a, c, t, g, unknown or other
  misc_feature (312)..(312): n is a, c, g, or t
  modified_base (322)..(322): a, c, t, g, unknown or other
  misc_feature (322)..(322): n is a, c, g, or t
  modified_base (332)..(332): a, c, t, g, unknown or other
  misc_feature (332)..(332): n is a, c, g, or t
  modified_base (348)..(348): a, c, t, g, unknown or other
  misc_feature (348)..(348): n is a, c, g, or t
  modified_base (352)..(352): a, c, t, g, unknown or other
  misc_feature (352)..(352): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtcgccaattgtgacatccagatgacccagtctccttccacctgtctgcatctggtgggagacagagtcaccatctctgccggcagtcagatgttctagtggtgctggtatcagcaggaaaccgggacaccctaaatctgatctatgngtcctgtaggttacaaggtcgggtccatcgaagnttcgagcggnaggtgatcgnggacagtactcactcncacntcagctagtctgctagctagatgtatttagacttaactttcgttaacgtcgtaccaaacgttagttaagttaagttacgtttacgtaccggttaggtaactttaggttacggaaccgtaacggggtaccgtagggtacggtaaacgtaacgtaaacggtacgtaggttacggcttacggacccgttaactacgttcttaggttaccttacgtccgtttacccgg

SEQ ID NO: 11266 - DNA, 774 bp, Homo sapiens
  misc_feature: GYAE6OF01A5EH8.9.75.G09.1.454.CMB.1.raw
  modified_base (203)..(203): a, c, t, g, unknown or other
  misc_feature (203)..(203): n is a, c, g, or t
tcagtgatacgtctcacgaccggtgctcgatttagtatagacatcagggggagtcagacccagtcaggacacagcgtggacatgagggtccccgctcagcctccgtggggctcctgctgcctctcggctccccagggtcgccaatttgtgacatccagatcgacccagttcctcccttccaccctgtctgcatctggtggganacagacgtcaccatctcgttcggcccggccagtccagtaattgtttacttaggttggtcggccttggtactcgagtacgaacggaaaaccggggaacctaccctaaacttcgttagactcttagtggacgtccttacgttacggtttaacgaaggtccgggtacctagtactaagtacttacgacggcggtacgtagtggtactcggtacggaactagtaacttcctacttctaacaccgtactaccaaggtaccgtacgttaccgtactacgtaccgtccgttagttacgttacgtttacgttttacgaaccttttaaacctttaacttaacccggtacgtaaacctaaacgtttaacgttaaagttaaacgtttaacggtttaaccgttaccgggtttaaggtaaccgtttaaggtttacccgggaaaccggttaacggggtaaccgggttaacggggttaacgaaaccgggttaaacccgtaaaacgggtaccgttaagggtacccggtagttaccgacccgttactacggttaccgtttactacccgtttactaccgtttaccccgg

SEQ ID NO: 11267 - DNA, 744 bp, Homo sapiens
  misc_feature: GYAE6OF01CKTCP.9.75.G09.1.454.CMB.1.raw
  modified_base (191)..(191): a, c, t, g, unknown or other
  misc_feature (191)..(191): n is a, c, g, or t
  modified_base (207)..(207): a, c, t, g, unknown or other
  misc_feature (207)..(207): n is a, c, g, or t
  modified_base (263)..(263): a, c, t, g, unknown or other
  misc_feature (263)..(263): n is a, c, g, or t
tcagtgatacgtctcacgaccggtgctcgatttagtatagacatcagggggagtcagacccagtcaggacacagcgtggacatgagggtccccgctcagctcctgggggctcctgctgctctggctcccaggtgccaattgtgacatccagatgacccagtctccttccaccctgtctgcatctgtggganacagagtcaccatctntgccggcagtcagatgttctagttggtgcctggtatcagcaaggaaaccggggaanccctaaatcttgatctatgacgccttctaggtttaacaaggttcgggtcccatacaagtattcgaacggcggtcaggtggtacttccggtaggggaacaggtaactttccaactttcctaccaaccgacttacgaacgtctaagtaccgttacggaccgtaacggtacccttaggtaacgtttaggttaacgttttttacggaaccttaaaaccttttaacttaaccgttacgtaacccctaaaactaaggtttaaacttaaaacgttaacggtttaacggttcccgggttaacgggttaaccgttaaggttttacggggaacccgtaaaagggggtaccccggtaaaggggttaacgggtaaaaccggtttaaaccgaaaaaccgggttaaccgttagggttaccggtaccggttacgaaccccgtaaccgttacgttacccgtttacggttcctttaacccgtaacgttttccccccgg

SEQ ID NO: 11268 - DNA, 600 bp, Homo sapiens
  misc_feature: GYAE6OF01EDHJC.9.75.G09.1.454.CMB.1.raw
  modified_base (269)..(269): a, c, t, g, unknown or other
  misc_feature (269)..(269): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtcctccttccaccctgtctgcatctgtgggagacagagtcaccatctcttgccgggccagtcagaatgttcttagttggttggcctggtatcagcagaaaccggggaaancccctaaactcttgatctatgaggcctctggtttacaaagtggggtcccatcaagattcagcggcagtggatcgtgggacagaattcactctcaccatcagcagtctcggcacgcctgattgtattttcgactaactttattacgtgaccaaactagttaacttaagttagtttaacgttccggtagggtacttaagttttagggacccgtaaacggggtacccggaaggggttacgggaaaggttaaccgaaaacggtaaccgtttagggtacgggcgttacggaccaacccgtaattcccgttacgtttacgttcctagtttacccccg

SEQ ID NO: 11269 - DNA, 869 bp, Homo sapiens
  misc_feature: GYAE6OF01AXUSI.9.75.G09.1.454.CMB.1.raw
tcagtgatacgtctcacgaccggtgctcgatttagtatagacatcagggggagtcagacccagtcaggacacagcgtggacatgagggtccccgctcagctccgtggggctcctgctgctctggctcccaggtgccaattgtgacatccagatcgaccctagtcctccttcccacccttgtctgctatcgtggtgggagacagacgtccacctattccttacgttcggccgggtaccagtacgtaagtaagttcgtttacgtttaggtttgggttcggtccgttaggttactcgtacggaaccggaaacgggtaaaaccccggggaaaccgtaccccttaaacgttcgtttacgtaacttcgtagtacggaccggttcccgtttacgttaacgggtttaacgaaacgggttccgggtaccctaagtacaaagttctacggacggtcggtacgtaggtacggtacgtacggtaacggactaacgttacgttaccacgttaccgtacctaccgtaagtaccgacgtaccgtacgttaccgtaccggtacgtaccgttacgttacggtaacgtttggtttaaccgtttaaccgtaacttttaaccgtttaacggttaccccaagttaacccgtaaacgtttaagtttaaacgtttaacggtttaccgggtttaacgttaccccgggttaaagttaacccgtttaggggttaacccggaaaccgggaacgggggttaaacggttacggtaaccgggtaaaaccgtaaaccggtaaaccgggttacggttaccggggttacggtacccgtaaaccggttccctaaaccgttcgtttaccttacgtttacccgttacgttccccgttaaccccgg

SEQ ID NO: 11270 - DNA, 653 bp, Homo sapiens
  misc_feature: GYAE6OF01D9CUX.9.75.G09.1.454.CMB.1.raw
  modified_base (422)..(422): a, c, t, g, unknown or other
  misc_feature (422)..(422): n is a, c, g, or t
  modified_base (622)..(622): a, c, t, g, unknown or other
  misc_feature (622)..(622): n is a, c, g, or t
  modified_base (631)..(631): a, c, t, g, unknown or other
  misc_feature (631)..(631): n is a, c, g, or t
tcagtgatacgtctcacgaccggtgctcgatttagtatagacatcagggggagtcagacccagtcaggacacagcgtggacatggagggtccccgctcagctcctggggctcctgctgctctggctcccaggtgccaattgtgacatccagatcgaccagtctccttccaccctgtctgcatctgtagggagacagacgtcaccatctcgttggccggacagtacagtatgttacttaggtggtcgcctggtatcagacgaaacgggaaacccgggaactaccccgtaaactcgttagaattctagtacggacggtcccttacggttacggtttaaacaacgggtcgggtaccctatacgaaagtacttacggagccggacgtaggtcgtagtcgtaggacagtaactcactcacaccgtancagcagtctacgcagtacctagtagttacggttacgtttacgaaccttaaacgtttactaccgtacgtaaccctaattaagttaactaaagtttacttaacggtacgttagtaacgttcggttacggaaccggtaacgggtacgaagggtacggtaactaaggaaaacggtaggttggacggtacgtcgaccgtaacctnttaccggtntttcccgtacgtccttaccccg

SEQ ID NO: 11271 - DNA, 682 bp, Homo sapiens
  misc_feature: GYAE6OF01B90LO.9.75.G09.1.454.CMB.1.raw
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
  modified_base (660)..(660): a, c, t, g, unknown or other
  misc_feature (660)..(660): n is a, c, g, or t
tcagtgatacgtctcacgaccggtgctcgatttagtatagacatcgagggggagtcagacccagtcaggacacagcgtggacatggagggtccccgctcagctccgtggggctcctgctgctctcggctccgaggtgaccaattgtgacatccagatcgacccagttcctcccttccacctgtctgactatcgtggtaggganacgagtacgtccactactcttcgtcggccgggtcagtacagtattgttacgttggttggtcgtcgtaggtatcgagacgaacggaaaccgggaactaccctaagtctgtactcgtagngacgtcttacgttaggtaacgaacgggttccggacctatacgtaagtcgtacgacggtcgtacgaggttcggacttacgggacggtaaacaagttaactcgaactccgtaacaaccgtataccgactcgtaacttcggtacgaccgacggttcgtagtaacgtttgttaaacgttttcgaaactttaacgttaactacctaacgtacctaaagtaagttaaactttagtacgttaccgtgggttaacgtaacgttaacgggttacggaaccggtaacgggtaccggtaaggtaacgaacggtaaactaggttccgggagttcgacttacgactacgttnttacgctttctactccgtcccg

SEQ ID NO: 11272 - DNA, 854 bp, Homo sapiens
  misc_feature: GYAE6OF01CMKYJ.9.75.G09.1.454.CMB.1.raw
  modified_base (172)..(172): a, c, t, g, unknown or other
  misc_feature (172)..(172): n is a, c, g, or t
tcagtgatacgtctcacgaccggtgctcgatttagtatagacatcagggggagtcagacccagtcaggacacagcgtggacatgagggtccccgctcagctcctggggctcctgctgctctcggctcccaggtgccaattgtgacatccagatcgaccagtcctcccttccnccctgtctgctagtcgtggtgggagacgagacgtccactagtctcgtcggccggaccgtagtacagtattcggttcgttaggtttgggttcgccgttaggtactacgaggaacggaaacgggaaaacccggggaacctaaccccgtaaactcgtttagacttccgtaagtcggacggttccttacggtttaacggttaaaccggtaacgggtttccgggtaacccctagtaacgtaacgtacggttacaacggccggttacgaggttacggaacgtagggtacggaactaagtaaccttcctaaccttaccttaacccgaacgtaactcgaacgttaccgaccggtttacacggtacccgacggtttaccgtagttaacggttacgtttaactttagttaaccctttaaaccgtttattaccgtaaccgtaacccgtaaaaagttttaaggtttaaactaaaacgtttttaccgtttaaccggttaccgggttaaccggtaacgtttaagggtttaaccccgggaacggtaaaccgggggtaacggttaccgggttaaagggtaaaccgttaaaccggtaaaccgggtacggttcggtaaacggtcccttaacgggaacgttaacccgttacgtttacccggtactttttacccgaacccgtttccccgtttaaacccccgg

SEQ ID NO: 11273 - DNA, 808 bp, Homo sapiens
  misc_feature: GYAE6OF01EEZMI.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtcctccttccaccctgtctgcatcgtggtggggagacaggacgtccacctatcctcgttcggcccgggaccagtcaagtaattggtttcgtttaggttgggttcggtccgttaggtacttaccgaaggaccgaaacggggaaaaacccggggaaaccgtacccccttaaaacgttcttacggaactttcctaagtacggtaccgggtccctttacggtttacgggtttaaacggtaaacgggttccggggttaaccctaagtaaccgtaaaggttacttaccggagggccggtacgtagggttaggtacgtacgttacggggaactaaacggtaacttccgaaccttcctaaccgaacccgtatccgaacgtcgtaacgtctacggaccgacgttacctagtacttaggttaacgttttacgaactttaactttacgttaaccgtacgtaacccgtaataacggttaattaacgttaacgtttaccgttaccggtaagtacgttacggtttaccgggaaccggtaacggggtaccgtaagggtaagggtaaacccgtaacggtaaaacggtacggttaggtacggtacgtaccgtaaccgtaacgttaccgttcggttaaccgttcccttacttacccgttacccccgg

SEQ ID NO: 11274 - DNA, 811 bp, Homo sapiens
  misc_feature: GYAE6OF01BQPC4.9.75.G09.1.454.CMB.1.raw
  modified_base (187)..(187): a, c, t, g, unknown or other
  misc_feature (187)..(187): n is a, c, g, or t
  modified_base (778)..(778): a, c, t, g, unknown or other
  misc_feature (778)..(778): n is a, c, g, or t
  modified_base (789)..(789): a, c, t, g, unknown or other
  misc_feature (789)..(789): n is a, c, g, or t
tcagtgatacgtctcacgaccggtgctcgatttagtatagacatcagggggagtcagacccagtcaggacacagcgtggacatgagggtccccgctcagctccgtgggggctcctgctcgctctggcctcccaggtgcctaattgtgacatccagactcgaccctagtcctcccttcccacccgttntcctgctactcgtggtgggaacgacgagtacgtccacctatctcgttcggaccggcagtcagtattcgttacgtttggttggtcggtccgttaggtactcggacgacggaaacgggtaaaccggggaacctacccttaactcgttagagttcgtagtcgacgttcgttacgttacggttaacgaacgggttcgggaccctaagttaccgtaagttaccgtacgtacggcggacgtacgggttcgggtattacggggtaacggaaacgttaaggtaaccttcctaaccctgttaccccgaacttcttaccggaccttacgttaccggtccgttacggaccttaaccggtccgttaggttaacgttttaggttttaaccgtttacgttaacccgtttaaacgttttaccgtttacccgaaccgttaaacccgtaacgtttaagtaaacgttttaaggttacccgtttaacggtcggttaaaccggttaacggtttacgttacggggttaaacccggggacggtaaccgggttaaggaacggttaccgaaacggaaaccggttggtagacggtacaccgtacccgttacttacnccggttttacncccgtttaacttccgttacccg

SEQ ID NO: 11275 - DNA, 894 bp, Homo sapiens
  misc_feature: GYAE6OF01EDRBC.9.75.G09.1.454.CMB.1.raw
tcagtgatacgtctcacgaccggtgctcgatttagtatagacatcagggggagtcagacccagtcaggacacagcgtggacatggagggtccccgctcagctccgtggggctcctgctgctctggcctcccgaggtcgccaattgtgacagtccagacgtcgaccctagttccttcccttaccacccttgtctgctagtcgtggtagggacacgtaaggacgtaccacctacttccttccgttcgggccccgggtacctaggtaccgtaaggtaagtttcggttttacgtttagggtttcgggttccggtaccgtttagggtaactaccgggaaggaaccggtaaaaccggggaaaaacccggggtaacctaacccccgtttaaaagttcgtttaggaaaccttttacgtaaggtaccgggtaccggtttaccctttcggtttaaaacggggtttaaaccgaacggggttcccggttaaccctaaagtaccggtaaaacggttcttaaccggcggaccggtagtaacggttcgggtaacgtcggtacgggaaactacggttacctccgaccgttcctaacccgtaactaggtaccgaacgtccgtaaggtccgtacgaccggtacgttccgttaagtcgtttaaccggttaagtttaaccggaccctttaaaacgttttaccgaacccgttaacgtaaaccccggttaattaaaaccgttttacgttaacggttttaacgttaccgtaaccgggttaggttaactttaccggggtaaccggaacgggtaaccgggtacggtaaggaacggttaaaacccgtagttaaccgacggttggaccgtaccacggtacctacggttaaccgttcgtagtttccttcgacccgttacccg

SEQ ID NO: 11276 - DNA, 344 bp, Homo sapiens
  misc_feature: GYAE6OF02IAF2U.9.75.G09.1.454.CMB.1.raw
  modified_base (342)..(344): a, c, t, g, unknown or other
  misc_feature (342)..(344): n is a, c, g, or t
tcagtgatacgtctcacgaccggtgctcgatttagtatagacatcaacaccacaaagggagacgccccagggtcgtcatctctgttaattccgatcgccctcagggtctccgaccgcttctctggctccaggtctggcgcctcagcctcctggccatcgctgggctccagcctgaggatgaggctgattatttctgccattcatatgacagtagtctggttgcgtcggtgttcggcggagggaccaagctgaccgtctaagtcagccaaggctgcccccaggtcactctcgttccccgccctcctcagacgtatcactgagcgggctggcaaggcgcatagnnn

SEQ ID NO: 11277 - DNA, 387 bp, Homo sapiens
  misc_feature: GYAE6OF02IUDCR.9.75.G09.1.454.CMB.1.raw
  modified_base (221)..(221): a, c, t, g, unknown or other
  misc_feature (221)..(221): n is a, c, g, or t
  modified_base (353)..(353): a, c, t, g, unknown or other
  misc_feature (353)..(353): n is a, c, g, or t
  modified_base (355)..(355): a, c, t, g, unknown or other
  misc_feature (355)..(355): n is a, c, g, or t
  modified_base (357)..(387): a, c, t, g, unknown or other
  misc_feature (357)..(387): n is a, c, g, or t
tcagtgatacgtctcacgaccggtgctcgatttagtatagacatcaacgacacgaaagggagagcccccagggtcgtcatctctgttaatttccgatcgcccctcagggtctccgaccgcttctctggctccaggtcctggcgccttcgagcctccctggccgtatcgctgggcttccagcctgaggatgaggctgattatttctgccagttcatatgacngtagtctcgttgcgtcgtgttcggcggaggaccaagctgaccgtctaagtcagcccaagactgcccccaggtcactctgttccccgccctcctcagcgtagtcacgtgaggcgggctggcaaggcgcatagnanannnnnnnnnnnnnnnnnnnnnnnnnnnnnnn

SEQ ID NO: 11278 - DNA, 512 bp, Homo sapiens
  misc_feature: GYAE6OF02J3K0C.9.75.G09.1.454.CMB.1.raw
  modified_base (193)..(193): a, c, t, g, unknown or other
  misc_feature (193)..(193): n is a, c, g, or t
  modified_base (249)..(249): a, c, t, g, unknown or other
  misc_feature (249)..(249): n is a, c, g, or t
  modified_base (267)..(267): a, c, t, g, unknown or other
  misc_feature (267)..(267): n is a, c, g, or t
  modified_base (294)..(294): a, c, t, g, unknown or other
  misc_feature (294)..(294): n is a, c, g, or t
  modified_base (321)..(321): a, c, t, g, unknown or other
  misc_feature (321)..(321): n is a, c, g, or t
  modified_base (382)..(382): a, c, t, g, unknown or other
  misc_feature (382)..(382): n is a, c, g, or t
  modified_base (434)..(434): a, c, t, g, unknown or other
  misc_feature (434)..(434): n is a, c, g, or t
  modified_base (445)..(445): a, c, t, g, unknown or other
  misc_feature (445)..(445): n is a, c, g, or t
tcagtgatacgtctcacgaccggtgctcgatttagtatagacatcaggggagtcagacccagtcaggacacagcgtggacatgagggtccccgctcagctcctggggctcctgctgctctggctcccaggtgccaattgtgacatccagatgacccagtctccttccaccctgtctgccattcgtgtgggaanacagtagtcaccatctcgttgccggcaaggtcagaatgttcttagtggtgctggtntcagcagaaaccgggaanccctaaatcttgatctagtgaggcctntggttacaaggtgggtcccagtcaagnttcgagcggtcaggtggactcgtagggacagtaacttcactctacgaccatcagcagttcngcagctgattgatttgactaacttagttactagccaatagtataaatgttanaccgttgactntttcgactaagggccgtagtgacgtagaaacgctgtggcttcgcacctagcctgtacttctattccc

SEQ ID NO: 11279 - DNA, 496 bp, Homo sapiens
  misc_feature: GYAE6OF02GUHLP.9.75.G09.1.454.CMB.1.raw
  modified_base (268)..(268): a, c, t, g, unknown or other
  misc_feature (268)..(268): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaancccctaaaactcttgatctatgaggcctctggtttacaaagtggggtcccatcaagattcagcggcagtggatctgggacagaattcactctcaccatcagcagtctgcagcctgatgtattttgctaacttattactgaccaacagtataatagttatcgtgactatttgccaaggaccgaggtggagtcaaacgaactgtggctgcaccatctgtcttcattcccg

SEQ ID NO: 11280 - DNA, 506 bp, Homo sapiens
  misc_feature: GYAE6OF02F8DSC.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtgggtcccatcaagattcagcggcagtggatctgggacagaattcactctcaccatcagcagtctgcagcctgatgattttgctaacttattactgaccaactagtataatagttatccgtaggactagtttggaccaaagggaccgaggtaggagtacaaacggtaactgtggctgcaccatctgtcttcattcccg

SEQ ID NO: 11281 - DNA, 506 bp, Homo sapiens
  misc_feature: GYAE6OF02GGFVP.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaatcttgatctatgaggcctctggtttacaaagtggggtcccatcaagattcagcggcagtggatctgggacagaattcactctcaccatcagcagtctgcagcctgatgtattttgctaactttattactgccaacagtataatagttatccgtgactatttggaccaagggaccgagggtaggagtacaaacggtaactggtaggctgacacattctgtcttcattcccg

SEQ ID NO: 11282 - DNA, 519 bp, Homo sapiens
  misc_feature: GYAE6OF02GHIK9.9.75.G09.1.454.CMB.1.raw
  modified_base (417)..(417): a, c, t, g, unknown or other
  misc_feature (417)..(417): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaaactcttgatctatgaggcctctggtttacaaagtggggtcccatcaagattcagcggcagtggatctgggacagaattcactctcaccatcagcagtctgcagcctgatgtattttgactaactttattactgacctaaanagtaattaattagttatccgttaggactatttagggaccaaagggaccgagggtaggaagtacgaaacggaactggtggctgcacatctgtcttcattcccg

SEQ ID NO: 11283 - DNA, 507 bp, Homo sapiens
  misc_feature: GYAE6OF02FJNU0.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtaccaattgtgacatccagatgacccagtctccttccaccctgtctgcatctgtgggagacagagtcaccatctcttgccgggccagtcagaatgttcttagtggttggcctggtatcagcagaaaccgggaaagccccctaaatcttgatctatgaggcctctggtttacaaagtggggtcccatcaagattcagcggcagtggatctgggacagaattcactctcaccatcagcagtctgcagcctgatgtattttgctaactttattactgaccaacagtataatagttatccgtgactatttcggaccaagggaccgagggtaggaagtacgaaacgacgtgtggctgcaccatctgtcttcactcttcccg

SEQ ID NO: 11284 - DNA, 565 bp, Homo sapiens
  misc_feature: GYAE6OF02H7TFV.9.75.G09.1.454.CMB.1.raw
  modified_base (259)..(259): a, c, t, g, unknown or other
  misc_feature (259)..(259): n is a, c, g, or t
  modified_base (397)..(397): a, c, t, g, unknown or other
  misc_feature (397)..(397): n is a, c, g, or t
  modified_base (405)..(405): a, c, t, g, unknown or other
  misc_feature (405)..(405): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgttctagttgtgctggtatcagcagaaccggggaaancccctaaactcttgatctatgaggcctctggtttacaaagtggggtcccatcaagattcagcggcagtggatctgggacagaattcactctcaccatcagcagtctgcagcctgatgtattttgctaacttatttacngacctaanagtaataattagtttaatccgtaggacctaagttttcggacccgtaaaggggacccgtaagggtagggaaagttaccgaaaacggaacttacgggtacgggacctttacgggacctacccgtaagttcccttaggtttacctttaccgattttacccccg

SEQ ID NO: 11285 - DNA, 510 bp, Homo sapiens
  misc_feature: GYAE6OF02HGMJT.9.75.G09.1.454.CMB.1.raw
  modified_base (190)..(190): a, c, t, g, unknown or other
  misc_feature (190)..(190): n is a, c, g, or t
  modified_base (411)..(411): a, c, t, g, unknown or other
  misc_feature (411)..(411): n is a, c, g, or t
  modified_base (506)..(506): a, c, t, g, unknown or other
  misc_feature (506)..(506): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctcttgccggccagtcagaatgttctagttggttggcctggtatcagcagaaacctgggaaagcccctaaactcttgatctatgaggcctctggtttacaaagtggggtccatcaagattcagcggcagtgatctgggacagaattcactctcaccatcagcagtctgcagcctgatgtattttgactaactttattactgacctaanataataatagttattccgtaggtactatttggaccgaagggaccgaggtggaagtacgaaacggtactaggtggtctgcacctatctcgttcttntacg

SEQ ID NO: 11286 - DNA, 491 bp, Homo sapiens
  misc_feature: GYAE6OF02HF25A.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaaactcttgatctatgagacctctggtttacaaagtggggtcccatcaagattcagcggcagtggatctgggacagaattcactctcaccatcagcagtctgcagcctgatgattttgctaacttattactgccaacagtataatagttatcgtgactatttgcaaggaccgaggtggagtcaaacgaactgtggctgcaccatactgtcttcatcc

SEQ ID NO: 11287 - DNA, 513 bp, Homo sapiens
  misc_feature: GYAE6OF02JTTXI.9.75.G09.1.454.CMB.1.raw
  modified_base (189)..(189): a, c, t, g, unknown or other
  misc_feature (189)..(189): n is a, c, g, or t
  modified_base (278)..(278): a, c, t, g, unknown or other
  misc_feature (278)..(278): n is a, c, g, or t
  modified_base (354)..(354): a, c, t, g, unknown or other
  misc_feature (354)..(354): n is a, c, g, or t
  modified_base (499)..(499): a, c, t, g, unknown or other
  misc_feature (499)..(499): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctcttccgacctgtctgcatctgtggganacagagtcaccatctcttgccggcagtcagatgtctagtgtgctggtatcagctagaacggagccctaactctgatctatcgtagcctntggttacaaggtcggggtcccagtcaagtagttcagcggtcagtggactcgcggacagaacttcacgtctacaccntcagcacgtcgtgcagcctgactgtactttcgactacttagtctagcctactagtactaatacgttactccgtagtactagtttcgacgtaacgggcgtaggtacgagtacgaacgtaacgtgtacggcgtacgcacctatcgtntacgttcacgttcc

SEQ ID NO: 11288 - DNA, 667 bp, Homo sapiens
  misc_feature: GYAE6OF02J3N1M.9.75.G09.1.454.CMB.1.raw
  modified_base (636)..(636): a, c, t, g, unknown or other
  misc_feature (636)..(636): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatcgacccagtcctccttccaccctgtctgcatctgtgggagacagagtcaccatctcttcgccgggcagtcagatgttcttagttggtgcctggtatcagcgaaggaaaccgggaacgtacccctaaatcttagactcgtatgacgtccttacgtaggttaacgaaggtcgggtacccagtacgaagtacgttcgaggcggtacgtaggtggtacgtcgtagggacagtaacttcgactccgtaccactagtacacgtctacgtctagcctacgtccttagtacgtttcgttaactttacggaaccttaactttacttaccgtacgtaaccctaaagttaacgtttaactttaaagttacgtttaccgttaccggtaacgtaaccgttacggttaaccggaaccggtaaacgggtaccgggtaaggtaacgggttaacgtaccgtaaacggtaacgttcggtacggtacgtccgactaacccgtnttaccgttactaccgttactaccgttccccg

SEQ ID NO: 11289 - DNA, 521 bp, Homo sapiens
  misc_feature: GYAE6OF02GRSPT.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaaggtgggtcccatcaagattcagcggcagtggatctgggacagaattcactctcaccatcagcagtctgcagcctgatgtattttgactaactttattactcgacctaaacagtaattaattagttaactccggtagactagtttcggacctaagggaccgaggtaggagtacgaaacgtacgtgtggctcgcacctattctgtcttcattcccg

SEQ ID NO: 11290 - DNA, 671 bp, Homo sapiens
  misc_feature: GYAE6OF02I6CMD.9.75.G09.1.454.CMB.1.raw
  modified_base (267)..(267): a, c, t, g, unknown or other
  misc_feature (267)..(267): n is a, c, g, or t
  modified_base (297)..(297): a, c, t, g, unknown or other
  misc_feature (297)..(297): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagatgttcttagttgtttggcctggtatcagcaagaaaccggggaanacccctaaactcttgactctatgaggcctntggttaacaaggtcggggtaccagtcaagtattcgagcggcagtggatcgtggaacagattcactctcacatcagctagtctgacagcctgtatggtattttcgacttaactttaattacctacgtacctaaacgtagttaacgttaaagttacgtttaacgttaccggttaggtaaacgttacgttttacggggaacccgtaaacgggggtaacccgggttaaggggttaaccgggtaaacgggttaaccgtaaaaaccggggtaaccgtttacggggttacgggtaaacccgtttacgggtaaccccttaacccggtaacgtttacccgggtttacggtttaccccgttttacgtaccgttttaacccccgg

SEQ ID NO: 11291 - DNA, 543 bp, Homo sapiens
  misc_feature: GYAE6OF02ITVHY.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccacctgtctgcatctggtgggagacagagtcaccatctctgccggcagtcagatgtcttagttggtgcctggtatcagcagaaaccgggaaagcccctaaactcttgatctatgaggcctctggtttaacaaaggtcggggtcccatacaagtattcagcggcaggtggacttcgtggggacaggtaattcgactctacaccatcagcagtctgcagcctgatgtattttgactaacgttattactcgacctaaactagtaattaagtagtttaacttccggtagtactagtttcggaccgaagggaccgagggtaggagtacgaaacgtacgtaggtggtactgacaccgtattcctgtaccttcgacttacccg

SEQ ID NO: 11292 - DNA, 526 bp, Homo sapiens
  misc_feature: GYAE6OF02HKKPJ.9.75.G09.1.454.CMB.1.raw
  modified_base (189)..(189): a, c, t, g, unknown or other
  misc_feature (189)..(189): n is a, c, g, or t
  modified_base (257)..(257): a, c, t, g, unknown or other
  misc_feature (257)..(257): n is a, c, g, or t
  modified_base (367)..(367): a, c, t, g, unknown or other
  misc_feature (367)..(367): n is a, c, g, or t
  modified_base (400)..(400): a, c, t, g, unknown or other
  misc_feature (400)..(400): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccacctgtctgcatctgtggganacagagtcaccatctcttgccggcagtcagatgttctagttggtgctgatcagcagaaaccgggaacnccctaaactcttagatctatgagcctctggttacaaggtgggtccatcaagtattcgagcggcaggtggatcgtagggacagtaattcactctacactactcagcagtcngcacgctagattgtatttgactaacttattacngacaatagtaataattagttataccggtagtaactagttacggaccgaagggaccgtagggtaggaagtacgaaacggtactggtcggtctacgactaccagtccgttagttccttacacttcccg

SEQ ID NO: 11293 - DNA, 574 bp, Homo sapiens
  misc_feature: GYAE6OF02GMTCF.9.75.G09.1.454.CMB.1.raw
  modified_base (141)..(141): a, c, t, g, unknown or other
  misc_feature (141)..(141): n is a, c, g, or t
  modified_base (294)..(294): a, c, t, g, unknown or other
  misc_feature (294)..(294): n is a, c, g, or t
  modified_base (319)..(319): a, c, t, g, unknown or other
  misc_feature (319)..(319): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgngacatccagatgacccagtcctccttccaccctgtctgcatctgtgggagacagagtcaccatctctgccggcagtcagatgttcttagttggtggcctggtatcagcgaagaaaccggggaaacgcccctaaactcttgatctatgagcctntgttacaagtgggtccatacaagtnttcagcgcagtggatcgtggaacagaactcactctcacatcagctgtctgcagtcctgatgtactttagaccttaagtttactacgtacgacctaaatagttaaattaaagttagtttaacgtccggttagaacgtacgtttggaacccgtaaagggtaccgtagggtacggtaagtacgaaaacggtaacgttagggtacggacgttacggacctaacccgtattcccgttagttcccttagtaccttaccccg

SEQ ID NO: 11294 - DNA, 612 bp, Homo sapiens
  misc_feature: GYAE6OF02HFEJV.9.75.G09.1.454.CMB.1.raw
  modified_base (189)..(189): a, c, t, g, unknown or other
  misc_feature (189)..(189): n is a, c, g, or t
  modified_base (241)..(241): a, c, t, g, unknown or other
  misc_feature (241)..(241): n is a, c, g, or t
  modified_base (256)..(256): a, c, t, g, unknown or other
  misc_feature (256)..(256): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccacctgtctgcatctgtggganacagagtcaccatctcttgccggcagtcagatgttctagttggtgctgtatnagcagaaccgggaancccctaaatctgatctatgaggctctggttacaaggtgggtccatcaagtattcagcggcaggtgatcgtgggacagtaattcactctacaccatcacgctagtcgtacgacacgtcctaggacttggtacttttcgaccttaaacgtttacttacctacggacctaaactacggttaattaacgttaacgtttacgtaccggttaggtaaccttagttttacgggaaccgtaaacggggtaccgtagggtacggtaacgttacgaaaaccggtaacgttacggttacggtaccgttacggaccctaaccggtacttcccggtttagtttaccctttacgtaaccgttttccccgg

SEQ ID NO: 11295 - DNA, 571 bp, Homo sapiens
  misc_feature: GYAE6OF02F2HX7.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagtggttgcctggtatcagcagaaaccgggaagcccctaaactcttgatctatgagtcctcgtggtttacaaagtggggtcccagtcaagtattcagcggcagtggatcgtgggacagaattcactctcacatcagctagtctgcagcctgatgtattttgctaactttattactcgacctaagattataattacgttacgtccgtagtaactagttttcgggacccgtaaagggtaccgaagggttacgggaacgtaaccgtaaacggtaacgttacggtcgggaccttacggaccgtaccgttacttacggttcgttccgtttacctaactttccccg

SEQ ID NO: 11296 - DNA, 541 bp, Homo sapiens
  misc_feature: GYAE6OF02H4LO7.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccggcagtcagatgttcttagtggttggctggtatcagcagaaaccggggaaagcccctaaactcttgatctatgaggcctctaggttacaaaggtggggtacccatcaagtattcagtcggcaggtggatccgggacagaattcactctcacatcagcacgtctgcagcctagattgtatttcgacttaactttattactgaccaactagttaataattagttacgttaccggtaggtacttagtttacgggaccgaaaggggacgtagggtaggaacgtacgaaacgacgtggtggctagaccactatcgtgttcttctactcttccccg

SEQ ID NO: 11297 - DNA, 559 bp, Homo sapiens
  misc_feature: GYAE6OF02HKZAS.9.75.G09.1.454.CMB.1.raw
  modified_base (190)..(190): a, c, t, g, unknown or other
  misc_feature (190)..(190): n is a, c, g, or t
  modified_base (264)..(264): a, c, t, g, unknown or other
  misc_feature (264)..(264): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtggganacagagtcaccatctctgccggccagtcagatgttcttagttggtgcctggtatcagcaagaaaccggggaacncccctaaactcttagatctagtgacgtcctcgttggtttaacaaggttcggggtaccctatacgaagtacttacgaggcggcgaggtggatcgtagggactaagtaattactactctaccacctatcagctagtctgcagtcctgattacgttatttcgacttaactttattacctacgacctaatagtaattaattacgttactaccgtagtacttagttacggacgaaggtaccgaggtagacgtacaaacggtagtggtagcgtacgacactctcgttgtacttcattcccg

SEQ ID NO: 11298 - DNA, 569 bp, Homo sapiens
  misc_feature: GYAE6OF02G52OL.9.75.G09.1.454.CMB.1.raw
  modified_base (244)..(244): a, c, t, g, unknown or other
  misc_feature (244)..(244): n is a, c, g, or t
  modified_base (370)..(370): a, c, t, g, unknown or other
  misc_feature (370)..(370): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctctgccggcagtcagatgttcttagttggttgctggtatnagcaagaaccgggaagacccctaaactctgatctagtagaggtcctgtcggttacaaggtcgggtacccatacgaagtattcgagtcggctagtggatcgtggacagtattacactctacacctancagcagtcgtcgcacgctagatgttagtttagacttaacttagttactcgaccaactaagttaattaacgttagttactcggtagtacgttagtttcggaccgtaaagggaccgtaagggagtaacgtacgaaacggtacgtaggtacgtcgtagaccgtaacttacgttaccgtcgtttaccttaccgactttccccg

SEQ ID NO: 11299 - DNA, 518 bp, Homo sapiens
  misc_feature: GYAE6OF02ING7E.9.75.G09.1.454.CMB.1.raw
  modified_base (262)..(262): a, c, t, g, unknown or other
  misc_feature (262)..(262): n is a, c, g, or t
  modified_base (331)..(331): a, c, t, g, unknown or other
  misc_feature (331)..(331): n is a, c, g, or t
  modified_base (403)..(403): a, c, t, g, unknown or other
  misc_feature (403)..(403): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccacctgtctgcatctgtgggagacagagtcaccatcctcttgccgggcagtcagatgtcttagttggtgcctggtatcagcagaaaccgggaacncccctaaactctgatctatgaggtcctcgtggtttacaaaggttcgggtacccatcaagtattcagcgnagtggatcgtgggacagtaattcactctcacatcagcagtctcgcagcctgatgtatttcgacttaactttntaacctcgaacctaatataattaagttagttactccgtagacttagttcgaacgagggacgaggtagagtacaagtcgtagtacggctagaccactattcgtatcttacatcccg

SEQ ID NO: 11300 - DNA, 586 bp, Homo sapiens
  misc_feature: GYAE6OF02HN2K0.9.75.G09.1.454.CMB.1.raw
  modified_base (190)..(190): a, c, t, g, unknown or other
  misc_feature (190)..(190): n is a, c, g, or t
  modified_base (286)..(286): a, c, t, g, unknown or other
  misc_feature (286)..(286): n is a, c, g, or t
  modified_base (344)..(344): a, c, t, g, unknown or other
  misc_feature (344)..(344): n is a, c, g, or t
  modified_base (419)..(419): a, c, t, g, unknown or other
  misc_feature (419)..(419): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctggtgganacagagtcaccatctcttgccggcagtcagaatgttcttagttggttgcctggtatcagcgaagaaaccggggaacgcccctaaatcttgatctangaggtcctcgttaggtttaacaaggttcggggaccctagtcaagtattcgaggcggtnaggtggatcgtaggacagattcactctacacatcagcagtctgcagcctgattgtatttgacttaattacttacncgaaccaacgtattaacttaaattagttacgtaccggtagtaacttacggttacggaacccgtaaaggggtaaccgtaggggtacgtaaggttacccaaaacggtagtcggttacggaccttacggacctaaccgtacttccgtggttaccttacgtacttaccccg

SEQ ID NO: 11301 - DNA, 632 bp, Homo sapiens
  misc_feature: GYAE6OF02IR4V5.9.75.G09.1.454.CMB.1.raw
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatcctcttcggccggcagtcagatgttcttagttggtggcctggtatcagcgaaggaaaccgggaacacccctaaatctagactctagtggacggtcttcgtaggttaacgaagggtcgggtcctagtacgaagtcttcgagcgacagtggatcgaggactagtattcactcacaccatcagcctagtctacgcacgtcctgtactgttatttacgaccttaagtttacttaccgtccgaacctaaacgtagttaaattaaacgttagtttaaccgtacccgggttagggtaacccttttaggttaccggggaaacccgtaaaggggtaccggtaaggggttacggtaacgtaaccggtaaaccgtaaggttacggcggtaccgtacgaccgtaacctagttccgtacgttccgtttaccacgtttccccg

SEQ ID NO: 11302 - DNA, 715 bp, Homo sapiens
  misc_feature: GYAE6OF02I2SG1.9.75.G09.1.454.CMB.1.raw
  modified_base (118)..(118): a, c, t, g, unknown or other
  misc_feature (118)..(118): n is a, c, g, or t
  modified_base (141)..(141): a, c, t, g, unknown or other
  misc_feature (141)..(141): n is a, c, g, or t
  modified_base (531)..(531): a, c, t, g, unknown or other
  misc_feature (531)..(531): n is a, c, g, or t
tcagtgatacgtctcacgaccggtgctcgatttagtatagacatcaggggagtcgagacccagtcaggacacagcgtggacatgaggtcccgctcagctcctgggctcctgctgctcnggctcccaggtcgcctaattgtnactatccagatcgacccagtcctccttccacccttgtcctgacattctggtaggacgacaggacgttccaccattccgttcgttcggcccggaccaggttcaaggtaattcgtttacttaggttgggttcgtccgttaggtacttcgagtacgaacggtaaaccggggaaccgtacccgtaactacgttacggtacttcgtagtacggacggtccttcgttaggttaaccgtaaggttccgggtaccctagtaccgaagtcgttacgagcgtacgtaggtacgacttcggacgacgtaagacgtctacgtcactaccactacacgactacgttcgactacgacgtaccttagtaactggttactttacgactttaaacgttctttaaccncggtaaccaacgttaagttaactacgttaaacgtttacgtacccgtaagttaacgtttacgtacggttaaccggaagggttaaccgtagggtacggtaacgtaaccgtaaacggttacgggttaccgtaagggtccctaacggaccttacggtacttcgttacgtaccttacttaccgttcccg

SEQ ID NO: 11303 - DNA, 736 bp, Homo sapiens
  misc_feature: GYAE6OF02JB3VN.9.75.G09.1.454.CMB.1.raw
  modified_base (494)..(494): a, c, t, g, unknown or other
  misc_feature (494)..(494): n is a, c, g, or t
  modified_base (725)..(725): a, c, t, g, unknown or other
  misc_feature (725)..(725): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatcgacccagtcctccttccaccctgtctgctattcgtggtgggagacagagtccacctatcctcgttcggcccgggccagtcagtaattcgtttcgttaggttggttcggcccgttggtacttcgagtcgaaacgggaaaacccgggggaaacgtacccccttaaaactcttaggaattaccgttaagtacggtacgtcccttacgttacggtttaacgaaaggtccggggtaccctagtacgtaaagtacttacggtacggccggtacgtaggttaggtaacgttacggtcggggaaactaagtaacttccgtaccttcctaaccgaaccctataccgtacncgtaacgttccgtacgaccgacgtccgttagtacttaggttaacgttttacgacttaaactttacgtttacgtacgaccctaaataaccgttaataaacgtttacggttactaccgggtagttaactacggttttaccgaacggaaacggggtacgacggggtaacgtacgtaaacgaacggtaacggtcggtacggtctacgacgtacctacgttcgttctccggtttanaccctttcccg

SEQ ID NO: 11304 - DNA, 646 bp, Homo sapiens
  misc_feature: GYAE6OF02IL7HJ.9.75.G09.1.454.CMB.1.raw
  modified_base (192)..(192): a, c, t, g, unknown or other
  misc_feature (192)..(192): n is a, c, g, or t
tcagtgatacgtctcacgaccggtgctcgatttagtatagacatcaggggggagtcagacccagtcaggacacagcgtggacatgagggtccccgctcagctcctggggctcctgctgctctggctcccaggtgccaattgtgacatccagatgacccagtctccttccaccctgtctgcatcgtgtggganacagagtcaccatctcgttcggccgggccagtcaagtaattgttctttaggttggttggccttggtatcagcgaaggaaaccggggaaacacccctaaaacttcgttagattactagtcgaggtccttcgttacggtttaacaaaggttcggggtaccctaagtacgaaagtacttacgaggtaccggagtacggtaggacttcgtagggaacaagtaaacttcgactcctacacctatacgagacctagttctacgccagtccgttagagttagttacgttttacgacttaaactttacgttactaccgaactaaacgtattaataaattacgttacttcggtagtacttagtttacgaccggtaaaggaccgtaagggtacgaacgtaacgaacggtaacttggacgtacgtacgacgtaccagtttccgtagtctttaccacgtttccccg

SEQ ID NO: 11305 - DNA, 854 bp, Homo sapiens
  misc_feature: GYAE6OF02F58F5.9.75.G09.1.454.CMB.1.raw
tcagtgatacgtctcacgaccggtgctcgatttagtatagacatcagggggagtcagacccagtcaggacacagcgtggacatgagggtccccgctcagctccgtggggctcctgctgctctggctcccaggtgccaattgtgacatccagatgacccagtcctccttccaccctgtctgcatcgtggtgggagacagacgtcacctattcctcgttcggcccgggcctagtcaagtaattgtttacttaggtttgggttcggtccttggtactcgagtacgaacgggaaaaccggggaaactacccccttaaaacttcgttagacttctaagtcgggacggtccttacggttacggtttaacgaagggttccgggtaccctagtacaagtacttcgaacgtccggacgtaggtaggactttacgggtacggggtaactaacggttaaactttccgtaaccgttaccttaacccgaaccgtaacgtaccgaacggtacgtaccggttaccgtaccggtaccgtaacggtcccgttaaggttaacgtttacggtttaaccgtttttaccggtaaccttttaaaacctttaacgtttacccgttaacccgtaaaccctaaaacggtttaaccgtttaaaatttaacggtttacggtttacggttacccgggtttaacgggttaactttccgggtttaacgggaacccggtaaacgggggtacccggttaagggggttaaccggttaaaccgtaaccgggtaaaccggttacggttaccgggtacgggtacctacggtaaccctaccggtacgtttaccgtttccggttacctttaaccgttcccgttaacccccgg

SEQ ID NO: 11306 - DNA, 635 bp, Homo sapiens
  misc_feature: GYAE6OF02F8WFV.9.75.G09.1.454.CMB.1.raw
  modified_base (189)..(189): a, c, t, g, unknown or other
  misc_feature (189)..(189): n is a, c, g, or t
  modified_base (262)..(262): a, c, t, g, unknown or other
  misc_feature (262)..(262): n is a, c, g, or t
tcagtgatacgtctcacgaccggtgctcgatttagtatagacatcagggggagtcagacccagtcaggacacagcgtggacatgagggtcccgctcagctcctggggctcctgctgctctggctcccaggtgccaattgtgacatccagatgacccagtctccttccaccctgtctgcatctgtggganacagagtcacgatctctgccgggcagtcagatgttcttagttgggtgcctggtatcagcaggaaaccgggaancccctaaatctagatctatgacggtcctcgttaggtttaacaaaggttcggggtacccatcgaagtattacgagcggacaggtggtactacggtgggaacaggtaacgtttacacgttctaccaaccgtatacacgtcgtagtccgttgctacggtcctagtattagttatttacgaccttaagtttacttacgtacgtaaccgtaacttagttaattaagttaacgtttaacgtccggttagtacgttaagtttacggggaaccggaaacggggtaaccgtagggttacgggtaacgtaacgaacggttaacgtaggttcgggaacttcggacctacctaacgttcttacgttaccgttactccgttacccg

SEQ ID NO: 11307 - DNA, 495 bp, Homo sapiens
  misc_feature: GYAE6OF02FSW1L.9.75.G09.1.454.CMB.1.raw
  modified_base (408)..(408): a, c, t, g, unknown or other
  misc_feature (408)..(408): n is a, c, g, or t
  modified_base (489)..(490): a, c, t, g, unknown or other
  misc_feature (489)..(490): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgagcctctggttacaaagtgggtcccatcaagattcagcggcagtggatcgtgggacagaattcactctcaccatcagcagtctgcagcctgatgtatttgctaatttactactgccaanatataatagttatccgtagactagtttgcctaagggaccgagggtcgagtacgaacgactaggtgctgcacatctgtcttnnttccg

SEQ ID NO: 11308 - DNA, 761 bp, Homo sapiens
  misc_feature: GYAE6OF02G2QFY.9.75.G09.1.454.CMB.1.raw
  modified_base (191)..(191): a, c, t, g, unknown or other
  misc_feature (191)..(191): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttccaccctgtctgcatcgtgtggganacagacgtcaccatctcttcggccggccagtcagaattgttcttaggttggttcggccttggtatcgagacgaacggaaaccggggaacacccctaaatcttagatctagtggacggtcctcgtaggtttaacgaaacggttcggggtaccccaagtaccgtaagtacttcgacggtcggcctaaggttggacttcggtacggggaactaaggtaactttccgacgttacctaccgtaaccacgttaccaacgtcgtaaggttccgtacggacctacggtccttaggtaacttcggttaacttttacggaacctttaaacgttttaacgtttaaccgttacccgtaaacctaaacgttaaacgtttaaacgttaaacgtttaacggtttaacgttaccgggtaaggttaaaccttacgggttttaacgggaacccgggtaaacgggtaaccggtacggggtaacggtaaccggttaccgtaaaaccggtacggttacggttacggtaccgttaccggaccctaaccgttacgttaccgttaccggttacccttcctacgtttacccccgg

SEQ ID NO: 11309 - DNA, 783 bp, Homo sapiens
  misc_feature: GYAE6OF02H9KSN.9.75.G09.1.454.CMB.1.raw
  modified_base (95)..(95): a, c, t, g, unknown or other
  misc_feature (95)..(95): n is a, c, g, or t
  modified_base (195)..(195): a, c, t, g, unknown or other
  misc_feature (195)..(195): n is a, c, g, or t
  modified_base (271)..(271): a, c, t, g, unknown or other
  misc_feature (271)..(271): n is a, c, g, or t
  modified_base (765)..(765): a, c, t, g, unknown or other
  misc_feature (765)..(765): n is a, c, g, or t
tcagtgatacgtctcacgaccggtgctcgatttagtatagacatcagggggagtcagacccagtcaggacacagcgtggacatgagggtccccgntcagctcctggggctcctgctgctctggctcccaggtgccaattgtgacatccagatcgacccagtccttcctccgaccctgtctgctactctgtggganacagacgtcaccatcctcttcgccgggcctagtcgagtaacttggtttacttaggttggttcggtccctaggtacncgtacgagaaccggaaaccgggaacgtacccctaaacgttcgttagtaaccgttactaagttcggaacggttccccgttaacgttacgggttttaaccgaaacgggttcccggggttacccaagttacgaacgtaacttacgacggccggacgtaacggtacgtaacgttcggtaacgggtaacctaagttaacgttacccacgttaccctacgaacccgtagtacaccgtcgttaacgtcgtacggtaccgtaacgtcccgtaggttacgttacgttaacggttttaccggacttaaaccgtttagttacccggtactaaaccgttaaacggtaatttaaaaccggttagttttaaacgtaccgtttcccgggaagttaccgtttaggttaacccgggaaccgttaaagggaacccgttaaggttacggtaaccgtaaacggtaccggaagttcggcgtacgttaaccgacctacgttacggtcgttaccgtntttaccgatttcccccgg

SEQ ID NO: 11310 - DNA, 748 bp, Homo sapiens
  misc_feature: GYAE6OF02I3ZEF.9.75.G09.1.454.CMB.1.raw
  modified_base (190)..(190): a, c, t, g, unknown or other
  misc_feature (190)..(190): n is a, c, g, or t
  modified_base (228)..(228): a, c, t, g, unknown or other
  misc_feature (228)..(228): n is a, c, g, or t
  modified_base (244)..(244): a, c, t, g, unknown or other
  misc_feature (244)..(244): n is a, c, g, or t
  modified_base (247)..(247): a, c, t, g, unknown or other
  misc_feature (247)..(247): n is a, c, g, or t
tcagtgatacgtctcacgaccggtgctcgatttagtatagacatcagggggagtcagacccagtcaggacacagcgtggacatgagggtccccgctcagctcctggggctcctgctgctctgctcccaggtgccaattgtgacatccagactcgacccagtctccttccacctgtctgcatcgtgtgganacagagtcactatctctcgccggacagtcagatcgttnttagtggtgcgtgtancgngacgaacggaaaccgggaacacccctaatctagtactcgtagtcggtacgtcttacgttacggttaacgtaacgggtcgggtaccctagtacgtaactacgttacgaacgtcggtacgtacggttagggtacttccggacgggaacttaaccgtaacgtttacccgtaaccttacctaaccgtaaccgtacgtacccgtaaacggtaccgttaccgttccgtaccggtactacccggttaccgtaacggtacgtttacgtttaacgttttaccgaaccttttaaacgtttacctaccggttaacctaaaaccgtaacgttaaggtttaaaccttaaagtttaaccgggtttacggttaccgtacggttaagtttaaccgttacggtaaccgggtaaacggaacgggttagggaacggtaacgtaacggtaacggtacggtcgttacggaccttaccggacctaacgttcgtttaccgttcgtccgttacctcgttaccccg

SEQ ID NO: 11311 - DNA, 651 bp, Homo sapiens
  misc_feature: GYAE6OF02I6057.9.75.G09.1.454.CMB.1.raw
  modified_base (328)..(328): a, c, t, g, unknown or other
  misc_feature (328)..(328): n is a, c, g, or t
  modified_base (334)..(334): a, c, t, g, unknown or other
  misc_feature (334)..(334): n is a, c, g, or t
tcagtgatacgtctcacgaccggtgctcgatttagtatagacatcagggggagtcagacccagtcaggacacagcgtggacatgagggtccccgctcagctcctggggctcctgctgctctggctcccaggtgccaattgtgacatccagatgacccagtctccttcaccctgtctgcatctgtgggagacagagtcaccatctctcggccggccagtcagattgttcttagttggttcgctggtatcagcaacggaaaccgggaacaccctaactctgatctatgtacgtctcttaggttaacaaggttcgggtaccagtacaagtnttacgnggtaccgggtactaggtcggattcggtacggggtaactaaggtaactttccaaccttcctaccgaacctatccgagtcctagtctcgtacgaccggtcgtacgtagttacgttactttacgtaccttaaacgtttacgtttacgtacgtaacctaaacgtaagtttaattaacgttaacgttacgttaaccgtaggtaacttacgtttacggaccggtaacgggtaacggtagggtaacgtaacggtacgaaaggttacgtacggtacggcgttacgacgtaactcggttaccgttcgtaccttactacgttacccg

SEQ ID NO: 11312 - DNA, 862 bp, Homo sapiens
  misc_feature: GYAE6OF02FOL3L.9.75.G09.1.454.CMB.1.raw
  modified_base (152)..(152): a, c, t, g, unknown or other
  misc_feature (152)..(152): n is a, c, g, or t
  modified_base (246)..(246): a, c, t, g, unknown or other
  misc_feature (246)..(246): n is a, c, g, or t
tcagtgatacgtctcacgaccggtgctcgatttagtatagacatcgagggggagtcagacccagtcaggacacgagcgtggacatggagggtccccgctcagctccgtggggctcctgctgctctacggcctcccgaggtcgaccaagttgngaactactcctagatcgacccagtcctccttaccaccctgtcctgctatcgtggtgggaagacaggtactcacctatctcgtcgccggcacgtnacggtattcgttacgttggtttcgggttcgccgtggtactacgaacgcgtaaacggggaaaaccggggtaaccacccccgttaaaacgttcgttaacggtacttacgttacgtacgggtaacccgtctttacgttaacgggttaaaccgaacgggtttccgggtacctaacgtacgtaaacggacgtttacgagggccggtacgtaggtcggtaccgttacgggacggggaattaccgtaaggttttcccaaccggttttacccaccgttaaaccgcggttaacccgtagggtccttaacggtaaccggttccggtaaccgtaacggtacccggttaggtaaccgttttacggtttacggtttaacgtaaccgtttaacggttttaaccttaaggttaacccgttaaacctaaagggttaaacgttaaacgtaagttttaacgttaccggtacggttaacgttacggttacggtttaccgggtaaacgggtacggtaaccgggtagggttaaccggaacggttacgtaaaaccggtgggttaccggtaccggtcgtaaaccggacgttacccttaggttacccggtttacttcccggtacgtttacccgttccccg

SEQ ID NO: 11313 - DNA, 671 bp, Homo sapiens
  misc_feature: GYAE6OF02FOBIW.9.75.G09.1.454.CMB.1.raw
  modified_base (141)..(141): a, c, t, g, unknown or other
  misc_feature (141)..(141): n is a, c, g, or t
  modified_base (193)..(193): a, c, t, g, unknown or other
  misc_feature (193)..(193): n is a, c, g, or t
  modified_base (451)..(451): a, c, t, g, unknown or other
  misc_feature (451)..(451): n is a, c, g, or t
  modified_base (474)..(474): a, c, t, g, unknown or other
  misc_feature (474)..(474): n is a, c, g, or t
tcagtgatacgtctcacgaccggtgctcgatttagtatagacatcagggggagtcagacccagtcaggacacagcgtggacatgagggtcccgctcagctcctggggctcctgctgctctggctcccaggtgccaagttgngacatccagactgacccagtcctccttccaccctgtctgcatctggtggganacgagacgtcactatctcttcggccggcagtacataattcgttactttagttggttcgcgttaggtatcgagacgaacggaaaaccggggtaactaccccgtaaatcgttagactctagtggacgtcctacgttaggttaacgtaaggtcgggtaccataacgagtacgttcgacgtcggacgtgtggtactcggtacgggaactaaggtacttaccgacttaccgtaccacgtataccgacggactcgtctacgganccgtacgttagattgtactttanacttaacttctacgctaacgtaatacgttaaataaggtttacgtaacgttcggtaacgttacgttaacgttaccgggaaccggtaagggaccgtaagggttacgtaaccgtaacggtaaccggtaggttaccggcggtaccgtaacgtcccggaacttacggttaccgttaccggtctttacgtccctttaccccgg

SEQ ID NO: 11314 - DNA, 727 bp, Homo sapiens
  misc_feature: GYAE6OF02IQKXG.9.75.G09.1.454.CMB.1.raw
  modified_base (136)..(136): a, c, t, g, unknown or other
  misc_feature (136)..(136): n is a, c, g, or t
  modified_base (459)..(459): a, c, t, g, unknown or other
  misc_feature (459)..(459): n is a, c, g, or t
tcagtgatacgtctcacgaccggtgctcgatttagtatagacatcagggggagtcagacccagtcaggacacagcgtggacatggagggtccccgctcagctccgtggggctcctgctgctctggctcccaggtcnccaattgtcgactatccagtatgacccagtcctccttccacctgtctgactatcgtggtggacacagacgtcacctatcgtcgtcggccggctagtcagtatgttacgttgttcggtcgtcctggtactacgagtaccgaacgggaaacccggggtaactaccccgttaaacgttcgttacgtaagttacgtacgtacgggtaccgtcccttacggtttacgggtttaaccgtaaaggttcccgggtaaccctaagtacgaacgttacgttacgacgtcggcgtaggtcggtactcgggtacgacgtagtacttccaactccnctaacctgacctacggtctacgtctacgactacgtcctagtactacgttacgttatacctaactttacgtaccgtcgtaaccgtaagtaagtaacgtttacgtacgtttacgtaccgggtataacgttacggttaccgaaccggtaacgggtaccggttaagggtaccggttacgttaaacccggaacgttaaacggtcggttaccgtaccgtagtaacccgttacgacggtttcctaacggtttccttacggttaaccctttcccgg

SEQ ID NO: 11315 - DNA, 784 bp, Homo sapiens
  misc_feature: GYAE6OF02JKPAM.9.75.G09.1.454.CMB.1.raw
  modified_base (524)..(524): a, c, t, g, unknown or other
  misc_feature (524)..(524): n is a, c, g, or t
tcagtgatacgtctcacgaccggtgctcgatttagtatagacatcagggggagtcagacccagtcaggacacagcgtggacatgagggtccccgctcagctcctggggctcctgctgctctggcctcccaggtcgccaattgtgacatccagactggaccctagttcctcccttcccaccctgtcctgctatcgtggtcgggaagacgaggagtccacctatcctcgttcggccggcctagtaccaagtaacttcgttacgttaggttggttcggtccgttaggtactcgacgacgaaacgggaaaaccggggtaaccgtaccccgtaaacttcgttagtactacgtacgtacggacgtccgttacgttaacggttaacgtaacgggtccggtaccctagtaacgtacggtacttacgacggccggtacggtaagttacgggtacgttacggaggaacgtaaggttaccttcgtaacgttccaaccgtacctacgtacgagtctaacggttccctaggtacccncgtaccgttaagtagtttaacgttagttttccaaaccgtttaactttaccgttaccacggttaacctaaagttaattaaagtttaacgttaaggttttccgtacggttaacgtaacgttttacgggttacccggaaagggtacgggtaaaccggtagggtaaccgtaaccgttaaagtaacggtaacgtagggtctaaccgtacgggtaccttaaccggttcgttacgttaacgtaccgtttacgtacccgttaccccgg

SEQ ID NO: 11316 - DNA, 733 bp, Homo sapiens
  misc_feature: GYAE6OF02HRFRP.9.75.G09.1.454.CMB.1.raw
  modified_base (200)..(200): a, c, t, g, unknown or other
  misc_feature (200)..(200): n is a, c, g, or t
tcagtgatacgtctcacgaccggtgctcgatttagtatagacatcagggggagtcagacccagtcaggacacagcgtggacatgagggtccccgctcagctccgtggggctcctgctgctcgtggctcccgaggtcgccaattgtgacatccagactgacccagtcctcccttccacctgtctagctatcgtggtggganacagagtccactatctcttcggccggcagtcagtattcgttacttaggttggttcgctagttactacgagcgaaacggaaaccgggaactacccctaaacgtcgtagacttaccgtagtcggaacgtccttacgttaaggtttaacaaacgggttccgggtaacctagtacgaacgtacgtaccgacggccggtataacggtcgtacgttaccggtaacgggtactaaacgttaacgtccctaacttcccacctaacctacgtaccgagttaccgaacggttcctagaaccgtggtaccgtagggtacttaacggttacgtttacgaaacttaactttacttaccgaccgttaaaccctaaggtaataaccttaaacgtttaggttaaccgttacgacggttaacgttaccggttacgggaaccggtaaagggtaccggttagggtaacggtacttaaacgtaaccggtcggtacggtacttacgtacgaaccgtaacgttcgttaccgttacttacgtttagcccttacccg

SEQ ID NO: 11317 - DNA, 173 bp, Homo sapiens
  misc_feature: GYAE6OF01EMO2Y.16.86.H09.1.454.CMB.1.raw
  modified_base (173)..(173): a, c, t, g, unknown or other
  misc_feature (173)..(173): n is a, c, g, or t
tcagtgtactactccacgaccggtgctcgatttagtgctatagacttgggtttgggggaagaggaagactgacggtcccccaggagttcaggtgctgggcacagcggccctgggctgcctggtcaaggactacttccgagtagtacactgagcgggctggcaaggcgcatagn

SEQ ID NO: 11318 - DNA, 173 bp, Homo sapiens; identical to SEQ ID NO: 11317
  misc_feature: GYAE6OF01EBTKE.16.86.H09.1.454.CMB.1.raw
  modified_base (173)..(173): a, c, t, g, unknown or other
  misc_feature (173)..(173): n is a, c, g, or t

SEQ ID NO: 11319 - DNA, 246 bp, Homo sapiens
  misc_feature: GYAE6OF01EN7CR.16.86.H09.1.454.CMB.1.raw
  modified_base (246)..(246): a, c, t, g, unknown or other
  misc_feature (246)..(246): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctcggtcactctgttcccaccctcctcgagtagtacactgagcgggctggcaaggcgcatagn

SEQ ID NO: 11320 - DNA, 173 bp, Homo sapiens
  misc_feature: GYAE6OF01COJJ2.16.86.H09.1.454.CMB.1.raw
  modified_base (172)..(173): a, c, t, g, unknown or other
  misc_feature (172)..(173): n is a, c, g, or t
tcagtgtactactccacgaccggtgctcgatttagtgctatagacttgggtttgggggaagaggaagactgacggtcccccaggagttcaggtgctgggcacagcggccctgggctgcctggtcaaggactacttccgagtagtacactgagcggctggcaaggcgcatagnn

SEQ ID NO: 11321 - DNA, 173 bp, Homo sapiens; identical to SEQ ID NO: 11317
  misc_feature: GYAE6OF01B9Y8W.16.86.H09.1.454.CMB.1.raw
  modified_base (173)..(173): a, c, t, g, unknown or other
  misc_feature (173)..(173): n is a, c, g, or t

SEQ ID NO: 11322 - DNA, 259 bp, Homo sapiens
  misc_feature: GYAE6OF01CDOXO.16.86.H09.1.454.CMB.1.raw
  modified_base (248)..(259): a, c, t, g, unknown or other
  misc_feature (248)..(259): n is a, c, g, or t
tcagtgtactactccacgaccggtgctcgatttagtgctatagacttgggtttgggaaccgtatgaacattcgtgtaggggccactgtcttctccacggtgctcccttcatgcgtgacctggcagcactctcgtattcggcggtgggaccaagctgaccgtcctaggtcagcccaaggctgccccctcggtcactctgttcccgccctcctcgagtagtacactgagcgggctggcaaggcgcatagnnnnnnnnnnnn

SEQ ID NO: 11323 - DNA, 146 bp, Homo sapiens
  misc_feature: GYAE6OF01CEGWH.16.86.H09.1.454.CMB.1.raw
  modified_base (110)..(110): a, c, t, g, unknown or other
  misc_feature (110)..(110): n is a, c, g, or t
  modified_base (131)..(146): a, c, t, g, unknown or other
  misc_feature (131)..(146): n is a, c, g, or t
tcagtgtactactccacgaccggtgctcgatttagtgctatagacttgggtttgggcacagcggccctgggctgcctggtcaaggactacttccgagtagtacactggancgggctggcaaggcgcatagnnnnnnnnnnnnnnnn

SEQ ID NO: 11324 - DNA, 173 bp, Homo sapiens; identical to SEQ ID NO: 11317
  misc_feature: GYAE6OF01CPJIE.16.86.H09.1.454.CMB.1.raw
  modified_base (173)..(173): a, c, t, g, unknown or other
  misc_feature (173)..(173): n is a, c, g, or t

SEQ ID NO: 11325 - DNA, 191 bp, Homo sapiens
  misc_feature: GYAE6OF01DOXQC.16.86.H09.1.454.CMB.1.raw
  modified_base (174)..(191): a, c, t, g, unknown or other
  misc_feature (174)..(191): n is a, c, g, or t
tcagtgtactactccacgaccggtgctcgatttagtgctatagactttgggtttgggggaagaggaagactgacggtcccccaggagttcaggtgctgggcacagcggccctgggctgcctggtcaaggactacttccgagtagtacactgagcgggctggcaaggcgcatagnnnnnnnnnnnnnnnnnn

SEQ ID NO: 11326 - DNA, 550 bp, Homo sapiens
  misc_feature: GYAE6OF01ARSYF.16.86.H09.1.454.CMB.1.raw
  modified_base (214)..(214): a, c, t, g, unknown or other
  misc_feature (214)..(214): n is a, c, g, or t
  modified_base (304)..(304): a, c, t, g, unknown or other
  misc_feature (304)..(304): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctcagtgtctgggtctcctggacagtcgatcatcatcttntgcactggatccagcagtgacgttggtagttataattatgtctcctggtaccaacagtacccaggcaaacgcccccaaatcatgatttangagtcagtaatccgcctcgtagggtttctaagtcgcttcgtctggtctccaagtctggacaacgtaccggcctccctgacctactctcgtgggctcccaggcctaggacgggacggagggtagtaatttagttactgcagtctctaatacgtagaaggttggacagctactctcgttagttccgggcggtcggacctaagtcgtacgtacccgtcgtacggtacacgcccaagggtcctaccccgg

SEQ ID NO: 11327 - DNA, 509 bp, Homo sapiens
  misc_feature: GYAE6OF01DIWOT.16.86.H09.1.454.CMB.1.raw
  modified_base (207)..(207): a, c, t, g, unknown or other
  misc_feature (207)..(207): n is a, c, g, or t
  modified_base (504)..(504): a, c, t, g, unknown or other
  misc_feature (504)..(504): n is a, c, g, or t
  modified_base (508)..(509): a, c, t, g, unknown or other
  misc_feature (508)..(509): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctctgataccaacngcaccaggcaaagcacccaaattcatgatttatgaggtcactaatcggccctcaggggtttctaatcgcttctctggctccaagtctggcaacacggcctccctgaccatctctgggctccaggctgaggacgaggctgattattatgcatctcatatacaaccaacagcactctcgactggtattcggcggaggaccaagctgaccgtcctaggtcagcccaaggctcgcccctcggtcactctcgttccccaccctcctcgagtacgtacacgtgagcgggctggcgtaaggcgnatgnn

SEQ ID NO: 11328 - DNA, 498 bp, Homo sapiens
  misc_feature: GYAE6OF01BFI61.16.86.H09.1.454.CMB.1.raw
  modified_base (403)..(403): a, c, t, g, unknown or other
  misc_feature (403)..(403): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcagggtttctaatcgcttctctggctccaagtctggcaacacggcctccctgaccatctctgggctccagctgaggacgngggtgattatactgcagctcatatagaagtgcagcactctcgtattcggcgtggaccagctcgaccgtctaggtcagcccaaggctcgtcccccg

SEQ ID NO: 11329 - DNA, 249 bp, Homo sapiens
  misc_feature: GYAE6OF01D85MJ.16.86.H09.1.454.CMB.1.raw
  modified_base (246)..(249): a, c, t, g, unknown or other
  misc_feature (246)..(249): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctcggtcactctgttcccaccctcctcgagtagtacactgagcgggctggcaaggcgcatagnnnn

SEQ ID NO: 11330 - DNA, 522 bp, Homo sapiens
  misc_feature: GYAE6OF01AKU8F.16.86.H09.1.454.CMB.1.raw
  modified_base (517)..(517): a, c, t, g, unknown or other
  misc_feature (517)..(517): n is a, c, g, or t
  modified_base (521)..(522): a, c, t, g, unknown or other
  misc_feature (521)..(522): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggcctcgccccctcggtccacttctcgttccccaccctcctcgacgtacgtaccgactggacgcgggctggcgaacggcganatgnn

SEQ ID NO: 11331 - DNA, 640 bp, Homo sapiens
  misc_feature: GYAE6OF01D1RM7.16.86.H09.1.454.CMB.1.raw
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatcctcctgcactggaagcggcagtgattggttggggttataaccttgtctcctggtaccagcagcacccagaaccaaacgcccccaaatcatgtactttatggagggacaaagtaacgccggccctacgaggtactttactaatcgtcttctctggctcaagtctacggacaaccgccggccctccctgacccattcctcgtcgggctaccgaggctggacgggtacggagggttgtaatttacgttacgtgacagtctacgaagttaagtaaggtaaggtcggactacgacctaccgttcgttaccggttacggttccgggaccggggtacgggtaacccgtaaggtcccgttccgggtaccccggttacccgtacgggtaccgaacccggtaccccggaacggttcccgtccccggtaccccccccgg

SEQ ID NO: 11332 - DNA, 547 bp, Homo sapiens
  misc_feature: GYAE6OF01BJ9O9.16.86.H09.1.454.CMB.1.raw
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtaccaggacaaacgcccccaaatcatgatttatgaagtcagtaatcggccctcgacggggtccctgactcgcttctcgtgggtccaagtctggcaacgaccggccctccctgacctatctcgtcgggcctccgaggctggacgggacggaggctaggtatttattacgtgcagctcaattataggtaagtggacagcctacgtcttcgtacgttcgggcgggtcgggaccaaggtcctacggacccgtcgtacggtcacggcccgaggtcctcccgg

SEQ ID NO: 11333 - DNA, 509 bp, Homo sapiens
  misc_feature: GYAE6OF01ANAZU.16.86.H09.1.454.CMB.1.raw
  modified_base (406)..(406): a, c, t, g, unknown or other
  misc_feature (406)..(406): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcagggtttctaatcgcttctctgctcagtctggcaacacggcctcctgaccatctctgggctccgaggctgaggacgagggtnattattactgcagctcatagtagaagtcggacagcacgtctcgtagttcggcggtaggaccaagcgtcgaccgtctaggtcacgacccaggcctcgtcccccg

SEQ ID NO: 11334 - DNA, 550 bp, Homo sapiens
  misc_feature: GYAE6OF01DGCRM.16.86.H09.1.454.CMB.1.raw
  modified_base (372)..(372): a, c, t, g, unknown or other
  misc_feature (372)..(372): n is a, c, g, or t
  modified_base (413)..(413): a, c, t, g, unknown or other
  misc_feature (413)..(413): n is a, c, g, or t
  modified_base (431)..(431): a, c, t, g, unknown or other
  misc_feature (431)..(431): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaatcatgatttatgaggtcagtaatcggccctcgacgggtttcaatcgtcttctctggctcaagtctggcacacgcctccngaccatcctgtcgggctccgaggctaggacggacgagggtntattatactgacagtctnactataggagtggactagtcctactcgttcgttagttccgggacggtacgggaccgaagtccgtacggtacccgttcgtaacggtcacggacccgaacggtcccgtaccggtccccccg

SEQ ID NO: 11335 - DNA, 248 bp, Homo sapiens
  misc_feature: GYAE6OF01D0Q4T.16.86.H09.1.454.CMB.1.raw
  modified_base (244)..(248): a, c, t, g, unknown or other
  misc_feature (244)..(248): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctggtcactctgttcccaccctcctcagtagtacactgagcgggctggcaaggcgcatagnnnnn

SEQ ID NO: 11336 - DNA, 554 bp, Homo sapiens
  misc_feature: GYAE6OF01ALZWP.16.86.H09.1.454.CMB.1.raw
  modified_base (241)..(241): a, c, t, g, unknown or other
  misc_feature (241)..(241): n is a, c, g, or t
  modified_base (372)..(372): a, c, t, g, unknown or other
  misc_feature (372)..(372): n is a, c, g, or t
  modified_base (546)..(546): a, c, t, g, unknown or other
  misc_feature (546)..(546): n is a, c, g, or t
  modified_base (551)..(551): a, c, t, g, unknown or other
  misc_feature (551)..(551): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcaccaggcaaagcaccaaattcatgatttangagtcactaatcgcctcaggggtttctaatcgcttctctggctcaagtctggcacacggcctcctgaccatctctggctccagctgaggcgaggctgacttatatgctatctcattactaccaacctaacncgcaacttctacgtactggttaacttcgggacggtaagggaccaagtcctagacccgttcgtacggtcacgcccgaaggctaccggcccctcggtctaccgtcgtcgttccccacctccgtagtacgtacgtacgtacgtggacggtcgggtctcgggtacaacgggtcaacgngtagntcg

SEQ ID NO: 11337 - DNA, 563 bp, Homo sapiens
  misc_feature: GYAE6OF01A35JN.16.86.H09.1.454.CMB.1.raw
  modified_base (368)..(368): a, c, t, g, unknown or other
  misc_feature (368)..(368): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccacagtaccaggcaaacgcccccaaactcatgtatttatgaggtcagtaatccggccctgtacgggtttctaagtcgtcttctctggctcaagtctgacaacnccggtccctcctgacctatctcgtcgggccttccgaggctggacggacggaggggtgtaatttattacgtgctagccttcaataagtaggaaggtggacacgcctactcgtcgtagttccgggacgggtagggacccaggtccgtcggacccgttcgtacggtcgaccgcccgaacggtccgtcccgtcccccgg

SEQ ID NO: 11338 - DNA, 542 bp, Homo sapiens
  misc_feature: GYAE6OF01BJ24O.16.86.H09.1.454.CMB.1.raw
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtacccaggacaaacgccccaaactcatgatttatgaggtcagtaatcggcctcgagggttctaatcgtcttctctgctcaagtctgcaacacggcctcctgaccatctctcggctccgagctgaggacgagggtgtattacgttactgcgacgtctacatataggaagtcggacagctactctcgtagttccgggcgggtcgggaaccgtagtccgtcgacccggttccgtacggtaccacggacccgacgggtcccgtccggtaccccccg

SEQ ID NO: 11339 - DNA, 641 bp, Homo sapiens
  misc_feature: GYAE6OF01DA6LQ.16.86.H09.1.454.CMB.1.raw
  modified_base (167)..(167): a, c, t, g, unknown or other
  misc_feature (167)..(167): n is a, c, g, or t
  modified_base (242)..(242): a, c, t, g, unknown or other
  misc_feature (242)..(242): n is a, c, g, or t
  modified_base (294)..(294): a, c, t, g, unknown or other
  misc_feature (294)..(294): n is a, c, g, or t
  modified_base (303)..(303): a, c, t, g, unknown or other
  misc_feature (303)..(303): n is a, c, g, or t
  modified_base (382)..(382): a, c, t, g, unknown or other
  misc_feature (382)..(382): n is a, c, g, or t
  modified_base (637)..(637): a, c, t, g, unknown or other
  misc_feature (637)..(637): n is a, c, g, or t
tcagtgtactactccacgaccggtgctcgatttagtgctatagacttggggtttggggggggtctcaggaggcagcgctctcaggacatctccaccatggcctggctctgctgctcctcaccctcctcactcagggcacgagggtcctgggtcctccactggaaccngcagtgacgttggtgttatactttgtctcctgactaccaacagcaccaggcaaagcacccaaattcatgatttangagtcactatccgcctgagggtttcaatcgcttctctgctcagtctggcacncggcctccngaccatctcgtggcctcgaggtctgaggacgaggctagtattattagttcgactatctacataactaaccaaaccaacncgacctacctccgtacgtacgttacgggttacgttaccgggacggtaacgggtacctagtcgtacgacccgttacgtaacggtccaacggacccgaaggtcccgtcccggtccccccgttacgggttccctaccgttccgttacccgttaccccctacccgttccgtaccggtaaccggttaacgtacccgtacggtacgggaccgggtccggggtaccgtacgggaaccgtaacgggcctacggtaactacggntacg

SEQ ID NO: 11340 - DNA, 246 bp, Homo sapiens
  misc_feature: GYAE6OF01DTJK4.16.86.H09.1.454.CMB.1.raw
  modified_base (246)..(246): a, c, t, g, unknown or other
  misc_feature (246)..(246): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctcggtcactctgttcccgccctcctcgagtagtacactgagcgggctggcaaggcgcatagn

SEQ ID NO: 11341 - DNA, 506 bp, Homo sapiens
  misc_feature: GYAE6OF01EGA81.16.86.H09.1.454.CMB.1.raw
  modified_base (243)..(243): a, c, t, g, unknown or other
  misc_feature (243)..(243): n is a, c, g, or t
  modified_base (459)..(459): a, c, t, g, unknown or other
  misc_feature (459)..(459): n is a, c, g, or t
  modified_base (501)..(501): a, c, t, g, unknown or other
  misc_feature (501)..(501): n is a, c, g, or t
  modified_base (505)..(506): a, c, t, g, unknown or other
  misc_feature (505)..(506): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangagttcactaatcggccctcaggggtttctaatcgcttctctggctccaagtctggcacacggcctcctgaccatctctgggctccaggctgaggacgaggctgattattatgcatctcatactaacaaccaacagcactctcgactggtattcggcggaggaccaagctgaccgtctagtcacgccaaggctcgcccctcgtcactctcgtcccnccctctcgagtacgtacactgaggcggcgtggacgaggcganatgnn

SEQ ID NO: 11342 - DNA, 603 bp, Homo sapiens
  misc_feature: GYAE6OF01DCM9M.16.86.H09.1.454.CMB.1.raw
  modified_base (300)..(300): a, c, t, g, unknown or other
  misc_feature (300)..(300): n is a, c, g, or t
  modified_base (415)..(415): a, c, t, g, unknown or other
  misc_feature (415)..(415): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcatcttctgcactggatcagcagtgacgttggtagttatattatgtctctggtaccaacagtaccaggcaaacgccccaaatcatgatttangagtcaagtaactcggccctgtagggtttctaagtcgtcttctctggctccaagtctggacaacacggcctcctcgaccatctcgtcgggctccgaggctggacggacgagggtntattagtactgcagtctacgtaatagtacgaagtggactaggactacgttccgttacggttacggttccggggtacgggtacggggtaaccctaagggtccgttccgggtaaccccggttacccgttaacgggtaccgaacccgggtaccccgtaaacgggtccccgttccgggttcccccccccggg

SEQ ID NO: 11343 - DNA, 268 bp, Homo sapiens
  misc_feature: GYAE6OF01D648C.16.86.H09.1.454.CMB.1.raw
  modified_base (247)..(268): a, c, t, g, unknown or other
  misc_feature (247)..(268): n is a, c, g, or t
tcagtgtactactccacgaccggtgctcgatttagtgctatagacttgggtttgggtaaccgtatgaacaattctgtagggccactgtcttctccacggtgctcccttcatgcgtgacctggcagcactctcgtattcggcggtgggaccaagctgaccgtcctaggtcagcccaaggctgccccctcggtcactctgttcccaccgtcctcgagtagtacactgagcggctggcaaggcgcatagnnnnnnnnnnnnnnnnnnnnnn

SEQ ID NO: 11344 - DNA, 634 bp, Homo sapiens
  misc_feature: GYAE6OF01DR34J.16.86.H09.1.454.CMB.1.raw
  modified_base (216)..(216): a, c, t, g, unknown or other
  misc_feature (216)..(216): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcactggatccagcagtgacgttgtagttatattatgtctctgtaccaacagtaccagacaaacgcccccaaactcatgtatttagtagaggtacagtaactccggccctcgtacggggtttactaagtcgtcttctctcggtctaccaagttctaggaccaaccgaccggccctccctcgacctacttcctcgtcgggcctccgaggtcgtaggacggacggtaggggttagtaactttagttacgtgacgtagacctacgtaattaacgtaaggaacggtggacgagacctacgttcgttaccggttaggttccgggtacgggtaccgggtaccgtaacggtaccgttcggaccccggttaccgttacgggtacccgacggaccccgaacgggtcccgttcccggtacccccccgg

SEQ ID NO: 11345 - DNA, 584 bp, Homo sapiens
  misc_feature: GYAE6OF01CM3M8.16.86.H09.1.454.CMB.1.raw
  modified_base (217)..(217): a, c, t, g, unknown or other
  misc_feature (217)..(217): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctcgccctgactcagcctgcctccgtgtctgggtctccgtggacagtcgatcatcatcttntgcactggatccagcagtgacgttggtagttataattatgtctctggtaacaacacgtaccaggacaaacgccccaaactcatgtattatgagtacagtaacgtcgcctacgtagggttactaatcgtcttctcgtcgctaccgaagtctacggacaacgaccggcctcctcgacctatcctacgtcggcctcgaggtcgaggaacggacggagggtataagttactacgtgacagtctactaataagtaggaagtcgacacgactacgtcgttcggttacgtcgggtacggtacgggaacctaaggccgttacggacccgttacgtacggttccgacggacccgaaggtcccggtccgtccccccg

SEQ ID NO: 11346 - DNA, 538 bp, Homo sapiens
  misc_feature: GYAE6OF01CIX4V.16.86.H09.1.454.CMB.1.raw
  modified_base (244)..(244): a, c, t, g, unknown or other
  misc_feature (244)..(244): n is a, c, g, or t
  modified_base (536)..(536): a, c, t, g, unknown or other
  misc_feature (536)..(536): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangaggtcactaatcggccctcagggtttctaatcgcttctctggctccaagtctggcaacacggcctcctgaccatctctgggcctccgaggctggaggacgaggctgattattattgcatctcatataaccaaccaacagcactctcgactggtattcggcggacggaccaagctcgaccgtcgtacggtcacgcccgaaggccgtccgcccccgtcgtccactcctcgttccccaccctcctcgacgtagtaccacgtgacggccggcgtcggacgaacgggcgacagtgntg

SEQ ID NO: 11347 - DNA, 599 bp, Homo sapiens
  misc_feature: GYAE6OF01EXTXX.16.86.H09.1.454.CMB.1.raw
  modified_base (308)..(308): a, c, t, g, unknown or other
  misc_feature (308)..(308): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcattcttctgcactggatccagcagtgacgttggtagttataattatgtctcctggtaccaacagtacccaggacaaacgcccccaaactcatgatttangaggtacagtaatcggccctcgtagggtttctaatcgtcttctctgctcaagtctggacaacgacggtcctccctagacctatcctcgtcgggctccgaggtctaggacgggtacggtagggtagtaatttacgttacgtgctagtctacattaagtaggaaggtggacacgtctacttcgttacgtacgtttccgggacgggttacgggacccgtaaggtccgtcggtacccggttaccgtacgggtacccgacggaccccgtaacggtcccgtcccggtacccccccgg

SEQ ID NO: 11348 - DNA, 648 bp, Homo sapiens
  misc_feature: GYAE6OF01C3WMF.16.86.H09.1.454.CMB.1.raw
tcagtgtactactccacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactggatccagcagtgacgttggtagttataattatgtctctggtacaacacgtaccaggcaaacgacccccaaactcactgatttatgaggtacagtaactcggccctcgtagggtttctaatcgtcttctcgtggtctaccgtaacgtcgtacggcaaacaccggtccctaccctacgaccctaatcctcgtcgggccttaccgaggtctaggaacgggacggtaggggtagtaactttagttacgtgactagtactacgtaattaacgtaaggtaaagttcgggactacggactaccgttaccgttacgttaacggttcgggtaccggggttacggggaacccgtaaggtccgttacggtaaccccggttaccgtacgggttacaaccggaccccgaaacgggtcccgttcccggtacccccccggg

SEQ ID NO: 11349 - DNA, 495 bp, Homo sapiens
  misc_feature: GYAE6OF01EYRI8.16.86.H09.1.454.CMB.1.raw
  modified_base (449)..(449): a, c, t, g, unknown or other
  misc_feature (449)..(449): n is a, c, g, or t
  modified_base (487)..(487): a, c, t, g, unknown or other
  misc_feature (487)..(487): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaccaggcaaagcccccaaactcatgatttatgaggtcagtaatcgcctcgagggtttctaatcgcttctctggctcaagtctggcaacacggcctcctgaccatctctggctccgaggctgaggacgagggtgattatactgcagctacatatagagtgcagcactctgtatcggnggtcggacagctgaccgtctaggtcacgaccaaggtcncgtccccg

SEQ ID NO: 11350 - DNA, 554 bp, Homo sapiens
  misc_feature: GYAE6OF01BX7XV.16.86.H09.1.454.CMB.1.raw
  modified_base (243)..(243): a, c, t, g, unknown or other
  misc_feature (243)..(243): n is a, c, g, or t
  modified_base (253)..(253): a, c, t, g, unknown or other
  misc_feature (253)..(253): n is a, c, g, or t
  modified_base (550)..(550): a, c, t, g, unknown or other
  misc_feature (550)..(550): n is a, c, g, or t
  modified_base (552)..(553): a, c, t, g, unknown or other
  misc_feature (552)..(553): n is a, c, g, or t
tcagtgtactactccacgaccggtgctcgatttagtgctatagactttggggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctctgataccaacagcacccaggcaaagcaccaaattcatgattangagtcactancgcctgagggtttctaatcgcttctctggctccaagtctggcaacgacggcctcctgaccatctcgtcgggctcgaggtctggacggacgaggctagtattattattgctatctcaataactaaccaaaccaacacgacactctcgacgttggtagtcgggacggacggacacgcgtacgaccgtcgtagtcgacgccgaacggcctccgccccgtcgtaccaccttctccgttcccacccgtcctcgtacgtacgtacgtcgtaggacggtcgggcgtagggacgacggcgacagngnng

SEQ ID NO: 11351 - DNA, 685 bp, Homo sapiens
  misc_feature: GYAE6OF01C3IJD.16.86.H09.1.454.CMB.1.raw
  modified_base (215)..(215): a, c, t, g, unknown or other
  misc_feature (215)..(215): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttcngcacgtggatccagcagtgacgttgtagttataattatgtctctgtaccaacacgtaccaggacaaaccgaccccaaatcatagtatttagtagagtacagtaacgtccggtcctagtacgggttactaagtcgtcttcgtctcggtctacgaagttctacggtaccaaccgtaccggtccctaccgtcgtaacctacgtccttcggtcgggtccttaccggacggtaccgtagggaacggggtaacggtaaggggttacgttaatttaacgtttaccgcgtacgtacgtaccgtactaagttaaacgtaaggtaacggtcggaacgtacgtaccgtaccgttccgttacggttacggttccggggaccggggttaacgggaaacccgtaagggtccgtaccgggttaacccggtaccgtttacgggaccaccggaacccggtaacgggtccgtccccggttacccccgg

SEQ ID NO: 11352 - DNA, 715 bp, Homo sapiens
  misc_feature: GYAE6OF01A6HAE.16.86.H09.1.454.CMB.1.raw
  modified_base (308)..(308): a, c, t, g, unknown or other
  misc_feature (308)..(308): n is a, c, g, or t
tcagtgtactactccacgaccggtgctcgatttagtgctatagacttgggtttggggggggtctcaggaggcagcgctctcgggacgtctccaccatggcctgggctctgctgctcctcactctcctcactcaggacacagggtcctgggcccagtctgccctgactcagcctgcctccgtgtctgggtctcttggtcagtcgatcaccatctcctgcactggaagcggcagtgagtggttggggttataccgttgtctcctggtaccagcagccaccagaccaaacgcccccaaatcatgtatttanggaggacaagtaacgccggtccctagaggtagtttactaatcgtcttctctggcctccacgtctggaccaaccgaccggtcctcccgagaacctaattcctcgtcggccctcgacggcgtaggacggacggacggtctaggtaatttacgtttaccgtgtaccgttcgtaccttactaacttaactttacgtaacggtttccgttcggttacctaacgttacgtttcggtttacggttttttacggggaccgggggtaaacggggtaaacccggtaaacggggttacccggttaaccccgggttaccccggttaacgggttacccgtaacccgggtaaacccccggttaaccggggtacccccgtttaccccggggttcccccccccggttacgggtttaacccccg

SEQ ID NO: 11353 - DNA, 594 bp, Homo sapiens
  misc_feature: GYAE6OF01CHM59.16.86.H09.1.454.CMB.1.raw
  modified_base (243)..(243): a, c, t, g, unknown or other
  misc_feature (243)..(243): n is a, c, g, or t
  modified_base (376)..(376): a, c, t, g, unknown or other
  misc_feature (376)..(376): n is a, c, g, or t
  modified_base (593)..(593): a, c, t, g, unknown or other
  misc_feature (593)..(593): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangaggtcagtaactcggccctcgagggtttctaatcgcttctctggctccaagtctggcaacgcggcctccctgaccatctcgtgggcctcgaggcgtaggagggacgagggtgtaatttatacgtgcagctanatagtagagtgcagctactcgtcgtacgttcgggcggtacggaccagtccgtacggacccgttcgtacggtccacgacccgaaggtccctccggtaccccccgtcggtccctaccgttccgttacccgttcccccacccttcccgtacgtacgtaccgtacctacggtcggacggtccgggcgtcgggacccgaagggcccgaactacggtagctgnc

SEQ ID NO: 11354 - DNA, 538 bp, Homo sapiens
  misc_feature: GYAE6OF01CGXP3.16.86.H09.1.454.CMB.1.raw
  modified_base (201)..(201): a, c, t, g, unknown or other
  misc_feature (201)..(201): n is a, c, g, or t
  modified_base (411)..(411): a, c, t, g, unknown or other
  misc_feature (411)..(411): n is a, c, g, or t
  modified_base (416)..(416): a, c, t, g, unknown or other
  misc_feature (416)..(416): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacgagggtcctgggcccagtctgccctgactcagcctgcctccgtgtctgggtctcctggacngtcgatcatcatcttctgcactggatccagcagtgacgttgtagttataattatgtctctggtaccaacagtacccaggccaaagcccccaaactcatgatttatgaggtcagtaatcggccctgagggtttctatcgcttctctgctcaagtctggcaacacggcctccgtgacctatctcgtgggcctcgagctgacggacgagggtnaattntactgctagcctactatataggtaagtcggacacgctacgtctcggtacttcgggcgggtacggaccaaggcgtcgacccgtctacggtaccacggacccacggtccgtccgtaccccccgg

SEQ ID NO: 11355 - DNA, 684 bp, Homo sapiens
  misc_feature: GYAE6OF01DN9IK.16.86.H09.1.454.CMB.1.raw
tcagtgtactactccacgaccggtgctcgatttagtgctatagacttggggtttggggggggtctcaggaggcagcgctctcaggacatctccaccatggcctgggctctgctgctcctcaccctcctcactcagggcacaggtgacgcctccgaggggaaggggcttcgagggacctctgggctgatccttggtctcctgcctcctcaggctcgaccgggccagcactgactcactggcatgtgtttcctcctctttccgagggtcctgggcccagtctcgcctgactcagcctcgcctcgtgtcgtcgggtctccgtggacagtcgatcatcattccttctcgacctacgttggactcccgaagcgtaaggtgtacggtttaggtagtttaaataatttacgttcgtacctccgttacggtaaccctaaacgtacgttaaccccgaagggaaccaaaaccgtaccccctaaacttcaattacgtaagtttagtaggtaacggttacgtaacgtaacgttcccggtacccgttacgggttaacggggttttaccttaacgtttccggtactttccgttacggttcggtacccttaccgtaacggttccgtaccgggtacaaacccggtcccggtccccttaccccgtacgtaacccgtacttcccgttcggtccgggtacccg

SEQ ID NO: 11356 - DNA, 678 bp, Homo sapiens
  misc_feature: GYAE6OF01BU7CB.16.86.H09.1.454.CMB.1.raw
  modified_base (304)..(304): a, c, t, g, unknown or other
  misc_feature (304)..(304): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtaccagacaaacgccccaaatcatgtatttangaggtcagtaatccggcctacgtagggtttctaagtcgtcttcgtcgtggcctaccgtaagtcgtacggaccaaccgaccggtccctccctagaccctattccgtcgtcgggtcctccgaggtacgtaggacggtacgtcgttacttagtaactttagttacgttcgactagtttcctacttaacttaacctaaaccgtaaacccaaacgtaacgtaccgtaacccttccgttaaccgggttaaccgtttacgggttaacccggtttaccggggacggggtaaccgggtaaccctaaacggttccgttaacccggtaccccggttacccgttaagggtacccgaacccggtaccccggtaacggggtccccccg

SEQ ID NO: 11357 - DNA, 632 bp, Homo sapiens
  misc_feature: GYAE6OF01ARO1E.16.86.H09.1.454.CMB.1.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
tcagtgtactactccacgaccggtgctcgatttagtgctatagacttgggtttgggtgggggtctcaggaggcagcgctctcaggacatctccaccatggcctgggctctgctgctcctcaccctcctcactcagggcacgagggtcctgggcccagtctgccctgactcagcctgcctccgtgtctggtctcctggacagtcgatcatcatcttntgcactggatccagcagtgacgttggtagttataattatgtctcctggtaccaanacgtaccaggaccaaacgcccccaaaactcaactctaatttatgtaagttctacgtaaacggccggtccctcggaaggggttactactaaacgtcgtcttctcgtcggtcctacctaagtctgggaccaacgaccggcccttccgtcgacccgttctcgtcggtccctccgacgactaggacgggacgtaggtcctgtaactttacgttactcgacctacgtcaattagtaagtaacgttagttacctacttaccgttggtttccggtttacgggcgggtaacgggtaccgtaacggtcgtacggtacccgtacgtacggtaccgtacggacccgaaggtccctccggtcccccgtaccgg

SEQ ID NO: 11358 - DNA, 556 bp, Homo sapiens
  misc_feature: GYAE6OF01ETWG3.16.86.H09.1.454.CMB.1.raw
  modified_base (244)..(244): a, c, t, g, unknown or other
  misc_feature (244)..(244): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttangagtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcgggcggagggaccaagctgaccgtcgtaggtcacgcccaaggcctcgccccctcggtcaccttcgtcgttccccaccctcccgtcgtacgtacgtaccgaccgtaggacggccggggcctcggggacccgtaaacggggcccgacgtaacgtggctcg

SEQ ID NO: 11359 - DNA, 550 bp, Homo sapiens
  misc_feature: GYAE6OF01B8NXG.16.86.H09.1.454.CMB.1.raw
  modified_base (403)..(403): a, c, t, g, unknown or other
  misc_feature (403)..(403): n is a, c, g, or t
  modified_base (438)..(438): a, c, t, g, unknown or other
  misc_feature (438)..(438): n is a, c, g, or t
  modified_base (457)..(457): a, c, t, g, unknown or other
  misc_feature (457)..(457): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcagcctgcctcgtgtctgggtctcctggacagtcgatcatcatcttctgcacgtggatccagcagtgtacgttggtagttataattatgtctctaggtaccaacacgtacccaggaccaaacgacccccaaactctatgtaatttagtagaggtacagtaacgtccgcctcgtagggtttctaacgtcgtcttctcgtcgctaccaagtctgacaacgtcggcctcctcgacctntctcgtcggctacgagcgtaggaggtacggaggtntaattagtctgcagtctanataagtagagtgacagctactcgtcgttagtcggacgggtacggaccagtcgtcgaccgtacgtacgtcacgacccacggccgtccgtccccg

SEQ ID NO: 11360 - DNA, 698 bp, Homo sapiens
  misc_feature: GYAE6OF01EARVJ.16.86.H09.1.454.CMB.1.raw
  modified_base (301)..(301): a, c, t, g, unknown or other
  misc_feature (301)..(301): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactgatccagcagtgacgttgtagttataattatgtctctgtacaacagtaccaggcaaacgcccccaaatcatgtatttangagtcagtaactcgcctgtagggtttctaatcgtcttctctggctaccaagtctcggacaacgcggtcctcccgtacgacctattccgtcgtgggtctcccgaggtctaggacggggaccggtaggggttacgtaatttacgttacgtcggactaaggtcccttataacgttaaacgttaacgggtaaacgggttcgggaacgtacgtacccgtaaccgtttccgttaccgggtttacggtttacccggggggtacgggggttaaccgggaaaccccgttaaagggtcccgtttaaccgggggtaccccccgtttaacccggtaccggggttaacccgaaacccggggtaacccccggtaacggggttccccgttccccgggttaaccccccccggg

SEQ ID NO: 11361 - DNA, 514 bp, Homo sapiens
  misc_feature: GYAE6OF01CT2F5.16.86.H09.1.454.CMB.1.raw
  modified_base (302)..(302): a, c, t, g, unknown or other
  misc_feature (302)..(302): n is a, c, g, or t
  modified_base (461)..(461): a, c, t, g, unknown or other
  misc_feature (461)..(461): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgtattataactttgtctcctggtaccaacaacaccagcaaagccccaaatcatcatttangaatctctaagccgccctcgagggtatctaatcgcttctctggctccaagtctgcaacacggcctccctgacccgtctcgtcggccctccgagactggacggacgaggctgtattatactgcctactcatatagaagtatactactctgttgtttcggnggaggacagctgaccgtcgtagcacgccaagctcgccccngtcncgtctcccg

SEQ ID NO: 11362 - DNA, 607 bp, Homo sapiens
  misc_feature: GYAE6OF01DPUMB.16.86.H09.1.454.CMB.1.raw
  modified_base (240)..(240): a, c, t, g, unknown or other
  misc_feature (240)..(240): n is a, c, g, or t
  modified_base (249)..(249): a, c, t, g, unknown or other
  misc_feature (249)..(249): n is a, c, g, or t
  modified_base (604)..(604): a, c, t, g, unknown or other
  misc_feature (604)..(604): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtgttataactttgtctctgataccaacagcacccaggcaaagcaccaaattcatgatttangagtcatancggcctgagggtttctaatcgcttctctggctccaagtctggcaacacggccctcctgaccatcctctcgggctccgaggctggacggacgaggctgtattattattgctatctcataatacgaaaccaacacgctactctacgactggtacttcggacggtacggaccaagctacgaccgtcctaggtaccacgacccgaacggtcctccgacccccgttcggtcctaccgttccttaccgtttccccccaaccccgttcccgtaccggtaccggtttacgtaacccgtaccgttgggaccgggcccgggggtcttaccggggacctaacggggacccgacgtaacgtaccggngtc

SEQ ID NO: 11363 - DNA, 676 bp, Homo sapiens
  misc_feature: GYAE6OF01CDUDC.16.86.H09.1.454.CMB.1.raw
  modified_base (306)..(306): a, c, t, g, unknown or other
  misc_feature (306)..(306): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgtacgttgtagttataattatgtctcctgtaccaacacgtaccaggacaaacgccccaaactcatgatttagngaggtcagtaactcggccctgtagggttactaatcgtcttctcgtgctacaagtctcggacaaccgaccggtccctcccgtacgacctacttccgtccgtcgggtaccttccgaaggtcctaggaacgggaacggtaggggttcttaaagtttacgttacgttcgacgtacgtacctactaagttaagtaacggtaagggttcggaacgtaccggtaccgtacccgttcggttaccggttaaggtttcccgggggacgggttaccggggaaaccctaagggcccttccgggtaaccccggttaccgttaacgggtcccgaacccggtaaccccggaaccgggttcccgtcccgggttaacccccccccgg

SEQ ID NO: 11364 - DNA, 537 bp, Homo sapiens
  misc_feature: GYAE6OF01EHC8A.16.86.H09.1.454.CMB.1.raw
  modified_base (260)..(260): a, c, t, g, unknown or other
  misc_feature (260)..(260): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
  modified_base (448)..(448): a, c, t, g, unknown or other
  misc_feature (448)..(448): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctctcactcagggcacaggtgacgcctccgaggggaaggggcttcgagggacctcgtgggctgatccttggtctcctgcctcctcaggctcgaccggggcccagcactgactcacgtggctagtgttcgttttccnccccttctttccgacgggtccgtcgggccctagtcctcgccctgactcacgcctcgcctccgtgtcgtcggtcctcgtggacagtcgatcatccaatctctgcactggatccagcagtgacttggagttanaattngtctcctggtaccaacagtacccaggccaagcccccaaatcaatcgatttangagtcagtactcgccgtcgtacgggtttactaagttcgacttcgtctcgctcaagtctggcacgcgcctccctcgaccatcctctcggc

SEQ ID NO: 11365 - DNA, 683 bp, Homo sapiens
  misc_feature: GYAE6OF01CS5S9.16.86.H09.1.454.CMB.1.raw
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctctaggtaccaacagtacccaggacaaacgcccccaaatcatgtactttagtgagtacaagtaacgtcggtccctagacgggttctacgtaagttccgtctttccgtcgtcggaccttccgaaacggttccgtaggtaccctaaccgtacccggtccctcccgtacgaccctagttccgtcggtcggtccttacgacggtcgttagggaacgggacggtaaggggttataagtttacttacgtacgacacgtctaactaacgttagtaaacgggtaacgttcggaacgtaacgcccgttaacttccgtttacgggtacggtttaccggggaccggggtacggtaacccgacggtccggttacccggttacccggttaccgttacgggtacccaaccggtaccccgaagggtcccgttaccccccggg

SEQ ID NO: 11366 - DNA, 178 bp, Homo sapiens
  misc_feature: GYAE6OF01E00RN.16.86.H09.1.454.CMB.1.raw
  modified_base (175)..(178): a, c, t, g, unknown or other
  misc_feature (175)..(178): n is a, c, g, or t
tcagtgtactactccacgaccggtgctcgatttagtgctatagacttgggtttgggggaagaggaagactgacggtccccccaggagttcaggtgcgtgggcacagcggccctgggctgcctggtcaaggactacttccgagtagtacactgagcgggctggcaaggcgcatagnnnn

SEQ ID NO: 11367 - DNA, 579 bp, Homo sapiens
  misc_feature: GYAE6OF01AVVDB.16.86.H09.1.454.CMB.1.raw
  modified_base (305)..(305): a, c, t, g, unknown or other
  misc_feature (305)..(305): n is a, c, g, or t
tcagtgtactactccacgaccggtgctcgatttagtgctatagacttgggtttggggggggtctcaggaggcagcgctctcaggacatctccaccatggcctgggctctgctgctcctcaccctctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggacaacgaacccccaatcatgatttangaggtcagtaatcggcctcgagggtttctaatcgtcttctctggctccgaagtctggaccaacacggtccctcccgtgacctatcctcgtgggtcctccgaggcctggacgggacggagggttagtatttacgttacgtcgacagtcctctaatagtaggaaggtgacacgtcactcgttcgtagttccgggacgggtacggaccgtaggccgtcggacccgttccgtacggtaccgacggtaccccgaacgggtccgtcccggtaccccccgg

SEQ ID NO: 11368 - DNA, 673 bp, Homo sapiens
  misc_feature: GYAE6OF01A0M50.16.86.H09.1.454.CMB.1.raw
  modified_base (256)..(256): a, c, t, g, unknown or other
  misc_feature (256)..(256): n is a, c, g, or t
  modified_base (303)..(303): a, c, t, g, unknown or other
  misc_feature (303)..(303): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcagcctgcctcgtgtctggtctcgtggacagtcgatcatcatcttctgcacgtggactccagcagtgtacgttggtagttatattatntctcgtgtaccacacgtaccagacaaccgaccccaatcatgtattangagtacagtagtccgcctgtagggttactacgtcgtcttctcgtcgtcctaccgtaagttccgtacggaccaaaccgacccggtcccctccccgttacgaaccctacttccgtccggttcgggtcccttaccggtacggtcgtagggaacgggtacggtaggggttacgttaagtttacgttacgtgacgtacgtctaacgtaagttaagtaaggtagtacgacgtacgtacgtaccgttcgttacggttacggttccgggtacgggttacggaacccgtaggtcccggttacggtaccccggttaccgttaaccggtacccgtaccggtaacccccggtaacggttcccgtccccgggttaccccccgg

SEQ ID NO: 11369 - DNA, 607 bp, Homo sapiens
  misc_feature: GYAE6OF01A63BO.16.86.H09.1.454.CMB.1.raw
  modified_base (346)..(346): a, c, t, g, unknown or other
  misc_feature (346)..(346): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtcgtttcctccctctttccgagggtcctgggcccagtctcgccctgactcagcctgccctccgtgtccgtgggtcctccgtggactagtcgatcatctattcttcgngcacgtggactccagcagtgtacgtttggttattataattgtcgtctcgtagtaccaacgtagtcgaccgagaccaaaccgacccctaaatcatgtattatgagtactagtaacgtccggtcccgttacgtacgggtttactaacgttccgtctttccgtcgttccggtaccttaccgtaacggttccgttacgggaccctaaccggacccggttcccccgtacccgtaccggaaccctacttcccgttccggtacccggg

SEQ ID NO: 11370 - DNA, 556 bp, Homo sapiens
  misc_feature: GYAE6OF01DDOK5.16.86.H09.1.454.CMB.1.raw
  modified_base (199)..(199): a, c, t, g, unknown or other
  misc_feature (199)..(199): n is a, c, g, or t
  modified_base (306)..(306): a, c, t, g, unknown or other
  misc_feature (306)..(306): n is a, c, g, or t
  modified_base (448)..(448): a, c, t, g, unknown or other
  misc_feature (448)..(448): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacngtcgatcatcatcttctgcactggatccagcagtgacgttgtagttataattatgtctcctggtaaccaacacgtaccaggcaaacgccccaaactcatgtatttangtaggtcagtaacgtcgccctcgagggtttctaactcgtcttctctggctcaacgtcgtcggcaacgcggcctccctgacctatctcgtcgggctccgaggcgtaggagacggagggttagaactttatacgtagcagtctntaactagtaaggagtgacagtctacgtcgttacgttagtcgggacgggtcggaacaagccgtcggacccgttcgtaacggtcacgacccaaggtcctcccggtccccg

SEQ ID NO: 11371 - DNA, 624 bp, Homo sapiens
  misc_feature: GYAE6OF01EBEAE.16.86.H09.1.454.CMB.1.raw
  modified_base (272)..(272): a, c, t, g, unknown or other
  misc_feature (272)..(272): n is a, c, g, or t
  modified_base (306)..(306): a, c, t, g, unknown or other
  misc_feature (306)..(306): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcattcttttgcactggatccagcagtgacgttggtagtttataattatgtctcctggtaccaanacgtaccaggacaacgccccaaatcatgatttangaggtcagtaactcggccctcgtagggtttctaatccgtcttctctcggcctaccaagttcaggcaacgaccggcctccctgacctattccgtcgtcgggcctccgaggtctgggaacggacggtagggttagtagtttacttacgtgacagtactacaagttaagtaaggtaaggttggacacgtacctacgttccgttacggttacggttccgggcggggtacggggaccctaacggtaccgttaccggtaacccggttacccgtaagggtcccacggaccccgtaacggtcccgtcccggtccccccgttacggg

SEQ ID NO: 11372 - DNA, 645 bp, Homo sapiens
  misc_feature: GYAE6OF01COXUG.16.86.H09.1.454.CMB.1.raw
  modified_base (368)..(368): a, c, t, g, unknown or other
  misc_feature (368)..(368): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (642)..(642): a, c, t, g, unknown or other
  misc_feature (642)..(642): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacacgggtcctgggtcctccactcggaaaccagcagtgacgttggtgttatactttgtctctgactaccaacagcaccaggacaaagcaaccaaattcatagtattagtgaaggtcaacttaacgtccggccctagtacgggttatttactagttctcttcgtcgtcgcctacgagtcgtacgaccaaccgccgtcctcctacgacctcttccgtcggcggtcctacggnggtacgtaggacggaacggcggtatagtatttatagttnactnttcaacgtaataaccaacaacccatacactctacctcgtacgttacggtcgttacgggacggacgacgacggtcgtaccgtccgtacgtacgtacgaccgtaccggaaccgtcccgtccccggtccccgttacgtacccgtacgttcccgttcccgtccccgtcccttacccgtacgtacgttaaccgtaccgtcgtacggcggtccggtcgacggacggacggacgatgngcg

SEQ ID NO: 11373 - DNA, 508 bp, Homo sapiens
  misc_feature: GYAE6OF01B4YVD.16.86.H09.1.454.CMB.1.raw
  modified_base (302)..(302): a, c, t, g, unknown or other
  misc_feature (302)..(302): n is a, c, g, or t
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatttctcctggtaccaacagtacccaggcaaagccccaaatcatgatttangagtcagtaatcgccctcagggtttctaatcgcttctctggctcaagtctgcaacncgcctcctgaccatctctggctccagctgaggacgaggtnattatactgcagctcatatagaagtgacagcactctacgtagttcggcggttggaccgtaagctagtcccgtccgtaggtccacgcccgaaaggctccgcccccgtacgg

SEQ ID NO: 11374 - DNA, 600 bp, Homo sapiens
  misc_feature: GYAE6OF01A8N5J.16.86.H09.1.454.CMB.1.raw
  modified_base (229)..(229): a, c, t, g, unknown or other
  misc_feature (229)..(229): n is a, c, g, or t
  modified_base (322)..(322): a, c, t, g, unknown or other
  misc_feature (322)..(322): n is a, c, g, or t
  modified_base (369)..(369): a, c, t, g, unknown or other
  misc_feature (369)..(369): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccaanagtgacgttggtagttataattatgtctcctggtaccaacacgtaccaggcaaacgcccccaaatcatgatttatgagtcagtaatcggcctnagggtttcaatcgcttctctgctcagtctgcacacgcctcctgaccntctcgtcgggctccgaggtcgtggaggtacggaaggtgtatttacttacgtcgactacgtcctacgaagttataacggaaggtcggtacgtagacctaaccttcgttaccggtaagttccgggtaccgggtacggggaacccgtaacggtccgttacggtaccccggtaccgttacgggacctaaccggaccccgtaaacgggcccttcccgggtccccccgttacccggg

SEQ ID NO: 11375 - DNA, 174 bp, Homo sapiens
  misc_feature: GYAE6OF01ADQ08.16.86.H09.1.454.CMB.1.raw
  modified_base (173)..(174): a, c, t, g, unknown or other
  misc_feature (173)..(174): n is a, c, g, or t
tcagtgtactactccacgaccggtgctcgatttagtgctatagacttgggtttgggggaagaggaagactgacggtcccccaggagttcaggtgctgggcacagcggccctgggctgcctggtcaaggactacttccgagtagtacactgagcgggctggcaaggcgcatagnn

SEQ ID NO: 11376 - DNA, 623 bp, Homo sapiens
  misc_feature: GYAE6OF01BRDY9.16.86.H09.1.454.CMB.1.raw
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
  modified_base (401)..(401): a, c, t, g, unknown or other
  misc_feature (401)..(401): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacaggtgacgcctccgaggggaaggggcttcgagggacctcgtgggctgatccttggtctcctgctcctcagctcgaccggggccagcactgactcacgtgcatgtcgtttcctcccttcgtttccgacgggtcctcggggccctagtcctacgccctgactcacgcctcgcctcggtgtcgtggtctcgtggacngtcatcatcagtcttcngctacgtgactccgagtcgtagttcgtacgtttaggtacgtttataagttntcgttaccttacgtacggtaaccaacgtaccgtaacccgacggaccaaacccgacccctaagtcctagtagtatttacgtcgagtactaggtaacgtccggtaccgtacggttacgggtttacctacgtcctccgttcgtcgtcgtcctacgtacgttcgtaccgacctacccggcccgtcccttacccgtacgacccgtacgttccgtcggtcggtacccg

SEQ ID NO: 11377 - DNA, 650 bp, Homo sapiens
  misc_feature: GYAE6OF01EM5E1.16.86.H09.1.454.CMB.1.raw
  modified_base (304)..(304): a, c, t, g, unknown or other
  misc_feature (304)..(304): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgacgttggtattataattatgtctcctggtaccaacagtaccaggcaaacgccccaaatcatgatttagngaggtcagtaatcggcctgtagggtttcaatcgtcttctcgtggctaccgtaagtctagggtaccaacgtaccggccctccctagaccctaattccgtccgtaggggccttccgaagggtccgttaggaacgggtaccggtaggggttcgttaagtttacttaacgtcggacgagtcctacgtaattaagtaaggaacggttggacaagtcctacgttccgttacggtaacgttccggggaccgggttacgggaaaccctaaggccgttaccgggtaaccccgttaccgttaacgggtacccaaaccggtaccccgtaaacgggtcccttcccgggtacccccccg

SEQ ID NO: 11378 - DNA, 174 bp, Homo sapiens
  misc_feature: GYAE6OF01CUSAQ.16.86.H09.1.454.CMB.1.raw
  modified_base (174)..(174): a, c, t, g, unknown or other
  misc_feature (174)..(174): n is a, c, g, or t
tcagtgtactactccacgaccggtgctcgatttagtgctatagacttgggtttggggggaagaggaagactgacggtcccccaggagttcaggtgctgggcacagcggccctgggctgcctggtcaaggactacttccgagtagtacactgagcgggctggcaaggcgcatagn

SEQ ID NO: 11379 - DNA, 943 bp, Homo sapiens
  misc_feature: GYAE6OF01A98HE.16.86.H09.1.454.CMB.1.raw
  modified_base (324)..(324): a, c, t, g, unknown or other
  misc_feature (324)..(324): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacgagggtcctgggcccagtctgccctgactcagctgcctccgtgtcgtgggtctccgtggactagtcgatcatcatcttctgcacgtggactccgagcaggtgtacgttggtagttataattatcgtctcctggtaaccaactacgtacccgaggaccaaaccgcccccaatctatagtatttagnggtacgtactagtaacgtccggaccttggttacgggtttactaacgtcgtcttcgtcgtcggtcctaccgtagtcgtacggaccaaaccgtccggtcccttaccctacgtaccctacgttcccgttaccggtaccggggtcccttacccgggagggttacccgtagggtaaaccggggtaacgggttacggggtttaacgtttaaacggtttttacgtttaacccggtacgggtacccgttaacgttacccgtttaaccgtaaaggtttaaaccggttaaacggggttaagggttaccccggtaaaccggtaacccgggttaacccgttaacccggttttaacccgggttttacccggggtttaaaccccggggttttacccgggggggttaaccccgggggggtttttaaaccccgggggaaaacccccggttaaaacccgggggtttaccccgggtttaaacccccggggttttaacccccccgggggttaaccccgggttttaacccgggggttaaacccccgtaaaacccccgggggttaacccccccgggggttaaaacccggggttcccccccccgggtttaccccccgggggttttaaccccccccccgggg

SEQ ID NO: 11380 - DNA, 671 bp, Homo sapiens
  misc_feature: GYAE6OF01CS3TJ.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccgaggggaaggggcttcgagggacctcgtgggctgatccgttggtcctcctgcctcctcgaggcctcgacccggggcccagcactgacctcactggcatgtctttcctccctctttccgacgggtcctcgggcccaggttcctcgccctgacctcgacgccctgcctccgtgtccgtcgggtcctccgtggactgtcgatcatctatcttcgcgctacgtcggactccgagtcaggtggtacgtttaggtaactttattaattagttcgttccttaccgtacggtaaccaacgtaacgtacccgaaggaacccaaaccgacccctaaactactaacgttacgttaatttacgtacggtacgttacgtaacggttaaccgtcccggtacccgttacggttacgggttttactaacgttccgtctttccgtccgttcggtaccttaccgacgttccgtacggaacctaaccgcccgtacccttcccgtacgaccctacgttaccgtccggtcgggtccccg

SEQ ID NO: 11381 - DNA, 736 bp, Homo sapiens
  misc_feature: GYAE6OF01E0NH2.16.86.H09.1.454.CMB.1.raw
  modified_base (248)..(248): a, c, t, g, unknown or other
  misc_feature (248)..(248): n is a, c, g, or t
  modified_base (733)..(733): a, c, t, g, unknown or other
  misc_feature (733)..(733): n is a, c, g, or t
tcagtgtactactccacgaccggtgctcgatttagtgctatagacttggggtttggggggggtctcaggaggcagcgctctcaggacatctccaccatggcctgggctctgctgcctcctcaccctcctcactcagggcacagggtcctgggtcctccactggaaccagcagtgacgttggtggttataactttgtctcctgataccaacagccacccaggcaaagccaacccaaattcatgatttangagtcactaatccgccctgtagggtttctaatcgcttctctggctccaagtctggcaacgaccggcctccctgacccatctcgtggcctcgaggtctggaggacgaggctgtatttagttattcgactatctactataactaaccaaacccaacgaccgcaaccgttccgtacgtaccgtttaggggttacgtttaccggggacggggtaacgggaacccgaaggtcccgttaccggtaacccggtttaccccggttaagggtccgtaaccggaccccggtaacgggtccccgttacccggtcccccccggttacccggttacctaaccccgtttccggtttaccccgttacccccccttaccccgttcccggtaccggttaaaccggttaaccggttacccgtaacccggtacggggtaacccgggtcccggggtacgttaccggggaacccgggtaacgggtcccggaacctaacgggtacgngcg

SEQ ID NO: 11382 - DNA, 584 bp, Homo sapiens
  misc_feature: GYAE6OF01BWXAT.16.86.H09.1.454.CMB.1.raw
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctctggtaccaacagtaccaggacaaacgcccccaaactcatgtatttagtagaggtcagtaatcggtcctcgagggtttctaatcgtcttctctggctcagtctggcaacgacggcctccctgacctatcctcgtcggggtcctcgacggtcgtaggaggtacggaggggttgtaatttaattacgtggtaccagtccttacaagttaactaaggaaggttcggacacgtactaccttcgtcgttagttccggggacggttcgggaacctaggtcctcggtacccgtccgttaggtccaacggcccgaacggccgttccggtcccccg

SEQ ID NO: 11383 - DNA, 500 bp, Homo sapiens
  misc_feature: GYAE6OF01CKVES.16.86.H09.1.454.CMB.1.raw
  modified_base (356)..(356): a, c, t, g, unknown or other
  misc_feature (356)..(356): n is a, c, g, or t
  modified_base (369)..(370): a, c, t, g, unknown or other
  misc_feature (369)..(370): n is a, c, g, or t
  modified_base (466)..(466): a, c, t, g, unknown or other
  misc_feature (466)..(466): n is a, c, g, or t
  modified_base (491)..(491): a, c, t, g, unknown or other
  misc_feature (491)..(491): n is a, c, g, or t
  modified_base (497)..(497): a, c, t, g, unknown or other
  misc_feature (497)..(497): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtgttataactttgtctcctgataccaacagcacccaggcaaagcaccaaattcatgatttatgaggtcactaatcggccctcaggggtttctaatcgcttctctggctccagtctggcaacacggcctcctgaccatctctgggctcagctgagacgagctgattattatgcatctnatatacaacaacnncactctcgactgtattcggcggaggaccagcgtgaccgtcaggtcagcccaaggctcgccccgtgtcactctcgtcccaccctcctcgactagacncgtgacgcgggctggcgaaggcganactagntcg

SEQ ID NO: 11384 - DNA, 544 bp, Homo sapiens
  misc_feature: GYAE6OF01BGK9R.16.86.H09.1.454.CMB.1.raw
  modified_base (302)..(302): a, c, t, g, unknown or other
  misc_feature (302)..(302): n is a, c, g, or t
  modified_base (378)..(378): a, c, t, g, unknown or other
  misc_feature (378)..(378): n is a, c, g, or t
  modified_base (475)..(475): a, c, t, g, unknown or other
  misc_feature (475)..(475): n is a, c, g, or t
  modified_base (535)..(535): a, c, t, g, unknown or other
  misc_feature (535)..(535): n is a, c, g, or t
  modified_base (541)..(541): a, c, t, g, unknown or other
  misc_feature (541)..(541): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcaccaggcaaagcacccaaattcatgatttatgagtcactaagtcggccctcgagggtttctaatcgcttctctggctccagtctggcaacncgcctcctgaccatctctgggctccaggctggacggacgaggctgattattatgcatctacatataccaacctaanacgcactctcgactggtattcggcggacggaccagctcgaccgtctaggtcacgcccgaaggcctccgcccccgtgtacctaccttctccgtccccncctccgtcgtacgtacgtaccgtacgtggacggccggtcgtcgggacgtacgggccgtanacgtgntcg

SEQ ID NO: 11385 - DNA, 572 bp, Homo sapiens
  misc_feature: GYAE6OF01CXPDL.16.86.H09.1.454.CMB.1.raw
  modified_base (200)..(200): a, c, t, g, unknown or other
  misc_feature (200)..(200): n is a, c, g, or t
  modified_base (307)..(307): a, c, t, g, unknown or other
  misc_feature (307)..(307): n is a, c, g, or t
  modified_base (402)..(402): a, c, t, g, unknown or other
  misc_feature (402)..(402): n is a, c, g, or t
tcagtgtactactccacgaccggtgctcgatttagtgctatagacttggggtttggggggggtcgtcaggaggcagcgctctcaggacatctccaccatggcctgggctctgctgctcctcaccctcctcactcagggcacagggtcctgggcccagtctgccctgactcagcctgcctcgtgtctggtctccgtggacngtcgatcatcatcttctgcacgtgactccagcagtgtacgttgtagttataattatgtctcctgtaccaacacgtaccagaccaaacgaccccaactcatgtattangacgtcagtactcgcctcgtaggttctactcgtcttcgtctgcctactagtctagacacgaccgtcctcctacgtacctactctcgcggtctcgngtctggacggacgtagggtcttacgttagtacgtgtctacgctacaattacgtaggtacgtcggcgtacgcgtacgtcgttacgttacggtaccggtcgggtacggtacacggtacgtcgtacccgttcgtacggtacccgacgtaccgacggtccctccgtacccccgg

SEQ ID NO: 11386 - DNA, 185 bp, Homo sapiens
  misc_feature: GYAE6OF01CAEJ6.16.86.H09.1.454.CMB.1.raw
  modified_base (174)..(185): a, c, t, g, unknown or other
  misc_feature (174)..(185): n is a, c, g, or t
tcagtgtactactccacgaccggtgctcgatttagtgctatagacttgggtttggggggaagaggaagactgacggtcccccaggagttcaggtgctgggcacagcggccctgggctgcctggtcaaggactacttccgagtagtacactgagcgggctggcaaggcgcatagnnnnnnnnnnnn

SEQ ID NO: 11387 - DNA, 756 bp, Homo sapiens
  misc_feature: GYAE6OF01BCHM7.16.86.H09.1.454.CMB.1.raw
  modified_base (150)..(150): a, c, t, g, unknown or other
  misc_feature (150)..(150): n is a, c, g, or t
tcagtgtactactccacgaccggtgctcgatttagtgctatagacgttggggtttggggggggtctcagggaggcgagccgctctcaggaacagtcgtcctaccatggcctggctctgctgactcctcacctcctcactcagggctacgnggtcgtggccctggttctcgtcctgtacttcagcctcgctcgtgtcgtcgggtcctccgtggtacgtaggtcgtagtcggtacgtcgtcgttcttcgtcgcgtaaaaacggtcggtactaccacgtcgtacggttacggtacggttaggttaacgttaagtttaaggtttatttaccgtcgttaccgttaaccgtaaccgtaacgttaacgtaccgaacgaaccgtaacccgaaccctaacgtcgtacgtacgtagttagtcggtacggtaacggtaacggtacgtccggtaccggttacggttacggttacgtacgttcgtcgttcgtgtcgtacgtacgtagtacgtacgacgtacgccgtccgtacgacgtactacgtcgtcggtaccgtctacgtaggtacgaaggtaacggtaacggttacgtaacgttaacttagtaacgtgtacgtaacgtctaactaagtaagtaacggagtacgaccgtaagtcccgtacggaaccgttcggtacggtcggggttacggtaccggtaaagttccgtacggtccgtaccggttaagtcggtaccggtacgggtacgtacggtccgtacccgtacccgg

SEQ ID NO: 11388 - DNA, 275 bp, Homo sapiens
  misc_feature: GYAE6OF01AHGUA.16.86.H09.1.454.CMB.1.raw
  modified_base (248)..(275): a, c, t, g, unknown or other
  misc_feature (248)..(275): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtctaggtcagcccaaggctcgccccctggtcactctcgttcccgcctcctcgagtagtacactgacgcgggctggcaaggtcgcatacgnnnnnnnnnnnnnnnnnnnnnnnnnnnn

SEQ ID NO: 11389 - DNA, 659 bp, Homo sapiens
  misc_feature: GYAE6OF01B09QI.16.86.H09.1.454.CMB.1.raw
  modified_base (248)..(248): a, c, t, g, unknown or other
  misc_feature (248)..(248): n is a, c, g, or t
tcagtgtactactccacgaccggtgctcgatttagtgctatagactttggggtttgggggggggtctcaggaggcagcgctctcaggacatctccaccatggcctgggctctgctgctcctcaccctcctcactcagggcacagggtcctgggtcctccactggaaccagcagtgacgttggtgttatactttgtctcctgataccaacagccacccaggacaaagccaacccaaattcatgatttangagtcactaagtccggccctcgaggggtttctaatcgtcttctctggctcaagtctggcaacgacggcctccctgaccatctctgggcctccgaggctgaggacgaggctgtattattattgctatctacaatactaacaaaccaacacgaccactcctacgtacgtggttacgttaccgggcggacgggtaaccgaagtccgtacggacccgttccgtacggtccaacggcccgtaacggccgtacccggtaccccccgtccgggtaccctaccgttccgttacccgttacccccctacccgttccccgttacggtaaccggttaaccgtaaccgtaccggttacgggacgggtcccggggaccgttaccgggaaccggtaaccggggctaaccggtagttacgcgtacg

SEQ ID NO: 11390 - DNA, 819 bp, Homo sapiens
  misc_feature: GYAE6OF01EPZHZ.16.86.H09.1.454.CMB.1.raw
  modified_base (207)..(207): a, c, t, g, unknown or other
  misc_feature (207)..(207): n is a, c, g, or t
tcagtgtactactccacgaccggtgctcgatttagtgctatagacttggggtttgggggggggtctcaggaggcagcgctctcaggacatctccaccatggcctgggctctgctgcctcctcaccctcctcactcgagggcacgagggtcctcgggcccagtctcgccctgactcacgcctcgcctcgtgtcgtggtctcgtggacngtcgatcatctacttcgttctgcctacgtggactccagactaggttcggtacggtttaggttaatttaattaagtttattccgttcctaccgtacggtaacccaacgtaccggtaaccccgaacggaaacccaaaacccgtacccccctaaatcgtaacgttacgttaattttaggacggtaacggtacgtaaacggtaccgtccggtaccccgttagggttaacgggttttacctaacgttccgttactttcgtccggttaccggtacctttaccgtaggttcccgtaaccggtaacctaaacccgtccccggttccctaccccgtacgtaacccttcgttcccgttcgggtaccgggtaccccgtacggtacggtacggtaggggaacgggtaaggttacgggttaacttaaggtttaacctcgtacggacctacggtactaacgtaagttaaccgagggttaacgtcgaaccgttacgtcctaacggttccgtacggttacgggtcccgggagggttaacccgacgttaaccgccggtccgggttaacccgtacgggaccggtaaccgtacccggaacccggttcgtccccccgtacccggttaccccg

SEQ ID NO: 11391 - DNA, 577 bp, Homo sapiens
  misc_feature: GYAE6OF01CJWEX.16.86.H09.1.454.CMB.1.raw
tcagtgtactactccacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtaccaggcaaacgcccccaaactcatgatttatggaggtacagtaatccggcccttcgtagggtttctaagtcgtactttctcgtggtctacctaagtctaggacaaccgacggtccctccgtcgaccattctcgtgggcctccgaggtctaggacggtcgagggtgtattattactgacagtctcataagtagaagtgacagctactcgtcgttacgttccgggtcgggtacggaccgtaaggccttacgggaccccgtccgttacggtcccacggtaccccacgggtcctccggtcccccccg

SEQ ID NO: 11392 - DNA, 599 bp, Homo sapiens
  misc_feature: GYAE6OF01BFL5T.16.86.H09.1.454.CMB.1.raw
  modified_base (269)..(269): a, c, t, g, unknown or other
  misc_feature (269)..(269): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaanacgtaccaggcaaacgcccccaaactcatgtatttatggtaggtcagtaactcggcccttgtaggggtttctaagtcgtcttctctgctcgagtcgtcggacaacaccggcctcctcgacctattcctcgtcgggtcctccgaggctgggaacggtacggagggtagtattattacgtgacgcgtactctaattaacgtaggtaacggtggacacgcctaccgttcgttaccggtacgttccgggcggggtacgggacctaaggtccgtaccggacccgttaccgtacggttacaccggaccccgaacggtcccgtcccggtccccccgg

SEQ ID NO: 11393 - DNA, 692 bp, Homo sapiens
  misc_feature: GYAE6OF01C1KLN.16.86.H09.1.454.CMB.1.raw
  modified_base (689)..(689): a, c, t, g, unknown or other
  misc_feature (689)..(689): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacgaggtcctgggtcctccactggaaccagcagtgacgttggtggttatactttgtctcctgactaccaacagccacccgaggaccaaaacgccaacccctaaaattcaattgtaattttagtggaggtcaactaacgtccggcccttcggtaggggtttctaagtccgtcttctctcggctccaagtccgtggccaaccgaccggcccttacccgtcgacctactctccgtcgggcctccggacggtcgtggacgggacggtacggactgtaactttatttatcgactattctactaataactaacaaaccaacacgtaccactccgtaccgtacgttacgggttacgttaccgggacgggtaacgggaccgaacggtaccgtcggtacccgtaccgtacggtccgacggtaccgaacggtcctacccggtcccccgttcggtacccgtacttcccgttcccgttacccctacccgttaccttacggtaacgttaccgtacgtacgtcggtacgggccgggtacgtaggccgaaacgggcgactagtcgntcg

SEQ ID NO: 11394 - DNA, 661 bp, Homo sapiens
  misc_feature: GYAE6OF01ABZ75.16.86.H09.1.454.CMB.1.raw
  modified_base (215)..(215): a, c, t, g, unknown or other
  misc_feature (215)..(215): n is a, c, g, or t
tcagtgtactactccacgaccggtgctcgatttagtgctatagacttgggtttgggggggtctcaggaggcagcgctctcaggacatctccaccatggcctgggctctgctgctcctcaccctctcactcagggcacagggtcctgggcccagtctgccctgactcagcctgcctcgtgtctgggtctccgtggacagtcgatcatcgatcttcngcactggatccagcagttgacgtttggtagttataattatcgtctcctaggtaccaacacgtaccaggtcaaaacgtcccccaaacttcatcgtatttacgtaggaggtcaagttaactccgggtacccttcgtacggggttttacctaacgtcggtcctttctcgtcggtaccttcccgaagttctacgggacctaaaccgtccggacccttccccgtaggtaaccccacgtttccgtaccgttcggggccttacccgaggtcgttaggacgggtacggagggttataacgtttacgttacgtcgtaccgtagtcctaacgtagttaacgtaggtacggtggacttacggacaccgttcgtcggtacgtcggacggtacggaccaagtcctcggacccttacgtacggtaccaccgacccgtaacggtcccgtaccggtcccccg

SEQ ID NO: 11395 - DNA, 739 bp, Homo sapiens
  misc_feature: GYAE6OF01AX69N.16.86.H09.1.454.CMB.1.raw
tcagtgtactactccacgaccggtgctcgatttagtgctatagacttggggtttggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtctccgtggacagtcgatcatcatcttctgaccactggactccagcagtgtacgttaggtagttaatattatcgtctccgtacgtaaccaacgtacgtacccgaggaccaaaccgacccccaaatctatagttactttagacgacggttacacgtaacgtccggtacccgttaggttaacgggtttactaacgtaccgtccttcgtcggttacgaccttaaccgtaacggttcgtacggacctaaaccgcccggtaccctcccgtacgaaccttacgttaccgttcggtcgggtccctacgacggtcgtaagggacgggtacggtacggtagttaactttacgtacgtagcgtacgtactactaagttaagaaggtaacgggtcggactacgtaccttacggttcgttacggttaccggttaccggggtacgggttaccgggtaaccgaacggttcccggttaaccggtacccgggttaacccgtttaagggccccgtaacccgggtaacccggaccgggttcccctacccccgggttaacccccgg

SEQ ID NO: 11396 - DNA, 654 bp, Homo sapiens
  misc_feature: GYAE6OF01D4MZ2.16.86.H09.1.454.CMB.1.raw
  modified_base (317)..(317): a, c, t, g, unknown or other
  misc_feature (317)..(317): n is a, c, g, or t
  modified_base (506)..(506): a, c, t, g, unknown or other
  misc_feature (506)..(506): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctgccctgactcagcctgcctccgtgtctggtctcctggacagtcgatcatcatcttctgcactggactccagctagtgacgttgtatataattatgtctcctagtaccaactagtaccaggaccaaacgaccccaatctatgactttagtagaggtanaacgtaactcggaccttcgtaagggttctaactcgacttctcttcggctactaacgtcgtacgtaccaaccgtaccggtccctacccgtacgtaccttacgttccgttaccgtcgggtaccttaccgacggtccgtaggacgggtaaccggtaagggtacttaagttagtacttaggactacgacttanaaacgttagtaaggtaaggtccgacgtacgaaccttaccgtagttaccgttagttccggggaaggtacggaaccctaagggtccctagggtaccccgtacgttaacggtaccaccggacccgaacggtcccaccggttacccccccgg

SEQ ID NO: 11397 - DNA, 633 bp, Homo sapiens
  misc_feature: GYAE6OF01DS4ST.16.86.H09.1.454.CMB.1.raw
  modified_base (302)..(302): a, c, t, g, unknown or other
  misc_feature (302)..(302): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactgatccagcagtgacgttgtagttataattatgtctcctgtaccaacagtaccaggccaaacgccccaaatcatagtatttangagtcaagtaactccggcctgtagggtttactaatcgtcttcgtctggtctcaagtctcgacaacgaccggccttccctacgaccgtacttcctcggtacgggtcccttaccggaggtccgtagggaacgggtacggtacggggttacgttatttaactaacgttcgacctacggtctacgtaaacgttaagtacggtaaaggttcgggactaacgtcctaactccgttaactacgttacggttccgggtacggggtaccggaacctacggtctacccggtacccgttcggtaacgaccggtaaccgcccggtaacgcccgttacccccgg

SEQ ID NO: 11398 - DNA, 664 bp, Homo sapiens
  misc_feature: GYAE6OF01BKS0S.16.86.H09.1.454.CMB.1.raw
  modified_base (243)..(243): a, c, t, g, unknown or other
  misc_feature (243)..(243): n is a, c, g, or t
  modified_base (306)..(306): a, c, t, g, unknown or other
  misc_feature (306)..(306): n is a, c, g, or t
  modified_base (659)..(659): a, c, t, g, unknown or other
  misc_feature (659)..(659): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctcctcactcagggcacagggtcctgggtcctccactggaaccagcagtgacgttggtggttatactttgtctcctgataccaacagcacccaggcaaagcaccaaattcatgatttangaggtcactaatccggccctcgaggggttttctaatcgcttctctggctccagtctggcaacnccggcctcctgaccatctcgtggcctccaggctggaggacggaggctagtattattattgctatctacatactaacaaacctaacacgcctactcgtacgtacgttcggtacgttcgggacgggagggaacccgaaggtcctacggtacccgttaccgtacggtcgaccggacccgaacgggtccctccggtcccccccgttcgggttacctacccgttcccttcccgtttacccccctaccccgtttacccgtccggtaaacggttaccgttaaaccgtaccggtttacggggacgggtcccggggtacgttaccggggaccggtaacgggtcggaacccgtaaggttacgngtacg

SEQ ID NO: 11399 - DNA, 751 bp, Homo sapiens
  misc_feature: GYAE6OF01D4NNQ.16.86.H09.1.454.CMB.1.raw
  modified_base (171)..(171): a, c, t, g, unknown or other
  misc_feature (171)..(171): n is a, c, g, or t
  modified_base (214)..(214): a, c, t, g, unknown or other
  misc_feature (214)..(214): n is a, c, g, or t
  modified_base (261)..(261): a, c, t, g, unknown or other
  misc_feature (261)..(261): n is a, c, g, or t
  modified_base (746)..(746): a, c, t, g, unknown or other
  misc_feature (746)..(746): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctcctcactcagggcacgagggtcctgggtcctccacgtcggaaccngcagtgtacgttggtgttattactttgctcctgactaccaacngccacccgaggacaaagcctaaccctaaattcaattgtacttttagnggacgtacaacttaacgtcccggcccttacggtagggtttactaagtccgtactttcgtcgtcggtccttacgtaacgtcgtcggaccaaaccgtccggtccctacccgtacgaaccctacttccgtaccgtcgggtcctaccgacggtcgtagggacggaacggtggtacttacggtatttattactcgacttaactcttactacttaacaaccaaacctacacgtacctaaccttcgtacgtacgttacgggtttacggtccggggaacgggaacggaaccctaggtccgtacggtacccgtccggtaacggtccgaacgtaccccggtaagtccccggttaaccccggtccccgttacggtcccttacccgttcggttaccccgttccccgccctttaccggtaaccggttacggtaccgtaccgtcgggttagggacccggtcgggtaccgacgggaccggtaacggccgtaagacgttgngtacg

SEQ ID NO: 11400 - DNA, 675 bp, Homo sapiens
  misc_feature: GYAE6OF01DNQZP.16.86.H09.1.454.CMB.1.raw
  modified_base (209)..(209): a, c, t, g, unknown or other
  misc_feature (209)..(209): n is a, c, g, or t
  modified_base (270)..(270): a, c, t, g, unknown or other
  misc_feature (270)..(270): n is a, c, g, or t
tcagtgtactactccacgaccggtgctcgatttagtgctatagacttgggtttggggggggtctcaggaggcagcgctctcaggacatctccaccatggcctgggctctgctgcctcctccaccctcctcactcgaggcacgagggtccgtgggcccagtctcgccctgactcgacgcctcgcctccgtgtcgtcggtctccgtggacngtcgatcatctattcttctcgctacgtgactccagctagtgtacgttgtaagttataattntgtcctcgtagtaccaacacgtaccgacgaccaaccgaccccaactcagtagtatttgtagtaggtactagtaacgtccggtccctagtacgggtttactactcgtacttcgtcgtcgtcctaccgtagtctacggacctaaaccgccggtacccctccgtacgtaccctaacgtttccgtcggtacgggtcctaccggtacgggtccgtaagggaacgggtacggtagggttagtaacgtttacgttacgtgacgtacgtctacgtatagtaaggtacgtacgcaactccgtacttcgtaccggtttacggtcgggaccggtacggtaacgtaacgtcgtccgggtaacccgttaccggacgtaccgaacccacccggtaacggtcccgtcccgtaccccccgg

SEQ ID NO: 11401 - DNA, 597 bp, Homo sapiens
  misc_feature: GYAE6OF01CGTS0.16.86.H09.1.454.CMB.1.raw
  modified_base (384)..(384): a, c, t, g, unknown or other
  misc_feature (384)..(384): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (471)..(471): a, c, t, g, unknown or other
  misc_feature (471)..(471): n is a, c, g, or t
  modified_base (478)..(478): a, c, t, g, unknown or other
  misc_feature (478)..(478): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccgaggggaaggggcttcgaggggacctcgtggggctgatccttggtctcctgcctcctcaggcctccgacccggggcccagcactgactcactggcagttgttcgtttcctcccttcttttcccgaggggttccctcggggcccctaggttcctcgtccctgacctcgacgtccctcgtcccttcggtgttcgtcgggtcctccgtggactacgtcgaatcatcattcttcngctacgtgactccagctaggtgtacgttgtaattatatntntctcgtacgtaccaacgacgtaccagaccaaaccgcccaatcagtntattagngagtacgatacgtccgtccgtacggtcgggtttactacgttcgtcttcgtcgtcgctaccgtacggtcgtacggacctaccgccgtccctcccgtcgaccctatccgtcgtcggtcccg

SEQ ID NO: 11402 - DNA, 717 bp, Homo sapiens
  misc_feature: GYAE6OF01C3P4E.16.86.H09.1.454.CMB.1.raw
  modified_base (225)..(225): a, c, t, g, unknown or other
  misc_feature (225)..(225): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctcctcactcagggcacgagggtcctgggcccagtctgccctgactcacgcctcgcctcgtgtcgtgggtcctccgtggacagtcgatcatcattctttcncgacacgtaggactccgagcgaggtgttacggtttaggttaattttattaattgtcgttccttaccgtacggtaacctaacgtaccggtaccgaacggaaccaaaccccgtaaccccctaaatctaacgttagttacgtttagtacggtaggtactaaacggttacgtccccggtaccgttacggtttaggttactaacgtcgttcttcgtcgtcgtctaccgtagtcgtacggaccaaccgtccgtccctcctacgacctacgttcccgtggtccggacctcggacgggttcgtacgggaaggggtacggtacggttagttactttaacgtacgtgtacaccgtattactaagttacggtaagggtaacgtcggaactcggtacctacggttcgttacggttacgggtcgggtacggtaagacccggtaattccggtacgtcccggtaccgttagaacccggaccgaccgtacggcccgttcccgtcccgg

SEQ ID NO: 11403 - DNA, 247 bp, Homo sapiens
  misc_feature: GYAE6OF01ERYCN.16.86.H09.1.454.CMB.1.raw
  modified_base (246)..(247): a, c, t, g, unknown or other
  misc_feature (246)..(247): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctcggtcactctgttcccgccctcctcgagtagtacactgagcgggctggcaaggcgcatagnn

SEQ ID NO: 11404 - DNA, 798 bp, Homo sapiens
  misc_feature: GYAE6OF01ES502.16.86.H09.1.454.CMB.1.raw
tcagtgtactactccacgaccggtgctcgatttagtgctatagacttgggtttggggggggtctcaggaggcagcgctctcaggacatctccaccatggcctggctctgctgctcctcaccctcctcactcagggcacgagggtcctggcccagtctgccctgactcagcctgccctcgtgtcgtgggtctccgtggacagtcgatcatctattccgttctgcacgtggactccgagcaggttgtacgtttggtagttaattattatgtcctctacgtaccaacacgtaccaggaccaaaccgtaccccaaactcattacgtagtttagtagtacggtataacgtaacgttccggtaccccgttacggttacgggttttacctaacgttccgttactttccgtacgttcgaccgttaaccgtaacgttccggtacggtacccaaaccgtacccggtccccttcccgtacgtaacctacgttccgttaccggtcggtcccgtaccggtacgtccggttagggaacgggtacggtacgggttacggtttaactttaacgtttacgtaccggtacgtaccgtaccgttaacgtaaacgttaaggttaaacggtagggttaaccggtaccgtaacgttacccgttaaccggttccggttaccggtttacccggggttaccggggtccgggtttaaaccgggaccgtaaccggttacccgtacccgggttacccgtttaccggtaaccgggtacccgaaccgggtaaccccgtaacccggttccgtcccccggttacccccgg

SEQ ID NO: 11405 - DNA, 537 bp, Homo sapiens
  misc_feature: GYAE6OF01D5KLM.16.86.H09.1.454.CMB.1.raw
  modified_base (419)..(419): a, c, t, g, unknown or other
  misc_feature (419)..(419): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgaggtcagtaactcggccctgtagggtttctaatcgcttctctggctccaagtctgcaacacggcctccctgaccatctcgtcgggtctccgaggctggacggacggagggtntatttagtactgactagctcatagtaagagtggacagctactctacgtagttccgggcggtgggaccaagcgtcgacccgtcgtacggtccaacgcccaacggtccgtcgtccccccg

SEQ ID NO: 11406 - DNA, 630 bp, Homo sapiens
  misc_feature: GYAE6OF01C2BUD.16.86.H09.1.454.CMB.1.raw
  modified_base (311)..(311): a, c, t, g, unknown or other
  misc_feature (311)..(311): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacagggtcctgggcccagtctcgccctgactcagcctgcctccgtgtctgggtctccgtggacagtcgatcatcattcgttctgcactggactccagcagtgtacgttgtattataattatgtctctagtaccacacgtaccagacaaaccgaccccaactcatgtatttagnggtagtctagtacgtccggacctcggtacgggttactaagtcgtcttctcgtcgtctctacgtctaggaccaacgccgtccctcccgacgtactactctcgtcggtcctaccgaggtcgagggaacggacgggtagggtacgttaatttaagtcgtacgctaacgtctacgtaatagttaacggtagggtcgtacgacgtccttacgttccgttacggtttacggtccggggtaccgggtacggtaaccgaggttccgttaccgacccggttacgacggtaccgacgacccggtaacggtcccgtccccggttaccccg

SEQ ID NO: 11407 - DNA, 595 bp, Homo sapiens
  misc_feature: GYAE6OF01B7MXW.16.86.H09.1.454.CMB.1.raw
  modified_base (310)..(310): a, c, t, g, unknown or other
  misc_feature (310)..(310): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactggactccagcagtgacgttggtagttataattatgtctcctggtaccaacacgtacccaggaccaaacgcccccaaactcatgtatttangtaggtcagtaactccggccctcgtagggttctaagtccgtcttctctggctacgtagtctggacaacgcggccctcccgtcgacctatccgtcgtcgggcctccgaggtcgtaggacgggtacggtagggtataagtttacgttacgtcggactacgctatataagtaggagtcggactacgtcctacttccgttggtacgttcgggacgggttacgggacctaggtccgtcggtacccgttacgtacggtccacggacccgacggtcccgtccgtccccccgg

SEQ ID NO: 11408 - DNA, 577 bp, Homo sapiens
  misc_feature: GYAE6OF01AE87Z.16.86.H09.1.454.CMB.1.raw
  modified_base (361)..(361): a, c, t, g, unknown or other
  misc_feature (361)..(361): n is a, c, g, or t
  modified_base (414)..(414): a, c, t, g, unknown or other
  misc_feature (414)..(414): n is a, c, g, or t
  modified_base (431)..(431): a, c, t, g, unknown or other
  misc_feature (431)..(431): n is a, c, g, or t
  modified_base (457)..(457): a, c, t, g, unknown or other
  misc_feature (457)..(457): n is a, c, g, or t
tcagtgtactactccacgaccggtgctcgatttagtgctatagacttgggtttggggggggtctcaggaggtagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtaccagcaaacgccccaaactcatgatttatgaggtcagtatcggccctcgtaggggtttctaatcgtcttctcgtgctcagtctgcacncggcctccctgaccatctcgtcgggcctcgaggcgtaggagggacgtagggtntatttacttacgtgacngtctctaagtagtaaggtagtcgggnacgtcacgtcgttacgttacgttcgggtaccgggtagggaccgtacggtccgttacggccccggttccgtaacggtccgaaccggtacccgaggtccctccggtcccccggttacccggg

SEQ ID NO: 11409 - DNA, 708 bp, Homo sapiens
  misc_feature: GYAE6OF01CGSW1.16.86.H09.1.454.CMB.1.raw
tcagtgtactactccacgaccggtgctcgatttagtgctatagacttggggtttgggggggggtctcaggaggcagcgctctcaggacatctccaccatggcctgggctctgctgctcctcaccctcctcactcagggcacaggtcgaccgcctccgaggggaaggggtcttcgacggggacctcgtggggctgactccgttggtcctcctgcctcctcgaggcctccgaccgggcccagcactgactcacgtggctattcgttcgttttcctcccttcgttttaccggacgggttccctcggggccctaggttcctcgccctagacctcacgtccctgtcccgtacgttgtccgtcggtcctccgtaggactacgtcgatctactctattcttacgcgactacggtggactccgagtacgtacggttagtacgggtttagttaaacgttaaattacgtttactcgttaccgttcgaacggtaaccaaccgtacggaaccctaacgggaacccaaaacccggtacccaaacgtctaacgttacgttaacgtttagtacggtaacggttactaacggttacccgtccggtacccgttagggttaacggtttacctacgttccgttctacgtcgtacgcccttaagacgttccgacgtaccgacctacccggtccctacggtaactacccagttcccgtggtacgtcccg

SEQ ID NO: 11410 - DNA, 532 bp, Homo sapiens
  misc_feature: GYAE6OF01AYQLA.16.86.H09.1.454.CMB.1.raw
  modified_base (245)..(245): a, c, t, g, unknown or other
  misc_feature (245)..(245): n is a, c, g, or t
  modified_base (302)..(302): a, c, t, g, unknown or other
  misc_feature (302)..(302): n is a, c, g, or t
  modified_base (320)..(320): a, c, t, g, unknown or other
  misc_feature (320)..(320): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
  modified_base (381)..(381): a, c, t, g, unknown or other
  misc_feature (381)..(381): n is a, c, g, or t
  modified_base (398)..(398): a, c, t, g, unknown or other
  misc_feature (398)..(398): n is a, c, g, or t
  modified_base (439)..(439): a, c, t, g, unknown or other
  misc_feature (439)..(439): n is a, c, g, or t
  modified_base (488)..(488): a, c, t, g, unknown or other
  misc_feature (488)..(488): n is a, c, g, or t
  modified_base (512)..(512): a, c, t, g, unknown or other
  misc_feature (512)..(512): n is a, c, g, or t
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagccacccaaattcatgatttangaggtcactaactccggccctgaggggtttctaatcgcttctctggcctcgaagtcnggcaacgaccggcctccngaccatctcgtggcctcgaggctggaggacgaggctatattattnttcgntatctacatanaaccaacacagcactcngacgttggtacgtcgggacggaaggaccagctgtacctcgngtcacgaccgaggcctccgccctggtcctacctcgtcctccccactccngtacgtagcgtactggaggccggngtcggacgagcganagtgcn

SEQ ID NO: 11411 - DNA, 694 bp, Homo sapiens
  misc_feature: GYAE6OF01C6PFV.16.86.H09.1.454.CMB.1.raw
  modified_base (319)..(319): a, c, t, g, unknown or other
  misc_feature (319)..(319): n is a, c, g, or t
  modified_base (652)..(652): a, c, t, g, unknown or other
  misc_feature (652)..(652): n is a, c, g, or t
  modified_base (687)..(687): a, c, t, g, unknown or other
  misc_feature (687)..(687): n is a, c, g, or t
  modified_base (692)..(692): a, c, t, g, unknown or other
  misc_feature (692)..(692): n is a, c, g, or t
  modified_base (694)..(694): a, c, t, g, unknown or other
  misc_feature (694)..(694): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctcctcactcagggcacgagggtcctcgggtcctccacgtggaaccagcagtgacgttggtggttatactttgtctctgactaccaacacgcacccgaggacaaacgtccaacctaaattcatagtatttagaggtacggtacacttaaacgtccggtccctacggtacggggtttactaacgtccgtcttctcncggtcctacgagtactcggacctaaccgaccggtccctccctacgacccacttcgtcgtacgggtcctaccgaggtccgaggtacggacggcgtacttagtaatttacttattcgtacactctactaactaaccgaaactaaaccacacgtctacctcgtaaccgtacgttcgggttacggtacgggtaccgggaacgggtaaccgacgtaccggttacgacccgtacggtacggtacaccggaccggtacgtccgtccccggtcccctccggtacctaccgttaccgttccctaccccgtcccgtcgtccgtaacggttaccgacgtaccgnggacggtccggacggtacggacgtacggccgtaanctcgngn

SEQ ID NO: 11412 - DNA, 309 bp, Homo sapiens
  misc_feature: GYAE6OF01EPTSF.16.86.H09.1.454.CMB.1.raw
  modified_base (300)..(309): a, c, t, g, unknown or other
  misc_feature (300)..(309): n is a, c, g, or t
tcagtgtactactccacgaccggtgctcgatttagtgctatagacttgggtttggggggtgtggtggtctccactcccgcctcgacggggctgctatctgcctccctgaccatctctgggctccaggctgaggacgagggtgattattactgcagctcatatagaagtggcagcactctcgtattcggcggtgggaccaagctgaccgtcctaggtcagcccaaggcctcgccccctggtcactctcgttccccacctcctcgagtacgtacactgagccgggctggcaaggcgcatagnnnnnnnnnn

SEQ ID NO: 11413 - DNA, 627 bp, Homo sapiens
  misc_feature: GYAE6OF01BRV9S.16.86.H09.1.454.CMB.1.raw
  modified_base (248)..(248): a, c, t, g, unknown or other
  misc_feature (248)..(248): n is a, c, g, or t
  modified_base (624)..(624): a, c, t, g, unknown or other
  misc_feature (624)..(624): n is a, c, g, or t
tcagtgtactactccacgaccggtgctcgatttagtgctatagacttggggtttggggggggtctcaggaggcagcgctctcaggacatctcccaccatggcctgggctctgctgctcctcaccctcctcactcagggcacagggtcctgggtcctccactggaaccagcagtgacgttggtggttataactttgtctcctgataccaacagccacccaggacaaagcaacccaaattcatgatttangagtcactaagtccggccctcgaggggtttctaactcgtcctttctctcggtctccaagttcgtcggaccaaccaccgggtcccttccccgtcgaacccaacttccgttccgtcggggtccctcccgaaggtccgttacggaacgggaccggacggtctacgtatttaagtttatttcggactattcctacaagtaactaccaaaccaacagcctacgtctcgacttcggtatcgggcggaaggaccagcgtacgaccgtcgtagcgacaccgacgctccgccccgtgtacctactccgtccgttccccgccctccgtacgtacgtactaccgcgtacggacggcggactcgggaccacgggacgacgattacggngtc

SEQ ID NO: 11414 - DNA, 744 bp, Homo sapiens
  misc_feature: GYAE6OF01BX9U3.16.86.H09.1.454.CMB.1.raw
  modified_base (209)..(209): a, c, t, g, unknown or other
  misc_feature (209)..(209): n is a, c, g, or t
tcagtgtactactccacgaccggtgctcgattttagtgctatagacttggggtttgggggggggtctcaggaggcagcgctctcaggacatctccaccatggcctgggctctgctgctcctccaccctcctcactcagggcacgagggtcctgggcccagtctgccctgactcacgcctcgccctccgtgtcgtgggtctccgtggacngtcgatcatctattcttctgcacgttggactccagcgtagtcgtacggttagttaagttaattaagttatcgttcctccgttaggtaaccaacgtaccgtaacccgacggaaccaaacccgaccccctaaatacctagttacgttaatttacgtaggtaacggtacgaaggttaaccgtcccggtacccgttagggttacgggttttactaacgttcgttccttacgttcgtcgtacctaccgtaacgtcgtaccggacctaaccggacccggttccctacccgtagtaaccctagttcccgtacggtccggtcccgtacggacgggtcgtacggggaagggtacggtagggttaatactttacgtacgtcgacgtagtccttaacgtagtaacgtaaggaggttcgacggtacacttacgtcgtttacggtggtaccgggacggtaacgggtacctaagggcccttacgggaacccgtttaccggacgggacccaacgggttaccccgacggttcccgccccgggttacccccg

SEQ ID NO: 11415 - DNA, 687 bp, Homo sapiens
  misc_feature: GYAE6OF01BF8J2.16.86.H09.1.454.CMB.1.raw
tcagtgtactactccacgaccggtgctcgatttagtgctatagacttggggtttggggggggtctcaggaggcagcgctctcaggacatctccaccatggcctgggctctgctgctcctcaccctctcattcagggcacaggtgacgcctccgaggggaaggggcttcgaggggacctcgtggggctgacttccgttgggtcctccgtgcctcctcgaggcctccgaccggggcccagccactcgactccgacgtggctagtcggttcgttttcctcccttcgtttcccggacgggttcccgtcgggtcccctaggtcctcgccctgtacctcacgtcctcgcccttccggtcgttcgtcgggtcctccgtggtactcgtcgactctatctactcttaccgtgcctacgtggactccgagtcgtaggtcgtacggtttaggttaatttaactaacgttagtcgtcttaccgtacgtaaccaacgtacgtacccgtaaggacccaaaccgtacccctaactactagtacgttactttacgtcggtacgtacgtaacgtacgttcccggtaccgttacgggttacgggtttacttaacgttccgtcgtttcgtacgttcgtacctaccgtaacgtccgtacgaccaaccgccgtccctaccgtactacctatccgttcggtcggtaccg

SEQ ID NO: 11416 - DNA, 771 bp, Homo sapiens
  misc_feature: GYAE6OF01CGWW4.16.86.H09.1.454.CMB.1.raw
  modified_base (201)..(201): a, c, t, g, unknown or other
  misc_feature (201)..(201): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagtcctgcctcgtgtcgtgggtctccgtggacngtcgatcatcattcttctgcctatggactccagcgagtgtacggtttggttaagttaattaattattcgttccttccgtacggtaaccaaacgtacgtaacccgacggaaccaaaccgacccccaaactactagtacgtaatttagtaggtagtacgtaagtaacgttccggtcccgtacgggttacgggtttactaacgttccgttacgttccttcgtcggtacctaccgtaaacgttccgtacgggtaccaaccgtcccggtacccttcccgtaaccgtacctacgttccgttaccggcggtcctacccggtaggacgttacggggaacgggtacgggtacgggttacgttaacgttaacgttcgacgtaccgtacggtactaaccgtaagttaagtaacggtacggttcggtaccgacgttacccgtaccgttacgttacggttacggttaccgggtaaccggggttacgggaaccccgtaggtacccggtccggtaccggttaacccgttacgggttaccccgaacggtaccccggaaccggtccggttccccggtaccccccggg

SEQ ID NO: 11417 - DNA, 719 bp, Homo sapiens
  misc_feature: GYAE6OF01CSNC5.16.86.H09.1.454.CMB.1.raw
  modified_base (531)..(531): a, c, t, g, unknown or other
  misc_feature (531)..(531): n is a, c, g, or t
tcagtgtactactccacgaccggtgctcgatttagtgctatagacttgggtttggggggggtctcaggaggcagcgctctcaggacatctccaccatggcctgggctctgctgctcctcaccctccttcactcagggcacgagggtcctcggcccagtctcgccctgactcagcctgccctcgtgtctgggtcctcgtgacagtcgatccatcattcttcgcgcacgtgtactccgagcgtagtgtacgtttggtaattaataattgtctctccgtagtaaccacgtaccgtaaccaggaaccaacccgaaccccctaagtactacgtagttatttagtacggtagtacaagttacgtccggtacctaggtttacggttatactccgttcgttacgttcgcgtactaccgtaagttcgacgaccaaccgtacccggttccctaccgtataccctacgttccgtaccggtccggtacctaccggtaggtcgtaacgggaaccggtgggtacgttagtaacgtttacgtacgngtacgtaacggttctacgtaaagtaacggttacggtaacggtctaccgtaaccgtcccttacgttacgtttaccgggttaccggtccgggaggtaaccggtaaccctagggtacctttccgggaacccgttacccggtcggtaaacccgtaccggaccgtacccggtccgttacccccggtaccccgg

SEQ ID NO: 11418 - DNA, 693 bp, Homo sapiens
  misc_feature: GYAE6OF01B3ISY.16.86.H09.1.454.CMB.1.raw
  modified_base (219)..(219): a, c, t, g, unknown or other
  misc_feature (219)..(219): n is a, c, g, or t
tcagtgtactactccacgaccggtgctcgatttagtgctatagacttggggtttggggggggtctcaggaggcagcgctctcaggacatctccacatggcctgggctctgctgctcctcaccctctcactcgagggcacagggtcctgggcccagtctcgccctgactcagcctgcctccgtgtctgggtctccgtggacagtcgatcatcatcttacngctactggatccagcgagtcgtacggttgtagttaatattatgtctcgtagtaaccacgtacgtaccagacaaaccgaccccaactcattagtacttagtagtaaggtactaagtaacgtcccggttaccgtacggttacgggttacttacgtaccgttcttccgtcgtcgtacgtaccgtacggtgtacggactaaccgaccggtccctccacgtacctacgttctcgtcgggtcctacggcggacgtagggaacggtacgggaggttacgtaatttacgtagcgtacacggttactaacgtaagtaagtacggtagtacgggactaccgaacttacgttccgttaggttacccgggttaccggggttacggggaacggaacccggttaagtccgggtaccggttacccggtaccgttaacgggtaccgtacccggaaccccggtacggttcccgtaccccggttacccccgg

SEQ ID NO: 11419 - DNA, 751 bp, Homo sapiens
  misc_feature: GYAE6OF01CCHT3.16.86.H09.1.454.CMB.1.raw
  modified_base (230)..(230): a, c, t, g, unknown or other
  misc_feature (230)..(230): n is a, c, g, or t
tcagtgtactactccacgaccggtgctcgatttagtgctatagacttggggtttgggggggggtctcaggaggcagcgctctcaggacatctccaccatggcctgggctctgctgctcctccaccctcctcactcgagggcacgagggtcctcggcccagtctcgcccctgactcagcctcgcctccgtgtcgtgggtcctccgtggacaggtcatcaatcacttctctnaccgtgtaggactccagctaggtgtacggttggttagttattacttatcgttcctacgtaccggtaacaacgtacgtaccgaacggaccaaaccgacccctaatcagtaggttactttaggaggtacgagttaacgtacgtcccggtaccgttaggttacggtttactaacgtttccgtctttacgtccggtacgttccgtaccgtaacggtcgtacggaaccctaaccggtccggtaccccttccgtacggtaccttccgtcggtaccgtaccgggtccttaccggaggtaccgtacggggacgggtaagggagggtttacgttaaacttccgtacggttcgaacgtctaccgtataacggttagtagggtaacggtcggtaacacgtcgtaccgtttacgtaccgggtttagggccgggtagggtaacccggtaccgtaagtccgggttacccgtaccggtacccggttaggccccgaacggtttaacccggaccggttccccgttaaccccggacccg

SEQ ID NO: 11420 - DNA, 841 bp, Homo sapiens
  misc_feature: GYAE6OF01CRCKM.16.86.H09.1.454.CMB.1.raw
  modified_base (195)..(195): a, c, t, g, unknown or other
  misc_feature (195)..(195): n is a, c, g, or t
tcagtgtactactccacgaccggtgctcgatttagtgctatagacttgggtttggggggggtctcaggaggcagcgctctcaggacatctccaccatggcctgggctctgctgcctcctcaccctcctcactcagggccacagggtcctgggcccagtctgccctgactcagcctgcctcgttgtcgtgggtccncgtggactagtcgatcatctattcttcagcctacgtaggacttccgagtcgtaggtcgtacgttggttaatttataagttcgtcgtccttaccgtacgtaaaccacgtaaccgtacccgaggaacccaaaacccgtaccccctaaaacgttcaagtttacggttaatttaacggtacgggtaacgttactaagggtaacccgttcccggtaccccgttaggggttaacgggtttttacctacgtccctttcgtttcgtacggtccggtacctacgtaacggttccgacggtacaaacccgggtccccttccctaccgtacgtaccgtaccttaccggtccggttaccggacccgttaccgggacgggtacggttaacggggaacggggtaccggttagggttaacggttaacttttaaaccgtccggttagtaaccgtacgtaaccgttcttaaaagttacggttaacggtaacggtgggtaacctccgggttaacctaccgtttccgttacccggttaggggttccggaccgggtaacgggtacccgttagggtaccccggttcggaaacccccgtttgggaacccggttacccgaacccgggttaccccgtaacgggccccccgtttaaccccgggtcccccgg

SEQ ID NO: 11421 - DNA, 838 bp, Homo sapiens
  misc_feature: GYAE6OF01DAVU2.16.86.H09.1.454.CMB.1.raw
  modified_base (545)..(545): a, c, t, g, unknown or other
  misc_feature (545)..(545): n is a, c, g, or t
tcagtgtactactccacgaccggtgctcgatttagtgctatagacttggggtttggggggggtctcaggaggcagcgctctcaggacatctccaccatggcctgggctctgctgcctcctccaccctcctcactcgagggcacgacgggtccgtcgggcccagtcctcgcccgtgactcacgcctcggtcccttccggtgtcgttcgggtcctccgtaggacgtaggtcatctatctacttcctttcgcgtacgacgttacggactaccgagtacgtaggtacggttaacggtttaggtttaaattaaatttaaactttagtcgttaccgtaccgttaacggtaaccaaaccgttacggaacccaacggaaaccaaaaccccgaccccctaaaatctagttaagtaagttttaggaggaacggttaacgtaacgttaaccggtcccgaaccctagttaagggttaactttacgaacgtcgttacttcgacgttcgaccctaccgtacgtcgtacggaacgttaaccgcccggtcctacccgtaanaacgtactacgtcgtacgtccctacgtacgacgtacggaggtacgacggtacgtattacgttacgtttacgtcgtacgtacgttccgtaatactttaacgttacgtaacgttccggttactaacgttacgtttagtttaccgggttacgggttttccgggaaacgggggttaaccgggtaacccggggttaaacgggttaacccgggttaacccgttacccggggtttaaccggacccgaaccgggtaaacccggttacccgggtaaccccgtcccccggggttaacccccgg

SEQ ID NO: 11422 - DNA, 715 bp, Homo sapiens
  misc_feature: GYAE6OF01DY9YX.16.86.H09.1.454.CMB.1.raw
tcagtgtactactccacgaccggtgctcgatttagtgctatagacttgggtttggggggggtctcaggaggcagcgctctcaggacatctccaccatggcctggctctgctgctcctcaccctctcactcagggcacgaggtgaccgcctccgaaggggaaggggcttcgacgggacctcgtgggctgacttccgttggtctccgtgcctcctcgaggcctccgacccggggccacgcacgtcgacctcacgtcggcattgttcgtttcctcccttcgtttaccgacgggttccgtccgggccctagtccgtcgtccctgtacctcgacgtcccgtcgtcccgttaccggtgttccggttacggtcctacggtacggacgtcggtactatcctacgtactacgtttcctgtcacgtcgtagactcgagacgtacgttaggtacgtttaggttaattacgttaagttcgtaccgttaccgtcgtaccggtaacctaccgtacgtaacccgacgtaaacccgaaacctacccccgtaactagtaacgttacgttacgttaggtacgtaacggttacgaacggttaacccgtaccggttacccgtttagggttacgggtttactacgttccgttactcgttacgtcgtaccgtacgtaccgttcggaccggtaccaccgtaccggtccctaccgtcaacctctcgtcggtcggtaccg

SEQ ID NO: 11423 - DNA, 668 bp, Homo sapiens
  misc_feature: GYAE6OF01BHL9K.16.86.H09.1.454.CMB.1.raw
tcagtgtactactccacgaccggtgctcgatttagtgctatagacttggggtttggggggggtctcaggaggcagcgctctcaggacatctccaccatggcctgggctctgctgctcctcaccctcctcactcagggcacagggtcctgggcccagtctgccctgactcagcctcgcctccggtgtcgtcgggtctccgtggacagtcgatcatcattccttctgctactggactccagcagtgagttgtattataattatcgtctcgtagtaccaacacgtaccgaggacaaaccgaccccctaaatactatcgtaatttagtaggtacggtactagtaacgtccggtaccctacggttacgggtttactacgtaccgtctttccgtcgtcgtacgtaccgtaacgtcgtacggaccaaccgaccggtccctaccgtcacctacttccgtccggtcgggtccctcggacgacggtaggacgggtacggtacgggttagttaacgtttaacgttacgtacgacgtacgactactaagtaacgttaggaaggtcggactacggtacctacttcgttcggtacgtcgggtacggtaccgggtacacggtcccgtaccggaccttccggtaacggtccacggtaacccgacgtcccgtcccggtcccccgg

SEQ ID NO: 11424 - DNA, 806 bp, Homo sapiens
  misc_feature: GYAE6OF01DMN6A.16.86.H09.1.454.CMB.1.raw
  modified_base (276)..(276): a, c, t, g, unknown or other
  misc_feature (276)..(276): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcgagggcacgacgggtccgtgggcccagtctcgccctgactcagcctgcctcgtgtcgtgggtctccgtggacaggtcgatccatcattcgttcacgcacgtggactccgagcaggtcgtacgttaggttaagttaattaattntcgtctaccgtagtaaccaacgtaccgtaccgacggaaccaaaccgacccctaaacgtctaagtagttactttagtacggtagtacgtaacgttaccggtccggtacccgttacggttaacggggttttactaaccgttcgttccgttccgttacggtccggtacctaccgtaacgttccgacggtaaccaacccgtccggtccccttccgtacggaaccttcgttccgtaccggttcgggtccctagggaccggtcgtacggggtaacgggtaccggttaaggggttattaacgtttaccgttacggcggtaacgtacgttacgtaagtacttaaggtaaccggtaagggttccgacgtaaaccgtccgttaccgttacggttaccggttacgggttcccggggtaccgggttaaaggggaaaccccttgggtccggttaaccccgggacccgttaaccgggtacccggtcccggtaaacccggttcccgggaacccgggtttccccgaacccccgggtttcccccggg

SEQ ID NO: 11425 - DNA, 762 bp, Homo sapiens
  misc_feature: GYAE6OF01CFKS6.16.86.H09.1.454.CMB.1.raw
  modified_base (203)..(203): a, c, t, g, unknown or other
  misc_feature (203)..(203): n is a, c, g, or t
  modified_base (321)..(321): a, c, t, g, unknown or other
  misc_feature (321)..(321): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctcctcactcagggccacgagggtcctgggcccagtctcgccctgactcagcctgcctcgtgtcgtggtctcgtggacngtcgatcatcattcttctgcacgtgctcagcagtgtacgttgttagttaatattatgtcctccgtagtaaccaactacgtaccaggtacaaacccgcccctaaactcatagtatttangtacgtatagtaacgtccgtaccgtcgttacgggttactacgtcgtccttctcgtcgtcctacgtacgtcgtacgtaccgaccgtacccggtccctaccgtactacctacgtccgttaccggtcgggcctccggtacggtcgaggtaacgggtaccggtagggttagttaacttttacgacgtccgtacgtaacctcttaaccgtaagttaaagtacgggttaaacggtcggaaccgtacggttaccttaacccgtttcgttaacgggtttacccgggttaccggggtaacccgggttaaaccgggtaaccccggtaaacggttcccgggtttaaccccggtacccgggttaaacccgggttaccgggtaacccgtaaaccccggggttaacccccggtaacggggttccccccgtttcccccggggttaacccccccggg

SEQ ID NO: 11426 - DNA, 729 bp, Homo sapiens
  misc_feature: GYAE6OF01DEK5H.16.86.H09.1.454.CMB.1.raw
  modified_base (128)..(128): a, c, t, g, unknown or other
  misc_feature (128)..(128): n is a, c, g, or t
  modified_base (178)..(178): a, c, t, g, unknown or other
  misc_feature (178)..(178): n is a, c, g, or t
  modified_base (250)..(250): a, c, t, g, unknown or other
  misc_feature (250)..(250): n is a, c, g, or t
  modified_base (394)..(394): a, c, t, g, unknown or other
  misc_feature (394)..(394): n is a, c, g, or t
  modified_base (594)..(594): a, c, t, g, unknown or other
  misc_feature (594)..(594): n is a, c, g, or t
tcagtgtactactccacgaccggtgctcgatttagtgctatagacttggggtttggggggggtctcaggaggcagcgctcgtacaggacatctccaccatggcctgggctctgctgctcctcacctcncactcgagggcacgcgggtcctcgggacccaggtcctcgcccctgactcngcctcgtcctccgtgtcgtcgggtctaccgtggactggtcatcatctcgttccttgacgctacgtgactccnggatcggtgttagttggttattatagttctcgttactccgtagtaaccacgtaccgaaccgcggaaactaaccccaacctaaacgtctatattaagttcggagtacgtacgttcgaaccggtcctacggtaggttcggttaacncggtacttcgttacgtcgtcgtaccctacgtaacgggtcaccgtaccgtaacccggtcccgtcccgttaccgaacctccgtcgttcccgtccggtccgggtcaacccgggtgtacggtaaccggaggggttaccggtagttaacgtgttaaccttgacggacttaccggtattaaccgttagtaaccggtggacggttanaacgttccgtaacctacgggttgttcggttaccgggtacgggtaaccggtaccggaaaccggttcgtaccggtaccgtttcgggaacccgttgacccggtacccgacgtcccggttaccgtccccggttacccgg

SEQ ID NO: 11427 - DNA, 648 bp, Homo sapiens
  misc_feature: GYAE6OF01AG30I.16.86.H09.1.454.CMB.1.raw
  modified_base (199)..(199): a, c, t, g, unknown or other
  misc_feature (199)..(199): n is a, c, g, or t
  modified_base (309)..(309): a, c, t, g, unknown or other
  misc_feature (309)..(309): n is a, c, g, or t
  modified_base (315)..(315): a, c, t, g, unknown or other
  misc_feature (315)..(315): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacngtcgatcatcatcttctgcacgtggactccgagcaggtgtacgttggtagttataattatgtctctcggtaaccaacacgtacccaggacaaaccgacccccaactcatntattangagtcagtactccgcctacgtaggttactatcgtcttctcgtcgtcctacgtacgtcgtcggacctaaccgccgtccctccctacgacctactccgtcgtcggcctcgaggcgtagggacggtacggtagggtacgttagttacgttacgtcgacgtacgtatactaagttaacgtaaggtaacgtggacacggttacctacgttaccggtcggttacggttccggggaccgggttaccggggtaacccgtaggtaccgtccggtaccccgggttaccgttaacgggtccgaccggaaccccggtaccggttcccgtcccccggtccccccgg

SEQ ID NO: 11428 - DNA, 679 bp, Homo sapiens
  misc_feature: GYAE6OF01AY66O.16.86.H09.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
  modified_base (257)..(257): a, c, t, g, unknown or other
  misc_feature (257)..(257): n is a, c, g, or t
  modified_base (310)..(310): a, c, t, g, unknown or other
  misc_feature (310)..(310): n is a, c, g, or t
  modified_base (353)..(353): a, c, t, g, unknown or other
  misc_feature (353)..(353): n is a, c, g, or t
tcagtgtactactccacgaccggtgctcgatttagtgctatagacttgggtttggcgggggtctcaggaggcagcgctctcaggacatctccaccatggcctgggctctgctgctcctcaccctcctcactcagggcacagggtcctgggcccagtctgccctgactcagcctgcctccgtgtcgtgggtctccgtggacngtcgatcatcattcttcngcacgtgactccagcagtgtacgttgtagttataattntgtctcgtagtaccaagacgtaccagacaaacgccccaaatcatgtatttagngtagtcagtactccggacctggtaggttctaagtcgtctttcncgtcggcctacgtaagttcgacgaccaaccgtacccggtcccttacccgagtacctacgttccgttccgggtcggtaccctacccggaggtccggtacgggtaacgggacggggttaagggttacgtaacttttaacgtaccgtacggacgtacgttacgtacctaaagtaaccggttaagggtaaccggtcggaccttaacggacccgttaccgttacccggtaggtttaaccggtcggggtaccggtaaccggtaaccgtcggtacccgttacggacccgttccgtaacggacgaccggtacccgtacggtcccgtacccccgg

SEQ ID NO: 11429 - DNA, 636 bp, Homo sapiens
  misc_feature: GYAE6OF01CH9VE.16.86.H09.1.454.CMB.1.raw
  modified_base (414)..(414): a, c, t, g, unknown or other
  misc_feature (414)..(414): n is a, c, g, or t
  modified_base (462)..(462): a, c, t, g, unknown or other
  misc_feature (462)..(462): n is a, c, g, or t
tcagtgtactactccacgaccggtgctcgatttagtgctatagacttggggtttggggggggtctcaggaggcagcgctctcaggacatctccaccatggcctgggctctgctgctcctcaccctcctcactcagggcacgagggtcctcgggtcctccgactcggaacccagcgtagttcgacggtttggtaggttaattaacgtttgtcctcctgaactaaccaacagccaaccgagacaaagaccaacctaaattcagttagattagtacgagtacactaacgccgtacctaggtaacggtttcaatcgtcttcctacgtggcctaccagtctggacctaaacgccgtccttccagacctatcgtaccgtgctccgagtcggtagaaggccgtaggctagttaatacgttntacgactactactactaaggttaaccaaccaaaccaaagtcgactacnctacgtagtggtactcgggacggaacgacgtaagtcgtaaccgccgtacgtacggaccacggaaccgttaacgccgttccgccccgttcgtaacctcttaccgtcctccccacctactaaccgcgtaataccgtcgaggaccggcggacgaggtaaccacggacagactagcga

SEQ ID NO: 11430 - DNA, 889 bp, Homo sapiens
  misc_feature: GYAE6OF01APUNZ.16.86.H09.1.454.CMB.1.raw
  modified_base (175)..(175): a, c, t, g, unknown or other
  misc_feature (175)..(175): n is a, c, g, or t
  modified_base (218)..(218): a, c, t, g, unknown or other
  misc_feature (218)..(218): n is a, c, g, or t
  modified_base (270)..(270): a, c, t, g, unknown or other
  misc_feature (270)..(270): n is a, c, g, or t
  modified_base (878)..(878): a, c, t, g, unknown or other
  misc_feature (878)..(878): n is a, c, g, or t
tcagtgtactactccacgaccggtgctcgatttagtgctatagactttggggtttgggggggtctcagggaggcagcgctctcaggacatctccaccatggcctgggctctgctgcctcctcaccctctcactcgagggcacgcgggtcctcgggtccctccgacgtcggaaccngcagtgtacgttggtgttataactttgtctcctgactaccaanacgccaccgaggacaaacgccaaccctaaattcaagttacggttaatttagnggtaacggtactaactaacggtcccggtcccttacggttacggggtttacctactccggttccttcttccgtcggtacctaccgtaaggttcctacgggaccctaaccgtacccggtcccctaccccggtacgtaccctacgttccgtccgggtacggtcctacccggtaggtccgtacgggaacgggtaccggtcggtcgttaagttatttacgttacgtcgtacgtaactttaccgtactaaacgttactaaaaccgaaaccaaccgttccgaccttaaccgttaccgtacgttacggtttcggtaaccgggttaccggggaacggtaacccgggtaacgaccggtccgtttacccggacccggtttacgtaccggtacccggtcccgtaaccccggttaccgggacccttcccccggggttcccccgttacggtttacccccgtacccgggtttcccgtttcccccgggtaccccccttcccggttacccggtccggttaaacccggttacccgttacccggtacgggtaacccggggtccgggttcggggaaccccgggttacggggaaccccgttaacgggggacccctaaagggttaaccgnggtccggtaac

SEQ ID NO: 11431 - DNA, 734 bp, Homo sapiens
  misc_feature: GYAE6OF01EJGNW.16.86.H09.1.454.CMB.1.raw
  modified_base (175)..(175): a, c, t, g, unknown or other
  misc_feature (175)..(175): n is a, c, g, or t
tcagtgtactactccacgaccggtgctcgatttagtgctatagacttggggtttggggggggtctcgaggaggcagcgctctcaggacatctccaccatggcctggctctgctgcctcctcaccctcctcactcgagggcacgagggtcctcgggcccagtctcgccctgactcncgcctcgccgtccgtgtcgtgggtctccgtggacagtcgatcatctcttcttctcgctacgtggacctccgagacgtaggttcggtacggtttaggttaagtttaattaagttagttcgtccgttccgtacggtaacctaacgtaaccggtaaccccgaacggaacccgaaaacccgtaccccctaaactcctaagttagtaactttaagtagtaacgtactaacgtaaccgtcccggtcccgttacggtacgggttccctaggtactccgtcgttcgtcggtcggtacccgtagtccgtacggacctaccggtaccgtcccttaccgtacgaaccgttcgttccggttccggtacgggtccctccggtaacggtacggtaacgggacgggtaggtacgggtacttagttaatttacgtccgtgtaccggtatactttagaaccgtaagtaacgtaactaacgttacgtttactttacggtacgtacggtacgtacggtacgtaccggtcctcgtacgtcgaccgacggtacccgactaaccccacttctcgtcctccg

SEQ ID NO: 11432 - DNA, 688 bp, Homo sapiens
  misc_feature: GYAE6OF01BZN2V.16.86.H09.1.454.CMB.1.raw
  modified_base (432)..(432): a, c, t, g, unknown or other
  misc_feature (432)..(432): n is a, c, g, or t
tcagtgtactactccacgaccggtgctcgatttagtgctatagacttggggtttggggggggtctcaggaggcagcgctctcgaggacatctccaccagtcggcctgggctctgctgcctcctcaccctctctactcgacgggtccaacggtcgggtccctcgggaccctggttcctcggaccctgtacctcgacgtcctcgtcccttacggtcgtcgtacggtctccgaggactcggtactactctactcctacttcttcgcgactacgtcgtactccggaagcgtaggttcgtaagggttatagtttaactagttcgtacgtccgtacgtacgaaacctacgtacggaccacgaacaacccgtctaatcgtaatagttagttacgagtacgactaaccgtccggtcgtacgtaagggtttactgttaccncgttctacgtggtaaccgtccttaggacggttcggaacaccacccggttctacccctggtacttaacctcggttccgtaggtcctacggaacggtcggaggtaggggtaaaccttggtaatttaacgtacttaacgtggactcgtacgataacgtacggttagtacgcgaatacgcaccttgtacctgggacgtcggagtaccgtacgtgaccccgtgtacccgacgtctaccgacgttacgcctccgtccggtac

SEQ ID NO: 11433 - DNA, 273 bp, Homo sapiens
  misc_feature: GYAE6OF01D48UR.16.86.H09.1.454.CMB.1.raw
  modified_base (255)..(273): a, c, t, g, unknown or other
  misc_feature (255)..(273): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcgggcggtgggaccaagctgaccgtcctaggtcagcccaaggctcgccccctggtcactctcgttcccaccctctcgagtagtacacgtggaggccgggctgggacaagggcacagtagnnnnnnnnnnnnnnnnnnn

SEQ ID NO: 11434 - DNA, 722 bp, Homo sapiens
  misc_feature: GYAE6OF01A735A.16.86.H09.1.454.CMB.1.raw
  modified_base (222)..(222): a, c, t, g, unknown or other
  misc_feature (222)..(222): n is a, c, g, or t
  modified_base (497)..(497): a, c, t, g, unknown or other
  misc_feature (497)..(497): n is a, c, g, or t
tcagtgtactactccacgaccggtgctcgatttagtgctatagacttggggtttgggggggggtctcaggaggcagcgctctcaggacatctccaccatggcctggctctgctgcctcctcaccctctcactcgaggcacgtgggtcctgggccctagtctcgccctgactcacgtcctcgcctcgtgtcgtggtcctcgtgacagtcatcatcattcttcngctagtgactccagcgtagtggtacgttagttattataagttcgtcgtaccttaccgtacggaacctacgtaccgtacccgtacgaacccgaacccgtaaccccaagtcctagtcgttagtttagcggaacggtactaacgtacgttccccgggtaccttaggttaggttcctagttccgttacttcgtacgtctaccgtacgtacgtcggaacccgtccgaaccgtcccgttccctacccgtacgacttcgtcccgttacggccgtaccgtcgnggtacgtaggtacgggtaggttacggtattcgtttaccgaccggtgtaaccgcgttaaccgtacgaaagttacgggtaaacggtcgggaaacgtccgtaaccggttcctaacggtttacccgtaggtacccgggttcggggaacgtaccggtaactcccgggtacgttaccccgtacgtaccggttacggactaccccgggagtcccgttcccgcccggtacccg

SEQ ID NO: 11435 - DNA, 707 bp, Homo sapiens
  misc_feature: GYAE6OF01BXCE7.16.86.H09.1.454.CMB.1.raw
  modified_base (226)..(227): a, c, t, g, unknown or other
  misc_feature (226)..(227): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctctcactcgagggcacgagggtcctgggcccagtctgccctgactcacgcctgcctcgtgtctgggtcctccgtggacctagtcgatctatcgattcgttcnnctacgtgactccagctagtgtacgttgtagttatattatcgtctcgtacggtaaccaacacgtaccgacgaccaaccgaccccaagtctagtcgtattagagtagtacgtagtacgtccgtcccgtaggttagggttactaagtctccttcgtcgttacgtcctaaccgtacgtcgtacggaaccaccgtccgtccctccgtacacctactcgtccggtacggtcctaccggtacgtacggtcggtaacgggtacgggttacggttacgtttaagttaccgttacgtacggtacctacggttactacggttaagttaacggtaacggtaacgggtaccggacgtaccgtacttacggtttaccgtcggtttaccgggttccgggtaccgggttacgtaccgggtacgtacccggtacggtaccccgtacgttacggcccgaccggtaaccccgaccggtccccgccccggtttaccccgg

SEQ ID NO: 11436 - DNA, 737 bp, Homo sapiens
  misc_feature: GYAE6OF01BAMAM.16.86.H09.1.454.CMB.1.raw
tcagtgtactactccacgaccggtgctcgatttagtgctatagacttgggtttggggggggtctcaggaggcagcgctctcaggacatctccaccatggcctgggctctgctgctcctcaccctcctcactcgagggcacgaggtgaccgcctaccgaggggaaggggcttcgagggacctcgtggggctgactccgttggtcctcctcgccttcctcgaggtcctaccgacccggggcccagcctacgtgtacctcacgtggctagttggttcgttttcctccctttccgtttaccggcgggttccctcggggtcccctaggttccgtcggcccttagacctcgacgtcccgtcgtcccgtccggtcgtccgtgggtcctccgtaggacctgtcgatcactctacgttctcgcgactcgtagacctcgacgcgtaggtggtacgtttagtaagtttataacttcgttccgtacccttacgttaacccggtaaccaaccgtaccgtaaacccggaacggaaccccaaaccccgtacccctaaacgtctaacgtttagtaagtttacggtacggacgttaacgtaacggttccgttcccgggtaccgttacggggtttacggtttacctagttcccttcttacgtcgtcgtaccgttacgtaggtccttaccggaaccctccgttacccggaccccttacctaaccgtaccgttacgtccggtcggtccggtaccccg

SEQ ID NO: 11437 - DNA, 269 bp, Homo sapiens
  misc_feature: GYAE6OF01A0VIV.16.86.H09.1.454.CMB.1.raw
  modified_base (248)..(269): a, c, t, g, unknown or other
  misc_feature (248)..(269): n is a, c, g, or t
tcagtgtactactccacgaccggtgctcgatttagtgctatagacttgggtttgggaacctatgaacattctgtaggggccactgtcttctccacggtgctcccttcatgcatgacctggcagcactctcgtagttcggcggtgggaccaagctgaccgtctaggtcagcccaggctgcccctggtcactctcgttcccacctcctcgagtacgtacactggacgcgggctgggacaaggcgcatagnnnnnnnnnnnnnnnnnnnnnn

SEQ ID NO: 11438 - DNA, 245 bp, Homo sapiens
  misc_feature: GYAE6OF02GCFB0.16.86.H09.1.454.CMB.1.raw
  modified_base (244)..(245): a, c, t, g, unknown or other
  misc_feature (244)..(245): n is a, c, g, or t
tcagtgtactactccacgaccggtgctcgatttagtgctatagacttgggtttgggaacctatgaacattctgtagggccactgtcttctccacggtgctcccttcatgcgtgacctggcagcactctcgtattcggcggtgggaccaagctgaccgtcctaggtcagcccaaggctgcccctcggtcactctgttcccgccctcctcgagtagtacactgagcgggctggcaaggcgcatagnn

SEQ ID NO: 11439 - DNA, 183 bp, Homo sapiens
  misc_feature: GYAE6OF02GOYTV.16.86.H09.1.454.CMB.1.raw
  modified_base (171)..(183): a, c, t, g, unknown or other
  misc_feature (171)..(183): n is a, c, g, or t
tcagtgtactactccacgaccggtgctcgatttagtgctatagacttgggtttggggaagaggaagactgacggtccccaggagttcaggtgctgggcacagcggccctgggctgcctggtcaaggactacttccgagtagtacactgagcgggctggcaaggcgcatagnnnnnnnnnnnnn

SEQ ID NO: 11440 - DNA, 171 bp, Homo sapiens
  misc_feature: GYAE6OF02G83GQ.16.86.H09.1.454.CMB.1.raw
  modified_base (171)..(171): a, c, t, g, unknown or other
  misc_feature (171)..(171): n is a, c, g, or t
tcagtgtactactccacgaccggtgctcgatttagtgctatagacttgggtttggggaagaggaagactgacggtccccaggagttcaggtgctgggcacagcggccctgggctgcctggtcaaggactacttccgagtagtacactgagcgggctggcaaggcgcatagn

SEQ ID NO: 11441 - DNA, 173 bp, Homo sapiens
  misc_feature: GYAE6OF02GXCN8.16.86.H09.1.454.CMB.1.raw
  modified_base (170)..(173): a, c, t, g, unknown or other
  misc_feature (170)..(173): n is a, c, g, or t
tcagtgtactactccacgaccggtgctcgatttagtgctatagacttgggtttgggaagaggaagactgacggtccccaggagttcaggtgctgggcacagcggccctgggctgcctggtcaaggactacttccgagtagtacactgagcgggctggcaaggcgcatagnnnn

SEQ ID NO: 11442 - DNA, 173 bp, Homo sapiens; identical to SEQ ID NO: 11317
  misc_feature: GYAE6OF02FJRFY.16.86.H09.1.454.CMB.1.raw
  modified_base (173)..(173): a, c, t, g, unknown or other
  misc_feature (173)..(173): n is a, c, g, or t

SEQ ID NO: 11443 - DNA, 134 bp, Homo sapiens
  misc_feature: GYAE6OF02JLNIM.16.86.H09.1.454.CMB.1.raw
  modified_base (109)..(109): a, c, t, g, unknown or other
  misc_feature (109)..(109): n is a, c, g, or t
  modified_base (130)..(134): a, c, t, g, unknown or other
  misc_feature (130)..(134): n is a, c, g, or t
tcagtgtactactccacgaccggtgctcgatttagtgctatagacttgggtttgggcacagcggccctgggctgcctggtcaaggactacttccgagtagtacactgancgggctggcaaggcgcatagnnnnn

SEQ ID NO: 11444 - DNA, 525 bp, Homo sapiens
  misc_feature: GYAE6OF02I0Z58.16.86.H09.1.454.CMB.1.raw
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgccccaaactcatgatttatgaggtcagtaatcggcctcgagggtttctaatcgtcttctctggctcagtctggcaacacggcctccctgaccatctcgtgggctccgaggctggaggacgagggtgattattactgcagctcatatagaagtgcagcacttctcgtagttcggcggtcgggaacctaagcgtacggaccgttccgtaggtccgacgcccgaaggtcctccggtcccccg

SEQ ID NO: 11445 - DNA, 503 bp, Homo sapiens
  misc_feature: GYAE6OF02G6W5I.16.86.H09.1.454.CMB.1.raw
tcagtgtactactccacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaaatcatgatttatgaggtcagtaatcggccctcaggggtttctaatcgcttctctggctccaagtctggcaacacggcctccctgaccatcctctgggctccaggctggaggacgagggtgatttattactgcagctcatatagaagtggcagcactctcgtattcggcggtgggacaagctgaccgtctaggtcagcccaaggctgtccccg

SEQ ID NO: 11446 - DNA, 174 bp, Homo sapiens; identical to SEQ ID NO: 11375
  misc_feature: GYAE6OF02I6A8R.16.86.H09.1.454.CMB.1.raw
  modified_base (173)..(174): a, c, t, g, unknown or other
  misc_feature (173)..(174): n is a, c, g, or t

SEQ ID NO: 11447 - DNA, 501 bp, Homo sapiens
  misc_feature: GYAE6OF02FIFOM.16.86.H09.1.454.CMB.1.raw
  modified_base (304)..(304): a, c, t, g, unknown or other
  misc_feature (304)..(304): n is a, c, g, or t
  modified_base (416)..(416): a, c, t, g, unknown or other
  misc_feature (416)..(416): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttangaggtcagtaatcggccctcagggtttctaatcgcttctctggctcaagtctggcaacacggcctccctgccatctctgggctccaggctgaggacgagggtgattattacngcagctcatatagaagtggcagcactctgtattcggcggtgggaccaaggctgaccgtcgtaggtcagcccaaggcctcgccccg

SEQ ID NO: 11448 - DNA, 511 bp, Homo sapiens
  misc_feature: GYAE6OF02GWRL3.16.86.H09.1.454.CMB.1.raw
  modified_base (459)..(459): a, c, t, g, unknown or other
  misc_feature (459)..(459): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgtcttctctggctcaagtctgcaacacggcctccctgaccatctctgggctccgaggctgaggacgagggtgattattactgcagctcatatagaagtggcagcactctcgtattcggnggtcgggaccaagcgtcgaccgtctaggtcacgcccaaggcctcgtcccccg

SEQ ID NO: 11449 - DNA, 515 bp, Homo sapiens
  misc_feature: GYAE6OF02G70MQ.16.86.H09.1.454.CMB.1.raw
  modified_base (486)..(486): a, c, t, g, unknown or other
  misc_feature (486)..(486): n is a, c, g, or t
tcagtgtactactccacgaccggtgctcgatttagtgctatagacttgggtttggggggggtctcaagaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgcccctcggtcacctctcgttcccgccctcctcgacgtagtaccnctgacgcgggctggcaggccgcagtagcg

SEQ ID NO: 11450 - DNA, 175 bp, Homo sapiens
  misc_feature: GYAE6OF02HK2FR.16.86.H09.1.454.CMB.1.raw
  modified_base (173)..(175): a, c, t, g, unknown or other
  misc_feature (173)..(175): n is a, c, g, or t
tcagtgtactactccacgaccggtgctcgatttagtgctatagacttgggtttgggggaagaggaagactgacggtcccccaggagttcaggtgctgggcacagcggccctgggctgcctggtcaaggactacttccgagtagtacactgagcgggctggcaaggcgcatagnnn

SEQ ID NO: 11451 - DNA, 618 bp, Homo sapiens
  misc_feature: GYAE6OF02GF6I1.16.86.H09.1.454.CMB.1.raw
  modified_base (310)..(310): a, c, t, g, unknown or other
  misc_feature (310)..(310): n is a, c, g, or t
  modified_base (454)..(454): a, c, t, g, unknown or other
  misc_feature (454)..(454): n is a, c, g, or t
  modified_base (469)..(469): a, c, t, g, unknown or other
  misc_feature (469)..(469): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggccaaaacgcccccaaactcatgtatttagngaggtcaagtaactccggccctagtagggtttactaatcgtcttctcgtggcctaccaagtccgtaggaccaaaccgaccggtccctcccgtagaccctatcctcgtcgggcctaccgaggtcctaggacggacggaggggttntaatttaacttacgngtacagtcctactaagttaagtaaggaaggttcggacagtacctaccttccgtacggttagttccggggacgggttacgggaacctaaggtccgtacggtacccgttccgtaggtaccacggaccccgaaggtccctcggtccccccgg

SEQ ID NO: 11452 - DNA, 511 bp, Homo sapiens
  misc_feature: GYAE6OF02GLFN8.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttatgagtcagtaatcggcctcagggttctaatcgcttctctgctcaagtctgcaacacggcctcctgaccatctctggctccaggctggaggacgaggtgattagttactgcagtctcatagtagaagtgcagcactctcgtattcggcggtcgggacaagcgtcgtaccgtcgtacggtcacgacccgaaggtcctcgtcccccgg

SEQ ID NO: 11453 - DNA, 519 bp, Homo sapiens
  misc_feature: GYAE6OF02F9L9Z.16.86.H09.1.454.CMB.1.raw
  modified_base (517)..(518): a, c, t, g, unknown or other
  misc_feature (517)..(518): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggttttctaaatcgctttctctggctccaagtctggcaacacggcctccctgacccatctctgggctccaggctgaggacgaggctgattattactgcagctcatatagaagtggcagcactctcgtattcggcggtgggaccaagctgaccgtcctaggtcacgcccaaggctcgccccctgtccactctcgttcccaccctcctccgtagtacgtacacgtgacgcgggctcggacaggccgcgatacgnnc

SEQ ID NO: 11454 - DNA, 523 bp, Homo sapiens
  misc_feature: GYAE6OF02GNZH9.16.86.H09.1.454.CMB.1.raw
  modified_base (365)..(365): a, c, t, g, unknown or other
  misc_feature (365)..(365): n is a, c, g, or t
  modified_base (378)..(378): a, c, t, g, unknown or other
  misc_feature (378)..(378): n is a, c, g, or t
  modified_base (521)..(521): a, c, t, g, unknown or other
  misc_feature (521)..(521): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggcccctcaggggtttctaatcgcttctctggctccaagtctggcaacacggcctccctgaccatctctgggctccaggctgagacgaggctgattattattgcatctnatatacaaccaangcactctcgactggtattcggcggagggaccaagctgaccgtcctaggtcacgcccaaggcctcgccccctcggtcaccttctcgttccccaccctcctccgagtagtaccactcgaggccggctggccgaaggccgcagtgncg

SEQ ID NO: 11455 - DNA, 262 bp, Homo sapiens
  misc_feature: GYAE6OF02FK2GM.16.86.H09.1.454.CMB.1.raw
  modified_base (247)..(262): a, c, t, g, unknown or other
  misc_feature (247)..(262): n is a, c, g, or t
tcagtgtactactccacgaccggtgctcgatttagtgctatagacttgggtttgggaacctatgaacattctgtagggccactgtcttctccacggtgctcccttcatgcgtgacctggcagcactctcgtattcggcggtgggaccaagctgaccgtcctaggtcagcccaaggtctgccccctcggtcactctgttcccaccctcctcgagtagtacactggagcgggctggcaaggcgcatagnnnnnnnnnnnnnnnn

SEQ ID NO: 11456 - DNA, 499 bp, Homo sapiens
  misc_feature: GYAE6OF02FZWCU.16.86.H09.1.454.CMB.1.raw
  modified_base (303)..(303): a, c, t, g, unknown or other
  misc_feature (303)..(303): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctcgtgtctgggtctcctggacagtcgatcatcatcttctgcactggatccagcagtgacgttggtagttataattatgtctcctggtaccaacagtacccaggcaaagcccccaaactcatgatttangaggtcagtaatcggccctcaggggtttctaatcgcttctctggctccaagtctggcaacacggcctccctgaccatctctgggctccgaggctgaggacgagggtnattatctgcngctnatatagaagtgcagcactctcgtattcggcgtgggccaagctgaccgtctacggtcacgcccaggctcgcccccg

SEQ ID NO: 11457 - DNA, 538 bp, Homo sapiens
  misc_feature: GYAE6OF02IZTO1.16.86.H09.1.454.CMB.1.raw
  modified_base (304)..(304): a, c, t, g, unknown or other
  misc_feature (304)..(304): n is a, c, g, or t
  modified_base (363)..(363): a, c, t, g, unknown or other
  misc_feature (363)..(363): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttangaggtcagtaatcggcctgaggggtttctaatcgcttctctggctcaagtctggcaacncggcctccctgaccatctctgggctccgagctgaggacgagtctgtattattattgctattctacattatacaaccaacacgacactctacgactggttattccgggacgggacgggaacctaaggccgtacggtacccgtaccgtacggttaccacggtaccccgaaggtcccg

SEQ ID NO: 11458 - DNA, 254 bp, Homo sapiens
  misc_feature: GYAE6OF02I5K6C.16.86.H09.1.454.CMB.1.raw
  modified_base (246)..(254): a, c, t, g, unknown or other
  misc_feature (246)..(254): n is a, c, g, or t
tcagtgtactactccacgaccggtgctcgatttagtgctatagacttgggtttgggtaaccgtatgaacattctgtagggccactgtcttctccacggtgctccttcatgcgtgacctggcagcactctcgtattcggcggtgggaccaagctgaccgtcctaggtcagcccaaggctgccccctcggtcactctgttcccgccctcctcgagtagtacactgagcgggctggcaaggcgcatagnnnnnnnnn

SEQ ID NO: 11459 - DNA, 580 bp, Homo sapiens
  misc_feature: GYAE6OF02GAKNU.16.86.H09.1.454.CMB.1.raw
  modified_base (307)..(307): a, c, t, g, unknown or other
  misc_feature (307)..(307): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaactcatgatttangaggtcagtaatcggccctcgaggggtttctaatcgcttctctggctccaagtctggcaacaccggcctccctgaccatctcgtgggcctccgaggcctgagggacggagggtgtaattattactgcagctcatagtagaagtggacagcacttcgtacgttacgttcgggacgggtacgggaaccctaaggtcccgttacgggtaccccggttaccgttaacgggtcccaaccgggtaccccgtaaagggtcccgtcccggtacccccccgg

SEQ ID NO: 11460 - DNA, 549 bp, Homo sapiens
  misc_feature: GYAE6OF02JTHDC.16.86.H09.1.454.CMB.1.raw
  modified_base (347)..(347): a, c, t, g, unknown or other
  misc_feature (347)..(347): n is a, c, g, or t
  modified_base (416)..(416): a, c, t, g, unknown or other
  misc_feature (416)..(416): n is a, c, g, or t
  modified_base (432)..(432): a, c, t, g, unknown or other
  misc_feature (432)..(432): n is a, c, g, or t
tcagtgtactactccacgaccggtgctcgatttagtgctatagacttgggtttgggggggggtcgtcgaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgacgttggtagttataattatgtctcctggtaccaacagtacccaggcaaacgccccaaactcatcgattatgagtcagtaatcgcctcgagggttactatcgtcttctntgctcaagtcgtggctaacgaccggtcctcctcgacctatctccgtggctccaggtctaggacggacgngggtgaactttatacngacagtctacataatagacgtaggcagctactcgttcgtagttcggacgggtcggaaccgtaaggtctcggacccgttcgtacgggtcacggtcccgaaggtccgtccgtacccccg

SEQ ID NO: 11461 - DNA, 529 bp, Homo sapiens
  misc_feature: GYAE6OF02F6QA6.16.86.H09.1.454.CMB.1.raw
  modified_base (353)..(353): a, c, t, g, unknown or other
  misc_feature (353)..(353): n is a, c, g, or t
  modified_base (524)..(524): a, c, t, g, unknown or other
  misc_feature (524)..(524): n is a, c, g, or t
  modified_base (526)..(529): a, c, t, g, unknown or other
  misc_feature (526)..(529): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataattatgtctcctggtaccaacagtacccaggcaaagcccccaaactcatgatttatgaggtcagtaatcggccctcgaggggtttctaaatcgcttctctggctccaagtctggcaacacggcctcctgaccatctctgggctccgaggctggaggacgagggtnattattactgcagctcatatagaagtggcagcactctcgtagttcggcggtgggaccaagctcgaccgtcctaggtcacgcccaacggctcgcccctggtccactctcgttcccacccttcctacgacgtagtaccactgacggcggctcgggcaaggccgagacgtacgnannnn

SEQ ID NO: 11462 - DNA, 545 bp, Homo sapiens
  misc_feature: GYAE6OF02IMOOK.16.86.H09.1.454.CMB.1.raw
  modified_base (541)..(541): a, c, t, g, unknown or other
  misc_feature (541)..(541): n is a, c, g, or t
  modified_base (545)..(545): a, c, t, g, unknown or other
  misc_feature (545)..(545): n is a, c, g, or t
tcagtgtactactccacgaccggtgctcgatttagtgctatagacttgggtttgggggggggtctcaggaggcagcgctcttaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctcctgaccatctctggctccaggctgagacgaggctgatttattattgcatctcatataacaaccaacagcactctcgactggtattcggcggagggaccaagctgaccgtcctaggtcacgcccaaggcctcggccccctgggtccacttcctcgtttccccgcccttccctcgacgtacgtaccacgtcggacggccgggcttcgggaccgtaagggccgaccagtagnactn

SEQ ID NO: 11463 - DNA, 176 bp, Homo sapiens
  misc_feature: GYAE6OF02IFBKZ.16.86.H09.1.454.CMB.1.raw
  modified_base (175)..(176): a, c, t, g, unknown or other
  misc_feature (175)..(176): n is a, c, g, or t
tcagtgtactactccacgaccggtgctcgatttagtgctatagacttgggtttggggggaagaggaagactgacggtccccccaggagttcaggtgctgggcacagcggccctgggctgcctggtcaaggactacttccgagtagtacactgagcgggctggcaaggcgcatagnn

SEQ ID NO: 11464 - DNA, 503 bp, Homo sapiens
  misc_feature: GYAE6OF02JIGHR.16.86.H09.1.454.CMB.1.raw
  modified_base (410)..(410): a, c, t, g, unknown or other
  misc_feature (410)..(410): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaaatcatgatttatgaggtcagtaatcggccctcgaggggtttctaatcgcttctctggctcaagtctggcaacacggcctcctgaccatctctgggctcaggctgaggacgagggtnattattactgcagctcatatagaagtggcagcactctcgtattcggcggtggacaagctcgaccgtcgtaggtcacgccaaggctcgtccccg

SEQ ID NO: 11465 - DNA, 175 bp, Homo sapiens; identical to SEQ ID NO: 11450
  misc_feature: GYAE6OF02FGNGG.16.86.H09.1.454.CMB.1.raw
  modified_base (173)..(175): a, c, t, g, unknown or other
  misc_feature (173)..(175): n is a, c, g, or t

SEQ ID NO: 11466 - DNA, 501 bp, Homo sapiens
  misc_feature: GYAE6OF02H4U7T.16.86.H09.1.454.CMB.1.raw
  modified_base (242)..(242): a, c, t, g, unknown or other
  misc_feature (242)..(242): n is a, c, g, or t
tcagtgtactactccacgaccggtgctcgatttagtgctatagacttgggtttgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagccaccaggcaaagcacccaaattcatgatttangagtcactaatcggccctcaggggtttctaatcgcttctctggctccaagtctggcaacacggcctcctgaccatctctggctccaggctgaggcgaggctgattattactgcagctcatataagagtcggcagcactctacgtattcggcggtggacagctgaccgtctagtcagccaagctcgcccctgcactcttcgtcccacctcctcgatacgtacacgtggaacgcgggctggctaacggcgactatagcagc

SEQ ID NO: 11467 - DNA, 540 bp, Homo sapiens
  misc_feature: GYAE6OF02F3OMN.16.86.H09.1.454.CMB.1.raw
  modified_base (217)..(217): a, c, t, g, unknown or other
  misc_feature (217)..(217): n is a, c, g, or t
  modified_base (439)..(439): a, c, t, g, unknown or other
  misc_feature (439)..(439): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcactggatccagcagtgacgttggtagttataattatgtctcctggtaccaacagtacccaggacaaacgacccccaaactcatgatttatgagtcagtaatcggcctgagggtttctaatcgcttctctggctccaagtctggacaacgaccggcctccctagaccatcctcgtcgggcctccgaggcctaggaggaccggagggtagtaattagttacngcagtctcatatagagtgacagcctactcgtagtagttcgggaggtacgggacacgcgtacgtaccgttcgtacggtcagacccgaggtccaccgtccccg

SEQ ID NO: 11468 - DNA, 131 bp, Homo sapiens
  misc_feature: GYAE6OF02GBEGH.16.86.H09.1.454.CMB.1.raw
  modified_base (130)..(131): a, c, t, g, unknown or other
  misc_feature (130)..(131): n is a, c, g, or t
tcagtgtactactccacgaccggtgctcgatttagtgctatagacttgggtttgggcacagcggccctgggctgcctggtcaaggactacttccgagtagtacactgagcgggctggcaaggcgcatagnn

SEQ ID NO: 11469 - DNA, 631 bp, Homo sapiens
  misc_feature: GYAE6OF02F8Y42.16.86.H09.1.454.CMB.1.raw
  modified_base (306)..(306): a, c, t, g, unknown or other
  misc_feature (306)..(306): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctcctggtaccaacagtacccaggcaaacgcccccaaactcatgatttangagtcagtaatcggcctgtagggttctaatcgcttctctggctaccaagtctagcaacacggccctcccgtgaacctactcctcgtcgggccttccgaggtcctaggaacgggtaccggaggggttgtaactttattaccgttggcctaaggtccttaacgagttaaacgttaagggaaaggttcgggactaaggacctaacgttccgttaacgttacgttccggggtcggggtacgggtaacccgaaggtccgtacggtaccccgttaccggtacggtcccgtaaccggaccccgtaacgggtcccgtacccggtaccccccgg

SEQ ID NO: 11470 - DNA, 562 bp, Homo sapiens
  misc_feature: GYAE6OF02JI1VO.16.86.H09.1.454.CMB.1.raw
  modified_base (389)..(389): a, c, t, g, unknown or other
  misc_feature (389)..(389): n is a, c, g, or t
  modified_base (431)..(431): a, c, t, g, unknown or other
  misc_feature (431)..(431): n is a, c, g, or t
  modified_base (441)..(441): a, c, t, g, unknown or other
  misc_feature (441)..(441): n is a, c, g, or t
  modified_base (449)..(449): a, c, t, g, unknown or other
  misc_feature (449)..(449): n is a, c, g, or t
  modified_base (454)..(454): a, c, t, g, unknown or other
  misc_feature (454)..(454): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggaccaaacgacccccaaactcatgtattatgaggtcagtaactcggccctacgtaggggttactaatcgtcttctctcggcctaccaagtctgacaacgacgccctccncgaccatctcgtgggcctccgaggctggaggacggtagggtntattattacngcagcctnattanagagtggcacgctacttcgtacgtcgttcgggacgggtacgggaaccgaagtcgtacggaccgttaccgtaggtaccacggcccgaacggtccgtccgtaccccccgg

SEQ ID NO: 11471 - DNA, 513 bp, Homo sapiens
  misc_feature: GYAE6OF02FJ7CM.16.86.H09.1.454.CMB.1.raw
  modified_base (507)..(507): a, c, t, g, unknown or other
  misc_feature (507)..(507): n is a, c, g, or t
  modified_base (513)..(513): a, c, t, g, unknown or other
  misc_feature (513)..(513): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggtagggaccaagctgaccgtctaggcagcccaaggctgccccctcggtccacttcctcgttcccgccctcctcgacgtacgtacactgagcgggctggcaggcncatagn

SEQ ID NO: 11472 - DNA, 752 bp, Homo sapiens
  misc_feature: GYAE6OF02H9UKM.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgcctctcaccctcctcactcagggcacgagggtcctgggcccagtctcgccctgactcagcctgcctccgtgtcgtgggtctccgtggacagtcgatcatcatcttctgcactggatccagcagtgacgttggtagttataattatgtctcgtggtaaccaacacgtacccaggaccaaacgccccccaaactcatgatttatgaggtctagtaactccggtaccctgtacggggtttactaagtccgtcctttctcgtcggtcctaccgtaagtcgttcggacaaccgtcccgggtccctcccgtacgacctagttcccgttacggtcggggtcctacccggagggtaccgtcgggaaacgggtaccgggtaaggggttacgttaaacttttacgttaaccgtcggacgacggttaccttacgtaaacgttaacgggttaagaaacggggtttcgggaccgtaaccgtccttaccgtacccgttttacgggttaccgtttacccggggggtaccgggttacggggaaccccgttaaacgggtccgttaccgggttaacccccggttaccggttaacgggtacccgtaacccggggacccctaaaggggttcccccgtaccccggttaccccccccggg

SEQ ID NO: 11473 - DNA, 554 bp, Homo sapiens
  misc_feature: GYAE6OF02GLSFX.16.86.H09.1.454.CMB.1.raw
  modified_base (309)..(309): a, c, t, g, unknown or other
  misc_feature (309)..(309): n is a, c, g, or t
  modified_base (419)..(419): a, c, t, g, unknown or other
  misc_feature (419)..(419): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctaggtaccaacagtacccaggacaaacgccccaaactcatgtatttangaggtcagtaactcggccctgtagggtttctaagtcgtcttctctggctcaagtctgacaacgcggcctcctgaccatctcgtcggcctcgaggctggaggacgagggtntaatttacttacgtgcagtctacaatagtagtagtgacagctactcgtcgttagttcgggcggtacggaaccgaacggtcgtacggtaccgttccgtacggtccgaaccgacccgacggtccctccgtcccccgg

SEQ ID NO: 11474 - DNA, 510 bp, Homo sapiens
  misc_feature: GYAE6OF02I0HFB.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgagtcagtaatcggccctctaggggtttctaatcgcttctctggctcaagtctggcaacacggcctccctgaccatctctgggctccgaggctgaggacgagggtgattattactgcagctcatatagaagtggacagcactctcgtattcggcggtgggacctagctgaccgttccgtaggtcacgcccaggtctcgtccccg

SEQ ID NO: 11475 - DNA, 699 bp, Homo sapiens
  misc_feature: GYAE6OF02H0B7P.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttatattatgtctctgaccacagtaccaggacaacgccccaaatcatgtatttatagagtactagtaacgtccggcctacgtcggggtttactaacgtccgtacttcgtcgtcggtcctaccgtaacggtccgttacggaacctaaccgtaacccgggtccccttacccgtaccggtaaccctaaccgttcccgtttccggttacccggggccctttaccccgagggtccgtaagggtacggggaccgggtaaggggtttcgttaaacgttttacgtttacgtcgtacgtacgtccttactaagtaagttaacggtaagggtcggactacgtccgtaactccgttaccgttacggttaccgggtcgggttacgggaacccgtagtccggttaccggtacccgttcgttaccgggtaccaccggtacccggaaggtcccgtcccggtacccccgg

SEQ ID NO: 11476 - DNA, 497 bp, Homo sapiens
  misc_feature: GYAE6OF02HB25J.16.86.H09.1.454.CMB.1.raw
  modified_base (455)..(455): a, c, t, g, unknown or other
  misc_feature (455)..(455): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgagtcagtaatcggcctcaggggtttctaatcgcttctctggctcagtctggcaacacggcctcctgaccatctctgggctccgaggctgaggacgagggtgattattactgcagctcatatagaagtggcagcactctcgtattcggnggtggaccagctgaccgtctagcacgcccaggcctgtccccg

SEQ ID NO: 11477 - DNA, 666 bp, Homo sapiens
  misc_feature: GYAE6OF02IIBM3.16.86.H09.1.454.CMB.1.raw
  modified_base (222)..(222): a, c, t, g, unknown or other
  misc_feature (222)..(222): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
  modified_base (365)..(365): a, c, t, g, unknown or other
  misc_feature (365)..(365): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctcgccctgactcagcctgcctccgtgtcgtgggtcctccgtggacagtcgatcatcatcttcngcactggatccagcagtgacgttggtattataattntgtctctagtaccaanacgtaccaggacaaacgccccaaatcatgtatttagtgaggtctaagtaacgtccggtcctaggtacgggtttactaaagtccgtctttcncgtacggtcctacgtaagtccgttaggacaaaccgccggtccctaccctgaaccctatctcgtgggacctcgaagcgtaggacggacggagggttacgtaatttagttacgtcgacgtagtcctataaagttaagtaagtaacggttcgggaacaacggtaccctaacgttccgttaacggttacgtttccggggaaccgggttacgggaaacccggtaagtccgttaaaccggtccccgttaaccggttacggtaaccgccggtaacccgtaacggggtccttaccccggtaccccccgg

SEQ ID NO: 11478 - DNA, 689 bp, Homo sapiens
  misc_feature: GYAE6OF02G2QW8.16.86.H09.1.454.CMB.1.raw
  modified_base (330)..(330): a, c, t, g, unknown or other
  misc_feature (330)..(330): n is a, c, g, or t
  modified_base (511)..(511): a, c, t, g, unknown or other
  misc_feature (511)..(511): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcgagggcacgagggtccgtgggcccagtctcgccctgactcagcctgcctccgtgtcgtgggtctccgtggacagtcgatcatcattcttctgcacgtggactccgagcagtgtacggttggtagttaataattatgtctccgtaggtaaccaacacgtaccaggacaaaccgacccccaaactcatagtaatttagnggtaggtcaagtaacgtccggccctaggtacggggtttactaacgtcgtcttcgtcgtggtcctacgtaacgtcgtaggaccaaccgccggtccctccctacgacctactccgtacggtcgggtccctccggacggtcgtacgggaacgggacgggtagggttgttaagtttacgttacgngactacgtcttacaagttaacgtaggtaacgtggacgacgtactacgttccgttacggttaccggttccggggacgggttaccgggaacccgtaacggttcccgtaccggtacccggttaccgttacggtaccgtacccggtacccggaacggttcccgtaccccggttaccccccgg

SEQ ID NO: 11479 - DNA, 630 bp, Homo sapiens
  misc_feature: GYAE6OF02IWEHR.16.86.H09.1.454.CMB.1.raw
  modified_base (246)..(246): a, c, t, g, unknown or other
  misc_feature (246)..(246): n is a, c, g, or t
  modified_base (545)..(545): a, c, t, g, unknown or other
  misc_feature (545)..(545): n is a, c, g, or t
  modified_base (627)..(627): a, c, t, g, unknown or other
  misc_feature (627)..(627): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacgagggtcctgggtcctccacgtggaaccagcagtgacgttggtgttataactttgtctctgataccaacagccaccaggcaaagccacccaaattcatgtatttangagtcaactaatccggccctctaggggtttactaattcgtcttctctggctccaagtctggcaacacggcctcctgaccatctctgggctccgagctgaggacgagtctgattattattgcatctcaattataaccaaccaaacagacctaactcctaccgtaacttgggttactttcgggaaccgggaggggtaacccaaacggcgtacggtacccgttcccgtaagggttccgaacgccccgaaaggtcctacccggtcccccgttcgggacctacccgttcgttccggttcccccncccgttcccgtcgtacgttacgtaccgtacgttacggacggtccgggtacttacgggccgtaaacgggccgtacgacgtagnacg

SEQ ID NO: 11480 - DNA, 520 bp, Homo sapiens
  misc_feature: GYAE6OF02GN3F0.16.86.H09.1.454.CMB.1.raw
  modified_base (305)..(305): a, c, t, g, unknown or other
  misc_feature (305)..(305): n is a, c, g, or t
  modified_base (361)..(361): a, c, t, g, unknown or other
  misc_feature (361)..(361): n is a, c, g, or t
  modified_base (371)..(371): a, c, t, g, unknown or other
  misc_feature (371)..(371): n is a, c, g, or t
  modified_base (398)..(398): a, c, t, g, unknown or other
  misc_feature (398)..(398): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctcctggtaccaacagtacccaggcaaacgcccccaaactcatgatttangaggtcagtaatcgcctcaggggtttctaatcgcttctctgctcagtctggcaacncggcctcctnaccatctctgggctcagctgaggacgnggtgtattattactgcagctacatatagaagtggacagcacttcgtcgttagttcggcggtgggaccaaggtccgtacgtacccgttccgtacggtccacggcccaacggctccgtcccccg

SEQ ID NO: 11481 - DNA, 558 bp, Homo sapiens
  misc_feature: GYAE6OF02F1IUB.16.86.H09.1.454.CMB.1.raw
  modified_base (337)..(337): a, c, t, g, unknown or other
  misc_feature (337)..(337): n is a, c, g, or t
  modified_base (372)..(372): a, c, t, g, unknown or other
  misc_feature (372)..(372): n is a, c, g, or t
  modified_base (428)..(428): a, c, t, g, unknown or other
  misc_feature (428)..(428): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctcaggctcaccggggcccagcactgactcactggcatgtgtttctccctctttccagggtcctgggcccagtctgcccctgactcagcctgcctccgtgtcgtgggtctccgtggacagtcgatcatcatcttcngcatggatccagcagtgacgttggtattataattntcgtctcctggtaccaacacgtacccaggacaaacgccccaaactcatgtatttangagtcaagtaactccggtaccctcggtacgggtttctaacgttcgtctttcgcgttggccttacgaagttcgtacggacaaccggaccggtacccttccctcgtacctactacccgttcgtcgggtaccg

SEQ ID NO: 11482 - DNA, 179 bp, Homo sapiens
  misc_feature: GYAE6OF02G2YX6.16.86.H09.1.454.CMB.1.raw
  modified_base (173)..(179): a, c, t, g, unknown or other
  misc_feature (173)..(179): n is a, c, g, or t
tcagtgtactactccacgaccggtgctcgatttagtgctatagacttgggtttgggggaagaggaagactgacggtcccccaggagttcaggtgctgggcacagcggccctgggctgcctggtcaaggactacttccgagtagtacactgagcgggctggcaaggcgcatagnnnnnnn

SEQ ID NO: 11483 - DNA, 591 bp, Homo sapiens
  misc_feature: GYAE6OF02I60VE.16.86.H09.1.454.CMB.1.raw
  modified_base (384)..(384): a, c, t, g, unknown or other
  misc_feature (384)..(384): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcatcttctgcactggactccagcagtgacgttggtagttataattatgtctcctggtaccaacacgtacccaggaccaaacgacccccaaactcatgtaatttatgtaggtcaagttaactccggtccctacgtacggggtttactaactcgtacttctcgtcggctacagtcnggccaacgccggtccctcctgaccatcctcgtcggcctcgagtctaggaggacggtaggtagtatttacgttactcgactagtctactaattagtaggaagttcggacagtacgtacctacgttcgtagttccgggaggtacggtaccgtagacgtacgtacccgttcgtacggtccgtacgacccgaggtcccgtccggtaccccg

SEQ ID NO: 11484 - DNA, 636 bp, Homo sapiens
  misc_feature: GYAE6OF02IUPWX.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcattcttctgcactggatccagcagtgacgttggtagttataattatgtctcctggtaccaacagtacccaggacaaacgcccccaaactcatagtatttatgaggtcagtaatccggcctcgtagggtttactaagtcgtcttctctggcctctaagtctaggacaacgaccggtccctcccgtcgacctattcctcgtacgggtcctaccgaggtcgtaggacgggaacggtagggtagttaatttacttacgtgcagtcctactaatagtaagaagttggactacgtcctaccgtcgttacgttacggttccgggacgggttacgggaacccgtaacggtccgttaccggtaccccggttaccgttaacgggttaccgaacccgggtacccccggaacgggtcccgttacccggtaccccccgg

SEQ ID NO: 11485 - DNA, 608 bp, Homo sapiens
  misc_feature: GYAE6OF02HCLA6.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacacgtacccaggacaaacgcccccaaactcatgattatgaggtcaatatcgcctgtagggttctaatcgcttctctggtctccagtctggacaaccgacggccctccctagaccactcctcgtcgggtcctcgtacggctagggacggtacgggagggttgtaatttacgttacgtggtacagtccttacaagttaatacgggtaaggtcggactaagcctaccttccgttcgttacggtttccgggacgggttcgggaaaccctaggtccgttacggacccggttaccgttacggtaccgaaccggtccccggaagggtcccgtcccgtccccccgg

SEQ ID NO: 11486 - DNA, 503 bp, Homo sapiens
  misc_feature: GYAE6OF02GHEBX.16.86.H09.1.454.CMB.1.raw
  modified_base (406)..(406): a, c, t, g, unknown or other
  misc_feature (406)..(406): n is a, c, g, or t
tcagtgtactactccacgaccggtgctcgatttagtgctatagacttgggtttggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaatcatgatttatgaggtcagtaatcggcctcaggggtttctaatcgcttctctggctcaagtctggcaacacggcctccctgaccatctctgggctccaggctgaggacgagggtnattattactgcagctcatatagaagttggactagcactctgtattcgggcgtgggaccaagctagccgtctaggtcagcccaaggtcctgtcccccg

SEQ ID NO: 11487 - DNA, 751 bp, Homo sapiens
  misc_feature: GYAE6OF02I6LM9.16.86.H09.1.454.CMB.1.raw
  modified_base (309)..(309): a, c, t, g, unknown or other
  misc_feature (309)..(309): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacgagggtcctgggcccagtctgccctgactcagcctgcctcgtgtctgggtctcctggacagtcgatcatcatctctgcactggactccagcagtgacgttggtagttataattatgtctcctggtaccaacacgtaccaggacaaacgaccccaaactcatgatttangtaggtcagtaactcggcctcgtagggtttactaagtcgtacttcgtacgtcggccttaccgaacgttcgtacgggacctaaaccgtaccgggtacccttccctacgtaacctacttcccgttcggtacggggtacccttaccggacgggtaccgtacgggtaaacgggaccggggtaggggttaacggttaacgtttttaacgtttaaccggtcgtaccgtaaggtacccgtttaacgaacgtttaaaggtaacgggtaacgggttacgggacctaacggtacccttaccgtttacccgttacggtttaaccggttccggggttacccggggtacggggtaacccgtaacggtaccgttaccggtaaccccggttccggttaccggttaaccggaccggtaccccggaaagggttccccttacccgggttaccccccccgg

SEQ ID NO: 11488 - DNA, 505 bp, Homo sapiens
  misc_feature: GYAE6OF02GZE5V.16.86.H09.1.454.CMB.1.raw
  modified_base (410)..(410): a, c, t, g, unknown or other
  misc_feature (410)..(410): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggacaaagcccccaaatcatgatttatgaggtcagtaatcggcctcgagggtttcaatcgcttctctggctcagtctggcaacacggccctcctgaccatctctgggctccgaggctggaggacgagggtntattacgttactgcagctcaatatagagtggcagcactcgtcgtgttcggcggtcggactagcgtgacgtctaggcacgccgaagctcgtccccg

SEQ ID NO: 11489 - DNA, 594 bp, Homo sapiens
  misc_feature: GYAE6OF02FP74A.16.86.H09.1.454.CMB.1.raw
  modified_base (309)..(309): a, c, t, g, unknown or other
  misc_feature (309)..(309): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcattcttctgcactggactccagcagtgacgttggtagttataattatgtctctggtaccaacagtacccaggcaaacgccccaaactcatgattttagngaggtcagtaatccggccctgtagggtttctaagtcgtcttctctgctctaagtctgaccaagaccggtcctccctgacccatctcgtcgggctcccgaggctaggacggacggtaggggtataatttacgtttacgtgctagtcctagtagtaagttacggaaggtcggacacgcctacgttccttcgtagttccgggtcgggtacgggtaaccgaacgtccgtaccgacccggttacgtacggtccgaacggtacccggaacggtcccgtcccggtcccccgg

SEQ ID NO: 11490 - DNA, 608 bp, Homo sapiens
  misc_feature: GYAE6OF02HSJRQ.16.86.H09.1.454.CMB.1.raw
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttatattatgtctctggtaccacagtacccaggcaaacgccccaaatcatgtaattatgaggtcagtaactcggccctcgtaggggtttctaatcgtcttctcgtcgctcaagtcgtggacaacgaccggccctccctcggacctactccgtcgtcgggtctccgaggcgttggaggtacgggagggttagtaatttacttacgtcgccctacttacaattagtaagtaagtacgtacctactccgtttggttcggtttcgggacggtacggggtacctaacggtccggtacggtacccggttaccgtacggtacgaccggacccgaacggtcctcccggacccccgttcggtaccttacccg

SEQ ID NO: 11491 - DNA, 620 bp, Homo sapiens
  misc_feature: GYAE6OF02HGOHM.16.86.H09.1.454.CMB.1.raw
  modified_base (458)..(458): a, c, t, g, unknown or other
  misc_feature (458)..(458): n is a, c, g, or t
  modified_base (473)..(473): a, c, t, g, unknown or other
  misc_feature (473)..(473): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactgactccagcagtgacgttggtagttatattatgtctctgtaccacacgtaccaggcacacgaccccaaactcactgtatttatgtaagtcagtaatccggtccctacggacgggtcctgactcgtcttcgtcgtcgggtacctaagtcgtacggaccaaccgccggtccctccccgtgaccctacgttcctcgtcggcctaccgaggtctagggacggacgaggtctagtactttntactgcagtcttaanatacgacggtactaaacgttaactttacgtttcgttaccgttacggaacgttacgggacctaaacgggtccctaacgggtacccgttaaggtacccgaaccggaaccccgtaacggaaccccctaaaccccgtcgttacgtaacccg

SEQ ID NO: 11492 - DNA, 707 bp, Homo sapiens
  misc_feature: GYAE6OF02JKY4S.16.86.H09.1.454.CMB.1.raw
  modified_base (238)..(238): a, c, t, g, unknown or other
  misc_feature (238)..(238): n is a, c, g, or t
  modified_base (320)..(320): a, c, t, g, unknown or other
  misc_feature (320)..(320): n is a, c, g, or t
tcagtgtactactccacgaccggtgctcgatttagtgctatagacttgggtttgggggggggtcgttcgaggaggcgagcgctctcaggacatctccaccatggcctgggctctgctgctcctcaccctcctcactcagggcacagggtcctgggcccagtctgccctgactcagcctgcctccgtgtctggtctcctggacagtcgatcatcatcttctgcactggatccagcagtnacgttgtagttataattatgtctctgtacacagtaccagacaaacgccccaaactcactgtatttagtgagtacaagttaancgtccgtctaacggggtttctaagtcgtcttcttccgttggtcctaccgtaacgtcgtacggtacgaaccgacggtccccgttccctcggaaccctacttcgtccgtacggggccttacccgacggtcgttcggacgggtaacggtacggggtgtaaacgtttacgtttacgtacggtacgtacggtcttaccgaagtttaattaacgggtaaagtccggacggaacgttaccgaaacttccggttaaccgtttagggttcccgggtaggggtaccggggtaaccccgttaaagggcccgttaaaccggtcccgggttaacccgtttacggggttacccaaccgggttacccgaaaccggggttccttacccgggtacccccccggg

SEQ ID NO: 11493 - DNA, 634 bp, Homo sapiens
  misc_feature: GYAE6OF02ICVRM.16.86.H09.1.454.CMB.1.raw
  modified_base (209)..(209): a, c, t, g, unknown or other
  misc_feature (209)..(209): n is a, c, g, or t
  modified_base (246)..(246): a, c, t, g, unknown or other
  misc_feature (246)..(246): n is a, c, g, or t
  modified_base (257)..(257): a, c, t, g, unknown or other
  misc_feature (257)..(257): n is a, c, g, or t
  modified_base (340)..(340): a, c, t, g, unknown or other
  misc_feature (340)..(340): n is a, c, g, or t
tcagtgtactactccacgaccggtgctcgatttagtgctatagacttgggtttgggggggggtcgtcaggaggcagcgctctcaggacatctccaccatggcctgggctctgctgctcctcaccctcctcactcagggcacagggtcctgggtcctccactggaaccagcagtgacgttggtggttataactttgtctctgataccaanagcacccaggacaaagcaacccaaattcatgatttangagtcactaancggccctcgtaggggtttctaagtcgtccttctcgtggccttccgaaacgtcgttcggactaaccgaaccggcccttccccgngtaaccctacgtcttcccgtggggaccttcccgagggctggaacgggacgaggcctaggtaactttattatttgacattctacctaataactaccaaaacactaagccaactcctacgtactaggttacgttcggacgggaacgggaccaaagccgtaagaccgtccgttaggccacggacccaaggcctaccgtccccgtagtccaccttacgtccgttcccaacccgtcgtacgacgtacggtacctacgtgtacgccggtctacggtacgacgggcgactaagtagagtcg

SEQ ID NO: 11494 - DNA, 559 bp, Homo sapiens
  misc_feature: GYAE6OF02IAGO6.16.86.H09.1.454.CMB.1.raw
  modified_base (326)..(326): a, c, t, g, unknown or other
  misc_feature (326)..(326): n is a, c, g, or t
  modified_base (345)..(345): a, c, t, g, unknown or other
  misc_feature (345)..(345): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctcctggtaccaacagtacccaggacaaagccccccaaaatcatgatttatgaggtcagtaatcggcctnaggggtttctaatcgcttntctggctcaagtctggacaacaacgccctacctcgacctatcctacgtcgggcctccgaggtctggaggacggagggttctagtttattacgtgacagctatataagtagaagtggacagtcacgtcgtagtattcgggcggtcggaacgtaagccgtacggtacccggttacgtacggtcacgacccggtaaggtcccgtaccgtccccccgg

SEQ ID NO: 11495 - DNA, 744 bp, Homo sapiens
  misc_feature: GYAE6OF02JBW1V.16.86.H09.1.454.CMB.1.raw
  modified_base (251)..(251): a, c, t, g, unknown or other
  misc_feature (251)..(251): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccgaggggaagggcttcgagggacctcgtgggctgatccttggtctcctgctcctcaggctcgaccggggccagcactgactcacgtgcatgtcgtttcnccctactttccagggtcctgggaccctaggtctcgccctgactcacgtcctcgcccttccgtgtccgtcgggtcctccgtaggaccagttccgattcattccaattccttcgtagcctaccgttggaacttcccgaaggccgtaggttacggtaccgtttaggggttagttttaaataagttttacgtcgttcgttaccgttacggtaacccgtaaaccgtacgttaacccgacggtaaccgaaaccggtaaccccctaaactacccgtaattaacggttaacttttaacggtacggtaacggtactaaacggttaaaccgtcccggttaacccgttcggttaacggggttttaccgttaaacgttccgtacgtttccttccgttcggttaccgttaccgtaacggttccgttacggaccgtaaacccggtacccggtaccccgttacccgtacgtacccgttaccgttcgttcccggttaacggttccccgg

SEQ ID NO: 11496 - DNA, 534 bp, Homo sapiens
  misc_feature: GYAE6OF02FVYSL.16.86.H09.1.454.CMB.1.raw
  modified_base (346)..(346): a, c, t, g, unknown or other
  misc_feature (346)..(346): n is a, c, g, or t
  modified_base (358)..(358): a, c, t, g, unknown or other
  misc_feature (358)..(358): n is a, c, g, or t
  modified_base (456)..(456): a, c, t, g, unknown or other
  misc_feature (456)..(456): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccaacagtaccaggcaaacgccccaaactcatgattatgagtcagtaatcggccctcgtacgggtttctaatcgtcttctntcgctccagtcngcaacaccggcctccctgaccacgtctcgtcggctccgaggctggacggacggagggttgtattagttacgtgacgtgctcatatagtaagtcggacngctactcgtcgtagttcggtggtacggacgacgcgtcgtaccggtcgtacggctacggaccgacgccgtccgtccccg

SEQ ID NO: 11497 - DNA, 535 bp, Homo sapiens
  misc_feature: GYAE6OF02JB4MQ.16.86.H09.1.454.CMB.1.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
  modified_base (386)..(386): a, c, t, g, unknown or other
  misc_feature (386)..(386): n is a, c, g, or t
  modified_base (389)..(389): a, c, t, g, unknown or other
  misc_feature (389)..(389): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (413)..(413): a, c, t, g, unknown or other
  misc_feature (413)..(413): n is a, c, g, or t
  modified_base (417)..(417): a, c, t, g, unknown or other
  misc_feature (417)..(417): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacngtcgatcatcattcttctgcactggactccagcagtgtacggttggtagttataattatgtctcctggtaccaacacgtaccgagacaaaccgacccccaaactcatgtaatttatgaggtcaagtactccggccctggtagggtttctaatcgtctctctcgctcagtctgcacncgcctccnacntctgcggctcgngcgngaggacgnggtntattatacgtgacagctacgattacgagtagtcgctagccacgttctgttcgtgggcggtacggaaccaggtcgtacgtacccgtcgtacgtcaccggaccgcgtccgtccgtccccg

SEQ ID NO: 11498 - DNA, 818 bp, Homo sapiens
  misc_feature: GYAE6OF02FSU2M.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggtcagtcgatcaccatcctcctgcactggaagcggcagtgagttggttagggggttacttaaccttgtcttccgtcggtaccgagcacgccacccagaaccaaaccgacccccaaactccaatagtaattttagtggagggacaaagtaacggccggtaccctacgaggtacgttttactaacgtccgtacttctcgttcggtccttacccgtacgttccgtacggacctaaaccgtacccgggtcccttacccgtacgaaccgtaacttaccgttccgttccggtccccgtacccggtagggtccccccccccccccccccccggtagggtaacggggtaacgggtacgggtaccggttacggttaacgtttaacgtttaacgttacgtcgttcgtaccgttacctaacgtttaacgtttaccgttaacggttacggttacggttaccttaccgtttacgtttcggttttaccggtttttacggggtaccggggtaacggggtaaaccggtaacggggttaccgggtaaccccggttaccggttaaccgggttaccggtaacccgggtaaccccggtaacccgggtacccggttaccccggttaccccccggttacccggg

SEQ ID NO: 11499 - DNA, 501 bp, Homo sapiens
  misc_feature: GYAE6OF02FYQXE.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggcctcaggggtttcaatcgcttctctggctccaagtctggcaacacggcctccctgaccatctctgggctccaggctggaggacgagggtgattattactgcagctcatatagaagttggacagcactctcgtattcggcggtgggacagctgaccgtcaggtcagcccaaggctgccccg

SEQ ID NO: 11500 - DNA, 560 bp, Homo sapiens
  misc_feature: GYAE6OF02IMQDR.16.86.H09.1.454.CMB.1.raw
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (314)..(314): a, c, t, g, unknown or other
  misc_feature (314)..(314): n is a, c, g, or t
  modified_base (496)..(496): a, c, t, g, unknown or other
  misc_feature (496)..(496): n is a, c, g, or t
  modified_base (520)..(520): a, c, t, g, unknown or other
  misc_feature (520)..(520): n is a, c, g, or t
  modified_base (558)..(558): a, c, t, g, unknown or other
  misc_feature (558)..(558): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcaccaggcaaagcaccaaattcatgatttangaggtcactaagtccggcctcgtagggtttctaatcgtcttctctggctcagtctggcaacncggcctccngaccatctcgtcggctccgagctgacggacgaggctgtattattattgctatctacatactaccaacaacagactactctacgacgttggtagttcgggacggacgggaccgagcgtacgaccgtcgtacgtacacgaccgaacggccgtaccgccccgtcgtccacttccgtccgttcccncccgtccgtacgtacgtacgtacncgtcggacggcggtcgtacggcgaacggcgacgagtgncg

SEQ ID NO: 11501 - DNA, 697 bp, Homo sapiens
  misc_feature: GYAE6OF02HYYRJ.16.86.H09.1.454.CMB.1.raw
  modified_base (391)..(391): a, c, t, g, unknown or other
  misc_feature (391)..(391): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacaggtgacgcctccgagggaaggggcttcgagggacctcgtgggctgatccttggtcttcctgcctcctcgaggctcgaccgggcccagcactgactcactggctatgttcgtttcctcccttcgtttaccgacggggttcccgtcgggccccaggttcctcgccccttggaccttcgacgtcctcgccccttccggttggttccgtacgggttcctccgtaggacctagtcgactctacgtcattcttcngcctacgtcggactccgagtccgtaaggttcgtacggtttaggttaacgtttaataagttttcgtacgttaccgttaccgtacggtaaacctaaccgtaacgtaacccgaacggaacccaaaaccgtaccccctaaatacctaagttacgttaattagtacggacgtactaacggtacgttcccggtacccgttaggtttaacgggtttactaacgttccgttacttcgtcgttcgccttacgaccgtcgtacgacctaacccgtccgtaccctacgtacgtacctacgtcgttccgtcgtacccg

SEQ ID NO: 11502 - DNA, 716 bp, Homo sapiens
  misc_feature: GYAE6OF02FZBNE.16.86.H09.1.454.CMB.1.raw
  modified_base (218)..(218): a, c, t, g, unknown or other
  misc_feature (218)..(218): n is a, c, g, or t
  modified_base (318)..(318): a, c, t, g, unknown or other
  misc_feature (318)..(318): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcatcttcngcactggactccagcagtgacgttggtagttataattatgtctcctaggtaccaacgacgtacccaggaccaaacgaccccctaaactcatgtatttagngtaggtcaagtaacgtccggccctaggtacgggtttactaagttccgtctttacgtcgtcggtcctaccgtaacgttcgtacggaccctaaaccgacccggtcccttacccgtacggtaaccctacgtttccgtaccggttcggggtcccttacccgggacgggtccgtaacggggtaaccggggtaacgggtacggggtttagttaaacgttttacgtttaccgtcggtaccgtacgtccttacgtaacgttaagtaacgggtaaggtcggtacgaacggtcctaacgttcgttacgttacggttccgggtacgggtacgggacctaacggtccgtaaccggtaccgttacggtacggtaccgaccggtaccgaacggtcccgtaccgtacccccgg

SEQ ID NO: 11503 - DNA, 545 bp, Homo sapiens
  misc_feature: GYAE6OF02FZN8U.16.86.H09.1.454.CMB.1.raw
  modified_base (435)..(435): a, c, t, g, unknown or other
  misc_feature (435)..(435): n is a, c, g, or t
  modified_base (438)..(438): a, c, t, g, unknown or other
  misc_feature (438)..(438): n is a, c, g, or t
  modified_base (465)..(465): a, c, t, g, unknown or other
  misc_feature (465)..(465): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacacgtacccaggacaaacgcccccaaatcaatgatttatgagtcagtaatcggcctcgagggtttctaactcgcttctctggctccaagtctgactaacacggcctacccgtgacctatctcgtgggcctcgaggtctaggaggacgagggtgtaattattacgngtnagtctcatactagaagtgcagcacttncgtattcgggcggtagggtaacaacgtcgtacggaccgttaccgtaggtacctacggacccgtaggcctacggtcccccg

SEQ ID NO: 11504 - DNA, 729 bp, Homo sapiens
  misc_feature: GYAE6OF02IVBU6.16.86.H09.1.454.CMB.1.raw
  modified_base (144)..(144): a, c, t, g, unknown or other
  misc_feature (144)..(144): n is a, c, g, or t
tcagtgtactactccacgaccggtgctcgatttagtgctatagacttgggtttgggggggggtctcaggaggcagcgcgtctccaggactatctccaccatggcctgggctctgctgctcctcaccctctcactcgagggcacngggtccgttgggcccagtcgtcgccctgaactcacgcctgcctccgtgtctgggtctccgtggacaggtcgatcgaatccgagttccttcgtgctaccttgggactccgacgctaggtggtacgttaggtacttaagttaattgcgttacgttccgtagggtaacctaacgtaaccgtaccccgaagggacctaaaacccggacccccgtaaaacgttccagttaggtaacgtttagtacggtaacggtaactaagttaacgtccggtacgttacgtaggggtttaactaacgtccgtcttcgtcgtcgtactaacgtagtcgtcggaactacgaccgtcctaccgtagaccctatcctacgtacgggccttacgcggtactagggacggtacggtggtattaacgttacgtagtcgactacgcgtactaagttagtagaacggttagacgtagtaccgtaacgtttcgtacgttaacgttccgggtaacggtaaccgggtaacgacggttcctaccgggtacccgtttacggggtaacgtcccgtaacgggacccgttaacggcccgtacccggttaccccggg

SEQ ID NO: 11505 - DNA, 814 bp, Homo sapiens
  misc_feature: GYAE6OF02GXV48.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctcgtgtctgggtctccgtggacagtcgatcatcattcttctgctacgtggactccgagcgtaggtcggtacggtttggtaagtttaattaatttaagtcgttccttcccgttacggtaacccaaacgtaacgttacccgaagggaacccaaaaccggacccccctaaaactcctaattaggttaattttaacggtggtaacggttactaacggttaaaccgttcccgggtaccccgttacgggttaacggggttttacctaacgttcccggttacctttcctcggttcggtaccttaccgtaaacggttccgttacggaaccctaaaccgtacccggtaccccttcccgtacgaaccctcttacccgttccggtccgggttaccctccggtagggtaccgtacggggtaaacgggtacgggtaaggggttacgttaacttttaaccgttacggtcgtaccgtagtcccgtaacgtaagttaagttaaggtaacggtggtaaccacgaccttaccgttacgttacggttacggttccggggtacggtacgggaacccgttaaggtccgtaaccggtcccgtttacggtaacggtaccgaccggtacccggtaacggtcccgttccccggtaccccggg

SEQ ID NO: 11506 - DNA, 726 bp, Homo sapiens
  misc_feature: GYAE6OF02JDFME.16.86.H09.1.454.CMB.1.raw
  modified_base (307)..(307): a, c, t, g, unknown or other
  misc_feature (307)..(307): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggactccagcagtgacgttgtagttataattatgtctctgtaccaacacgtaccaggacaaacgcccccaaatcatgtatttagngtaggtacagtaactccggccctaggtacgggtttactagtcgtcttcctcgtcggtcctaccgtaagtcgtacggacctaaccgaccggtccctcccgtacgtaccctacgttccgtttaccggtccggggtaccctcccggacgggttaccgtacggggtaaccggggaacgggttaacggggttacttaacgttttaacgtttaccgtcggtacgtaaccgtccttaccgtaagttaagttaacggtaacggttcgggtaacctacgtaccttaccgttaccggtttacggttaccggttccggggtaacgggtaccgggtaacctaacggtccgttaccgggtaacccgttaccggttacggtacccgtaacccggtacccggtaaccggttcccggtccccgttaacccccggg

SEQ ID NO: 11507 - DNA, 523 bp, Homo sapiens
  misc_feature: GYAE6OF02HB4MT.16.86.H09.1.454.CMB.1.raw
  modified_base (363)..(363): a, c, t, g, unknown or other
  misc_feature (363)..(363): n is a, c, g, or t
  modified_base (446)..(446): a, c, t, g, unknown or other
  misc_feature (446)..(446): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttgtagttataattatgtctctggtaccaacagtaccagacaaacgcccccaaatcatgtattatgagtcagtatcgcctgtagggttctatcgtcttctctgctcagtctgcacgacgcctccngaccatctcgtcggcctccgagctggacggtacggagggtgtaattagttacgtgctagctacatatagagtggcagctactntcgtacgtcggcggtacggacaggtctacggtaccgtacgtacggtccgacgacccgacggtccgtaccgtcccccg

SEQ ID NO: 11508 - DNA, 726 bp, Homo sapiens
  misc_feature: GYAE6OF02GGUPX.16.86.H09.1.454.CMB.1.raw
  modified_base (167)..(167): a, c, t, g, unknown or other
  misc_feature (167)..(167): n is a, c, g, or t
  modified_base (249)..(249): a, c, t, g, unknown or other
  misc_feature (249)..(249): n is a, c, g, or t
  modified_base (372)..(372): a, c, t, g, unknown or other
  misc_feature (372)..(372): n is a, c, g, or t
  modified_base (722)..(722): a, c, t, g, unknown or other
  misc_feature (722)..(722): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccngcagtgacgttggtgttataactttgtctcctgactaccaacagccacccaggcaaacgccaacccaaattcatgtatttangaggtcaactaacgtccgccctcgagggtatctaatcgtcttctcgtggcctccaagtctggacaacaccggccctcccgcgtaccgtctctcggtccctcagtaccgtggacggacgacggnttagtatttaacttacgtcgtaccgtaactctaattaataagtaagttacgtacttaccgttccgtttaggtttcgggttttaccgggacgggtaacgggtaccgaacggtccgttaccggtaacccgttaccgttaacgggtacctaaccggtaacccggtaacggccccgtttacccggtccccccggttacggttacccctaaccgtttcccgtttcccgggttccccccgtccccgtttacccgttacccggtaaacggtttaacgtaacccgtacggtacggtaccgggtaccggggtcggttacggaccggtaacggtcccgtagtacggtacggctccgatcncgtc

SEQ ID NO: 11509 - DNA, 553 bp, Homo sapiens
  misc_feature: GYAE6OF02F6DJA.16.86.H09.1.454.CMB.1.raw
  modified_base (308)..(308): a, c, t, g, unknown or other
  misc_feature (308)..(308): n is a, c, g, or t
  modified_base (382)..(382): a, c, t, g, unknown or other
  misc_feature (382)..(382): n is a, c, g, or t
  modified_base (387)..(387): a, c, t, g, unknown or other
  misc_feature (387)..(387): n is a, c, g, or t
  modified_base (418)..(418): a, c, t, g, unknown or other
  misc_feature (418)..(418): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttaataattatgtctcctggtaccaacacgtaccaggcaaacgcccccaaactcatgtattangtaggtcagtaactcggcctacgtagggttctaactcgtacttctctcgctccaagtctgacacgacgcctccngaccntctcgtggctccgaggctggaggacgaggtntaattagttcgtgcagtctactaagtaataggtaagtcggacagctacgtctacggttagttcggggcggtacggaaccgagccgtacggacccgtcgtacggcgaccgaccgtacggtcccgtccgtcccccgg

SEQ ID NO: 11510 - DNA, 628 bp, Homo sapiens
  misc_feature: GYAE6OF02G2RTC.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcattcttctgcactggatccagcagtgacgttggtagttataattatgtctcctggtaccaacacgtacccaggaccaaacgacccccaaactcatagtatttagtgaggtcagtaacgtcggccctcgtagggtttctaatcgtcttctcgtcggctacaagtcgtgaccaaccgaccggtccctccctcgacctactctccgtcgggtccgtccgacggtcgtcggacgggacggagggtagttagttattacgtgcacgctactataagaagttttttttttttaagacggtacgacgaccgtacgtcgttacgttacggttcgggtacgggtacgggtaaccggtaacggtaccgtacgtacccgttaccgtacggtaccgtaccggacccggtacggtccgtcccgtcccccgg

SEQ ID NO: 11511 - DNA, 564 bp, Homo sapiens
  misc_feature: GYAE6OF02I99SN.16.86.H09.1.454.CMB.1.raw
  modified_base (353)..(353): a, c, t, g, unknown or other
  misc_feature (353)..(353): n is a, c, g, or t
  modified_base (388)..(388): a, c, t, g, unknown or other
  misc_feature (388)..(388): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacaggtgacgcctccgagggaaggggcttcgagggacctcgtgggctgatccttggtctcctgctcctcaggctcgaccgggcccagcactgactcacgtcggctattgttcgtttcctcccttcgtttccggagggttcctgggccctagtctcgccctgacctcgacgcctcgcctcgtgtcgtggtcctcgtggactgtcatcatcatctncgctacgtgactcagcagtgtagttgtattatatntgtctcgtacgtacaacgtacgtaccagaccaaccgacccaatctagtatattgagtagtactagtacgtccgtacctacggtaggtttctaacgttcgtacttcgtcgtcgtactacgtacgtcgtcgacctaccgtccgtccctccgtcgacctacgtccgtacggtcgtaccg

SEQ ID NO: 11512 - DNA, 749 bp, Homo sapiens
  misc_feature: GYAE6OF02JYE67.16.86.H09.1.454.CMB.1.raw
  modified_base (254)..(254): a, c, t, g, unknown or other
  misc_feature (254)..(254): n is a, c, g, or t
  modified_base (301)..(301): a, c, t, g, unknown or other
  misc_feature (301)..(301): n is a, c, g, or t
  modified_base (358)..(358): a, c, t, g, unknown or other
  misc_feature (358)..(358): n is a, c, g, or t
tcagtgtactactccacgaccggtgctcgatttagtgctatagacttgggtttgggggggggtcgtcgaggaggcagcgctctcaggacatctccaccatggcctgggctctgctgctcctcaccctcctccactcagggcacaggtgacgcctccagggaaggggcttcgagggacctcgtgggctgactccttggtctcctgctcctcgaggctcgaccggggccagcactgactcactggcatgtgttccnccttcttccgagggtcctgggccctaggtctcgccctgacctcgacncctcgccctccggtgtctcgggtctccgtaggacctgtcgatcactcattccttacncggtcaaccgtggacttcccgagccgtaggtcgtacggtttaggttagttaacttaagtttacgtgtccttaccgttaaggtaccctaaacgtaacggttacccgacggtaaacccgaaaccgtaaccccctaaacttcctaaggtacttaaggtttaagtacgtaaggttaccgttaacgtaacgttcccggtacccgtttaacggttaccggggttttacgttaaaccgtttccggtacccttttcggtaacgtttcccgggttacggttaaccctacgggtttccgtaccggggaaacccttaacccgggtacccggtttacccccttaccccggttaacctaaccccgttacgttttccccgtaccggttaccgggttacccccggg

SEQ ID NO: 11513 - DNA, 570 bp, Homo sapiens
  misc_feature: GYAE6OF02FOZPN.16.86.H09.1.454.CMB.1.raw
  modified_base (416)..(416): a, c, t, g, unknown or other
  misc_feature (416)..(416): n is a, c, g, or t
  modified_base (421)..(421): a, c, t, g, unknown or other
  misc_feature (421)..(421): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaacgcccccaaatcatgatttatgagtcagtaatcgccctcgtagggtttactaagtcgtcttctcgtggtctcaagtctgacaacgaccggcctcctgaccatctcgtgggtcctccgaggctggaggacgngggtntattacttactgtcagtcctactatactagacgttggacacgctacgtccgttcgtacgttccgggacggtacgggtaaccgaaggtccgtacggtacccgttccgttaacggtcaacggtccccgaacggtcctcccggtacccccgg

SEQ ID NO: 11514 - DNA, 702 bp, Homo sapiens
  misc_feature: GYAE6OF02G6Q06.16.86.H09.1.454.CMB.1.raw
tcagtgtactactccacgaccggtgctcgatttagtgctatagacttggggtttggggggggggtctcaggaggcagcgctctcaggacatctccaccatggcctgggctctgctgctcctcaccctcctcactcagggcacgagggtcctgggcccagtctcgccctgactcagcctgcctcgtgtcgtggtctcgtggacagtcgatcatcattcttctcgctacgtcggactccagcagtggacgtttaggtagttataattatgtcctcgtacggtaaccaacgacgtacccagaccaaaccaccccaaactcatatattagtagagtacagtaactccggccttaggttacgggttactaacgtccgtcttctcgtcgtacctacgagtcgtacgacctaacgtcccggtcccttacccgagtaccctacgtccgtccggttacgggaccctaccggtacggtacgttagggaaccgggacgggtagggtaattacgtttacgttaaccgtgacgtcgtaccttactaaagttagtaacggacggttacggactaacgttcccttaacgttccgttacgggttacggtccggggttaccgggaaccggtaaccgacggttcccggtaccggttaacccgtaccggttaacggtcccgacggtaccccggtaacgtcccgtaccccggtaacccccgg

SEQ ID NO: 11515 - DNA, 711 bp, Homo sapiens
  misc_feature: GYAE6OF02IH3ZJ.16.86.H09.1.454.CMB.1.raw
  modified_base (266)..(266): a, c, t, g, unknown or other
  misc_feature (266)..(266): n is a, c, g, or t
  modified_base (309)..(309): a, c, t, g, unknown or other
  misc_feature (309)..(309): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacgagggtccgtgggcccagtcgtgccctgactcagcctgcctccgtgtcgtggtctccgtggacagtcgatcatcattcttcagcactgactccagcaggtgacgttgtagttatattatgtctcngtacacactacagacaaacgccccaaacgtcatcgtatttagngtagtctaagtaacgtccggtaccctacggttaggggttttacaacgtcgttccttcgttacgtcggtacctacgtaagtccgttacggaccaaccgaccggtcccgtaccctacgaacctctccgtaccggtcggtaccgtacccgtggacgtacggaacgggtcggtagggtacttaagtttacttaccgtgaccgtacgtacctacgtaaactaaggtacgtaagtccggtacgacgtacgtaccgttccgttacggttaccgttccggggtacgggttaacgggaacccggtaaccggttccggttaacccgggttaccccgtttaaccgggtcccgggttaaccgaacccggtaccccggtaacccgggttccccggtaccccggttcccccccggg

SEQ ID NO: 11516 - DNA, 655 bp, Homo sapiens
  misc_feature: GYAE6OF02JE37J.16.86.H09.1.454.CMB.1.raw
  modified_base (313)..(313): a, c, t, g, unknown or other
  misc_feature (313)..(313): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgctactggactccagcagtgacgttggtagttataattatgtctcctaggtaccaacacgtaccaggacaaacgcccccaaaacttcatgtattangaggtacagtaactcggccctagtagggtttctaatcgtcttcgtacgtcggtctacctaagtcgtacggacaaccgacccgtccctaccctcgtacctactccctcggtagggtcctccgtacggccgtaggacgggacggtagggttagtaagtttacgttaactgctaagtccgtactaattacgaagggtaagtcggacgaacgtaccgtaccgttaccgtacgttaaccggttccggggtacggggtaccgggtaaccgaacggttccggtacggtacccgttacccgtaggtacccgtacgaacccggaacgggtcccgtccccggttacccccgg

SEQ ID NO: 11517 - DNA, 740 bp, Homo sapiens
  misc_feature: GYAE6OF02I92GQ.16.86.H09.1.454.CMB.1.raw
  modified_base (216)..(216): a, c, t, g, unknown or other
  misc_feature (216)..(216): n is a, c, g, or t
  modified_base (591)..(591): a, c, t, g, unknown or other
  misc_feature (591)..(591): n is a, c, g, or t
  modified_base (638)..(638): a, c, t, g, unknown or other
  misc_feature (638)..(638): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgactactactacnttccttcgtcgacgtacggtacggtacctaccgaccgtacgtaggtacggttacgggtttagggttaagtttaaatttaagttagttccggttcccgttacggttaaccggtaaccaacgtaaccgtaccggacggtaaacccgaaacccctaacccctaaacgtctaacgttagttacttagtacggtacgtacgtaaacgtccgtcccggtaccgtaggggtttacggttactaacgtccgttcttactcggtacggtacctaacgtacgtggtaccgaaccgtaaccgtcccggtacctcgtacgtactacgtctacggcgaccctacggcgtagacggacgggtacggtcggtaattactttacgtacggnacctacgtccgtagtaagtttaccgggaagtcggtacgaaccgttancccgttagttccgtacgtacgggtcggtaacgggactaacgtcgtccgtaccggtacttacggccgtaaccgcccgaacgtaccggtcctcccgtacccggg

SEQ ID NO: 11518 - DNA, 726 bp, Homo sapiens
  misc_feature: GYAE6OF02GX2S2.16.86.H09.1.454.CMB.1.raw
  modified_base (706)..(706): a, c, t, g, unknown or other
  misc_feature (706)..(706): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacaggtgacgcctccgaggggaaggggcttcgagggacctcgtgggctgatccttggtctctgctcctcgaggctccgaccggggccagccactgactcactggcattgttcgtttcctccccttcgttttccgacggggttcctcggggcccctaggttcctcggtccccttggaaccttccgacgtccgttccgcccttcccggtgttccggtcgggtccttccgtagggacctcggtcatctatcctattccttactgacctacgtggaccttcaggactaggtacgtacggtttaggtttaactttaattaaagtttgttccgttaccgttaccggttacggtaaccctaaaccgtaaccggttaacccgaacgggtaacccaaacccggaaccccctaaacgtacttaacgttacgtttaacgttacgtacggttacggtacctaacgttaaccgtcccggttacccgttacggttacgggtttcctaacgtccggttccttcgtccgtacggtccttaccgtacggttcctacggaccgtaaccgtccgtccctccgaccncctacgtccgttcgcgtccg

SEQ ID NO: 11519 - DNA, 248 bp, Homo sapiens
  misc_feature: GYAE6OF02I8IWY.16.86.H09.1.454.CMB.1.raw
  modified_base (245)..(248): a, c, t, g, unknown or other
  misc_feature (245)..(248): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctggtcactctgttcccgccctcctcgagtagtacactgagcgggctggcaaggcgcatagnnnn

SEQ ID NO: 11520 - DNA, 656 bp, Homo sapiens
  misc_feature: GYAE6OF02JLHTV.16.86.H09.1.454.CMB.1.raw
  modified_base (205)..(205): a, c, t, g, unknown or other
  misc_feature (205)..(205): n is a, c, g, or t
  modified_base (359)..(359): a, c, t, g, unknown or other
  misc_feature (359)..(359): n is a, c, g, or t
  modified_base (379)..(379): a, c, t, g, unknown or other
  misc_feature (379)..(379): n is a, c, g, or t
tcagtgtactactccacgaccggtgctcgatttagtgctatagacttgggtttggggggggtcgtcgaggaggcagcgctctcaggacatctccaccatggcctgggctctgctgctcctcaccctcctccactcagggcacaggtgacgcctccagggaaggggcttcgagggacctgtgggctgatcttggtctctgctcctngctcgaccgggccagcactgactcactggcatgtgttctccctacttttccacgggtcctacgggccctaggtccttcgacccctgaacctcgacgtccctcgccctccgttgtcgtacggtctccgtaggactgtcgatcatctacgtcttcngcctacgttggacttccganacgtagtacggtacggtttggtaagtttaacttaattacgttcgtccgttccgttacggtaacctaaacgtaccgtacccaagggtaaccaaacccggtaccccaaactcgattacgtaatttctagacgtacgaagttaacgtcccgtaccgttggttaacggtttactaccgttacgtcgtttacctcgttacgtacctacgttaacggttcgacgtaccgaaccgtaccggtcccttcccggtaccaccgttacttaccggtctacccggtccg

SEQ ID NO: 11521 - DNA, 695 bp, Homo sapiens
  misc_feature: GYAE6OF02FI0AQ.16.86.H09.1.454.CMB.1.raw
  modified_base (223)..(223): a, c, t, g, unknown or other
  misc_feature (223)..(223): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctcgggccagtcgtcgcctgactcacgcctcgcctcgtgtcgtgggtctccgtggactagtcgatcatcacttctcncgccacgtggctccgagtcaggtgtacggtttggttaattataattatcgttctaccgttacgtaaccaacgtaccgtacccgaggaccaaaccgacccctaaatctattagtaatttagacggtaggtactagttaacgtccggtcctaggttacgggttactagtccgtcttcgtcgtacgtcctacgtacgtcgtacggaccaaccgtaccgtcctaccgctacctacttcgcggtacggtccctacggtacggtcgtacggggacggtaacgggtacgggttattaacgtttacgttacgcggacgtacggtactagtaacgttaaggtaacggtacgtcggtacgtcgacgttaccgtcgttacgttacggttacgggaccgggttaacggaacctacggttaccgtaccggttacccgtaggtaccggtaccacccggtaccggtacggtcccgtccctaccccgg

SEQ ID NO: 11522 - DNA, 760 bp, Homo sapiens
  misc_feature: GYAE6OF02HTMVE.16.86.H09.1.454.CMB.1.raw
  modified_base (758)..(758): a, c, t, g, unknown or other
  misc_feature (758)..(758): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctcctcactcagggcacagggtcctgggtcctccactggaacccagcgagtgacgttgggtggttacttaactttgtctcctgataccaacagccaccgagacaaagcaacccaaattcatagactttagtagaggtctaacgtaacgtccggcccttcgtaaggggttttctaatccgtacttctcgtcggtacctccgtaaagttccgtacggtaccaaaccgtacccggtccctcccgtacgaccctagttccctcgtacgggccctaccgaggcgtaggacggacggtaggtaccttaggtaagtttattacttacgtactacgtacttacaaattaacctaaaccgaaaaccaaccgtaacgtcctaaacccttccttaccggtaacggttaccgttagggttaccgggtaccgggggaaccggtaccgaaaccggtcgttaccggtacccgtccggttaacgtacggacccgacccggtaacgtacccggtaccccggtaccccgtaccgggtcctacccgttccgttacccgttccccgtacccgttaccgtaccgtacggttaccgtaacgtaccgtacgggacggtccggtacggtcgaaccgacggtacgtacgtactacggtnag

SEQ ID NO: 11523 - DNA, 646 bp, Homo sapiens
  misc_feature: GYAE6OF02G2V7I.16.86.H09.1.454.CMB.1.raw
  modified_base (302)..(302): a, c, t, g, unknown or other
  misc_feature (302)..(302): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttatattatgtctctgtacaacagtaccagacaaacgccccaaactcatgtatttangagtcagtaactcgcctcgtagggtttctaagtcgtcttctcgtcggctacaagttctacggaccaacgaccggtccctcccgtagacctatcctcgtcgggtcctccgaggtcctaggacgggtaacggtacgggtagtaacgttttaacttacgtcgtacgacgtccttacaagttacgtaaggtaacggttgaccgacgtccgtacgttaccgttaccgttacggtttccggggacgggttacgggtaacccgtaaacggtccgttaaccggtaccccggttacgttaacgggtacccgtaaccgggaccccgtaacgggtcccgtacccggtccccccgg

SEQ ID NO: 11524 - DNA, 881 bp, Homo sapiens
  misc_feature: GYAE6OF02GXGHF.16.86.H09.1.454.CMB.1.raw
  modified_base (168)..(168): a, c, t, g, unknown or other
  misc_feature (168)..(168): n is a, c, g, or t
  modified_base (207)..(207): a, c, t, g, unknown or other
  misc_feature (207)..(207): n is a, c, g, or t
  modified_base (240)..(240): a, c, t, g, unknown or other
  misc_feature (240)..(240): n is a, c, g, or t
tcagtgtactactccacgaccggtgctcgatttagtgctatagacttgggtttgggggggggtctcaggaggcagcgctctcgaggacatctccaccatggcctgggctctgctgctcctcaccctcctcactcagggcacgagggtcctgggtcctccatggaaccngcagtgacgttggtgttatactttgctctgactaccaangcaccaggcaaagcaaccaattcatgtatttangagtcataatccggcctacgagggtttacaactcgtacttcgtctcggtacttaccgtaaagttcgtacgggacctaaaccgaccggtccccttaccccgttacggaaccctaagttccgttaccggttacgggacccgttaccgaacgggtacttacgggaacgggtaaccggtaacgggtccttaaggttaaacgttttaagtttaacgtttaggaacctaacttaccgttaaccgtaaaacttaaaccttaaaacccggtaaaaaccccaaaggtaaccgtaacctaaacccgtttacccgtacggtaaacgtttacgggtttaacgttaccggggaacggggtaacgggtaacccaaagggttctaaccggtaacccgttaccgttaacgggtaccctaaaccgggtacccgtaaacggtaccccggtaccccggttaccccccggttacggtttaaccctaccgggttttaccccttaccggggttttaaccccccccaaaaccggtttacccggttaaccggttaacggttaaaccgtttaaacccgtaacgggttaaccgggaacgggggttcccggtaaccggttaccggggaacgtaaaccgggtccgtaacgtaacggttacggactaacg

SEQ ID NO: 11525 - DNA, 702 bp, Homo sapiens
  misc_feature: GYAE6OF02IRD5H.16.86.H09.1.454.CMB.1.raw
  modified_base (353)..(353): a, c, t, g, unknown or other
  misc_feature (353)..(353): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccaggggaaggggcttcgagggacctcgtgggctgatccttggtctcctgctcctcaggctccgacccggggcccagcactgactcactggcatgtgtttctcccttcttccgacggtccgtcgggcccagtctcgccctgacctcacgccctcgtccctccgtgtcgtcgggtcctcgtggctgtcgatcatctattcttncgcacgtggactccgagcgtaggtcgtacggtttaggttaagtttataagttttgtcgttcccgttccgttaacggtaacccaacgtaccgtaacccgagtaacccgaaacccgaccccctaaacctcgtaacgttacgttaacgtttagtacgggtaaggtaccgtaacgttaaccgtaccccgggttaccttacgggtttaaccggggttttaacttaaccggttccgttacctttccgtacgttcggttacccgtaccgttacggttcgtaaccggaccctaaccgtaccccggttccttaccccgtaacggtaccctacgtttcccgttcggtaccgggtacccg

SEQ ID NO: 11526 - DNA, 767 bp, Homo sapiens
  misc_feature: GYAE6OF02FWMTL.16.86.H09.1.454.CMB.1.raw
  modified_base (204)..(204): a, c, t, g, unknown or other
  misc_feature (204)..(204): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccagggaaggggcttcagggacctctgggctgatccttggtctcctgctcctnaggctcgaccgggcccagcactgactcacgtggcatgtgtttcctcccttctttccgaggggtcctcgggccctaggtcctcgccccttgaccttcgacgcctcgtcccgtccggttcgtcgttcggggtaccttcggtgggaacctacggtccgacttcctaaacttctactttccttctcgaccgtacgtggaccttccgaagtccgtaggtacggttaaccggttttagggttaagttttaaatttaatttacgtcgttacccgtttacgtaccggttaaacccaaacgtaaccggttaaacccgaacggtaacccaaaacccggaaccccccgtaaaaccttactagttaacgttaagttttacgtacgggtacgttacctaaacgtttaccggtacccgggtacccgttaccggtttaacggggttttactaaacgtttccgtacgtttccgttacccgttcgtcccgttacccgtaccggttcgtaaccggacctaaacccggtaccggcccgtttacccgacgtaaaccttacctcccgttacgtacccggtcccg

SEQ ID NO: 11527 - DNA, 636 bp, Homo sapiens
  misc_feature: GYAE6OF02I1CZB.16.86.H09.1.454.CMB.1.raw
  modified_base (114)..(114): a, c, t, g, unknown or other
  misc_feature (114)..(114): n is a, c, g, or t
  modified_base (265)..(265): a, c, t, g, unknown or other
  misc_feature (265)..(265): n is a, c, g, or t
  modified_base (475)..(475): a, c, t, g, unknown or other
  misc_feature (475)..(475): n is a, c, g, or t
  modified_base (485)..(485): a, c, t, g, unknown or other
  misc_feature (485)..(485): n is a, c, g, or t
  modified_base (563)..(563): a, c, t, g, unknown or other
  misc_feature (563)..(563): n is a, c, g, or t
  modified_base (632)..(632): a, c, t, g, unknown or other
  misc_feature (632)..(632): n is a, c, g, or t
  modified_base (635)..(636): a, c, t, g, unknown or other
  misc_feature (635)..(636): n is a, c, g, or t
tcagtgtactactccacgaccggtgctcgatttagtgctatagacttgggtttgggggggggtctcaggaggcagcgctctcaggacatctccaccatggcctgggctctgctnctctcaccctcctcactcagggcacagggcctgggtccctcgactggaaccagcagtgacgtttggtagttataactttgtcctcctagactaaccaacacgccacccgaggacaaacgacctaaccctaaattcaaattggaacttttanggtaacggttacaactttaaagcccggtcccttcggtaacggggtttttaccaacgttcgtccttcgttcgtcggtaccctaccgaacgtcgtacgggacctaaacgcccggtccctcctacgtacctacgtctcgtcgggacctcgagtcgagaggcgtaagtcgaattacttattatcgcctatactactaataactaacgaaccaanccgactaccntaacgacgttggtaactcgggagaacggctagcgtcgtacctgtaacgctacgaccaggtccctccgcccttcgtccncgttacctccgtaaccctccgtatacggacgttcaacgtgtacgcgggtagcgacgacgacgtcagtancgnn

SEQ ID NO: 11528 - DNA, 620 bp, Homo sapiens
  misc_feature: GYAE6OF02I4OJG.16.86.H09.1.454.CMB.1.raw
  modified_base (208)..(208): a, c, t, g, unknown or other
  misc_feature (208)..(208): n is a, c, g, or t
  modified_base (242)..(242): a, c, t, g, unknown or other
  misc_feature (242)..(242): n is a, c, g, or t
  modified_base (617)..(617): a, c, t, g, unknown or other
  misc_feature (617)..(617): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtgttataactttgtctcctgataccaangcaccaggcaaagccaaccaaattcatgatttangaggtcataatccggcctcgaggggtttctaatcgcttctctggctccaagtctggcaacacggcctcccgtgaccatcgtcgtcgggtctccgaggtctaggacggacggaggctgtaattacttattgactatctctataacaaccaaacctaacagccctaactctacgtacgtggttacgttcgggacgggtaacgggaacccgacgtcgtacgacccgttacgtacggtacccacggtacccgaacggtccgtacccggtcccccgtttacggtacctaccgttccgttacccgttccccgaccttccgtacgtacgttacgtacgacgtcggacggtcggaccgtggaccggaggtcccgataacgtgntcg

SEQ ID NO: 11529 - DNA, 525 bp, Homo sapiens
  misc_feature: GYAE6OF02GGD62.16.86.H09.1.454.CMB.1.raw
  modified_base (217)..(217): a, c, t, g, unknown or other
  misc_feature (217)..(217): n is a, c, g, or t
  modified_base (304)..(304): a, c, t, g, unknown or other
  misc_feature (304)..(304): n is a, c, g, or t
  modified_base (416)..(416): a, c, t, g, unknown or other
  misc_feature (416)..(416): n is a, c, g, or t
  modified_base (425)..(425): a, c, t, g, unknown or other
  misc_feature (425)..(425): n is a, c, g, or t
  modified_base (469)..(469): a, c, t, g, unknown or other
  misc_feature (469)..(469): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcactggatccagcagtgacgttgtagttataattatgtctcctggtaccaacagtacccaggacaaagcccccaaactcatgattngtagtcagtaatcggcctcgtagggtttctatcgacttctctggtcctccaagtctaggcaacacggccctccctgaccctatctcgtgggctccagctgacggcgagggtntattattangcagtctcatataagtagtggcaagctacgtctcgtattccggngttacgggaaccagtcctacgaccgtcctaggccagacccgtaggcctcgtccccc

SEQ ID NO: 11530 - DNA, 707 bp, Homo sapiens
  misc_feature: GYAE6OF02FNO04.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagtcgatcatcatcttctgcatggatccagcagtgacgttgtagttataattatgtctctggtaccaacagtaccaggcaaacgaccccaactcatcgtattatgagtcagtaatcggaccctcgtaggggtttactaagtcgtacttcgtctcggcctaccgaagttctagggacctaaacgacccgggtcccttccccgtacgtaacccgtacgttacctcgtcgggtacccttacccggtacgggtccgtacggtaacgggtaaaccggggtaggggttagtaacgtttacgtttaaccggtcgtaccgtaacggtcctaaccgttaagtaaacgttacggaaaggtcgggacgaacgtcctacgttccgttacgttacggtttccggggaccgggtacgggtaacccgaaacggttcccggttaacgtaccccgggtttcgttaacccgggttcgaacccgggtacccgaaccgggttcccgtccccggttaacccccccggg

SEQ ID NO: 11531 - DNA, 615 bp, Homo sapiens
  misc_feature: GYAE6OF02FZ4WC.16.86.H09.1.454.CMB.1.raw
  modified_base (203)..(203): a, c, t, g, unknown or other
  misc_feature (203)..(203): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgcctccagggaaggggcttcagggacctctgggctgatccttggtctcctgctctnaggctcaccggggcccagcacgtgactcactggcatgtgttctccctcttccgagggtcctgggccctagtctcgccctgactcacgcctgcctccgtgtcgtggtcctcctggacaggtcgtatcatcattccttcgtgccacgtggactccgagtcgaggttcgtacgtttgggtaactttaagttaatttagtcgtccttccgtacggtaaccaacgtacgtacccaggtaccaaaccgacccccaaacttacgtatacgttaacgtttagtagtacggtctaagttaacgtccggtaccctcggttaacgggtttactaacgtccgtcgttctccgtgtcctaccgagttcgtagtacgtaaccgtaccgtaccctccgtacgtacctactccgtaccgtcggtaccg

SEQ ID NO: 11532 - DNA, 672 bp, Homo sapiens
  misc_feature: GYAE6OF02GDB0Z.16.86.H09.1.454.CMB.1.raw
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggtcctccactggaaccagcagtgacgttggtggttataactttgtctctgataccaacagcaccaggcaaagccaacccaaattcatgatttatgaggtcaactaatccggccctcgtacggggtttactaagtcgtctttctctggcctaccaagtctggacaacgaccggtccctccgtacgacctactccgtcgtcgggtcctaccgacgggtctaggacgggacggacggtctagtatttattagtttgctagtctactaataactaaaccaacctaacacgtacctactctacgacgttggttacgttcgggacgggacgggaaccgagccgtacgacccgtacgtacggtacgacgaccgtaacggccgtacccggtcccccgttacggtaccctaccttccgttcccgttaccccctacccgttccgtaccggtacgttaccgtaacgtaccgtacggtaccgggtacccgggtacggtacggtaccggaacgggtccgactaacggtgtagcg

SEQ ID NO: 11533 - DNA, 730 bp, Homo sapiens
  misc_feature: GYAE6OF02I59G3.16.86.H09.1.454.CMB.1.raw
  modified_base (204)..(204): a, c, t, g, unknown or other
  misc_feature (204)..(204): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacgtagggtcctgggcccagtctgccctgactcagtcctgcctccgtgtcgtcggtctcctggacncgtcgatcatctacttcttactcgcctacgtaggactccgagtcaacggttgtacggttggttaacttaagttaattactcgttctccgtacgtacccaactacgtaccgagtaccaaaccgtaccccaactgactgtagttacgtagcggtatacggtactccggtaccgtacggtaggtttactaacgttccgtacttcgtccgttaccggaccgtttaccgtaagttaccgtacgggtaccaacccggtaccggttcccctaccgtactaccgtaccttaccgtccgtcggtccgtaccggtagtacgtagggaaccggtaacggtaacgttagttaacgttacgttacgacggtaacctccgtcctaataggtaactaggtaacgtcggtacaccgtaaccgttaccctaggtacgttcgggtacgggtacggtaaccggtcgtaaccggtccggttaaggtcccgttaccggtacgtacccgttaaccggtccggaccgggttcccggtaccctccccggg

SEQ ID NO: 11534 - DNA, 612 bp, Homo sapiens
  misc_feature: GYAE6OF02HLHHI.16.86.H09.1.454.CMB.1.raw
  modified_base (255)..(255): a, c, t, g, unknown or other
  misc_feature (255)..(255): n is a, c, g, or t
  modified_base (266)..(266): a, c, t, g, unknown or other
  misc_feature (266)..(266): n is a, c, g, or t
  modified_base (271)..(271): a, c, t, g, unknown or other
  misc_feature (271)..(271): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
  modified_base (343)..(343): a, c, t, g, unknown or other
  misc_feature (343)..(343): n is a, c, g, or t
  modified_base (354)..(354): a, c, t, g, unknown or other
  misc_feature (354)..(354): n is a, c, g, or t
  modified_base (409)..(409): a, c, t, g, unknown or other
  misc_feature (409)..(409): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacaggtgacgccctccgaaggggaacggggtcttcgaggggacccttcgtgggctgacttccttggtctcctgcctccgtacaggtcctccgacccgggcccagcactgactcacgngcatgtcttcnccttnttccgacgggtcncgggccagtctcgcctagacctgacgtccngcccttcgtgcgtcggtccttccgagacnggttcatccanctagttcttcagcctagtcgactccagcaggttgtacgttggtattaatatttancgttcctcgtacgtaaccaagtaaccgtaccgaacgtaacgaaaccctaccccgaaactctaagtcttaagttagtacgtagtactaagaaccgttccggccgtacggttacggttactaacgtcgtcttcctgtccgtactacccgtagtcgttacgaccgaaccgtaccggcccttccacgccttatccgttcgcggtccc

SEQ ID NO: 11535 - DNA, 571 bp, Homo sapiens
  misc_feature: GYAE6OF02FW1EN.16.86.H09.1.454.CMB.1.raw
  modified_base (470)..(470): a, c, t, g, unknown or other
  misc_feature (470)..(470): n is a, c, g, or t
  modified_base (485)..(485): a, c, t, g, unknown or other
  misc_feature (485)..(485): n is a, c, g, or t
  modified_base (569)..(569): a, c, t, g, unknown or other
  misc_feature (569)..(569): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagccacccaggcaaagcacccaaattcatgtattatgaggtcactaagtccgccctcgaggggtttctaatcgcttctctggctcaagtctggcaacgaccggcctccctcgaccatctcgtgggtcctccgaggctgaggtacgaggtctagtattagttattggactatctctatactacaaaccaacagtacactctacgactggttattcggacgggaggaccaagccgtagacccgtcgtaggtcaacgccacgcncgtccccgtcgtccnctccgttccgttcccgtcccgtccgtcgtacgtacgtaccgtactgacgggtccggtcgtcggacgacggccgtacacgtgtancg

SEQ ID NO: 11536 - DNA, 691 bp, Homo sapiens
  misc_feature: GYAE6OF02HKEV6.16.86.H09.1.454.CMB.1.raw
  modified_base (217)..(217): a, c, t, g, unknown or other
  misc_feature (217)..(217): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttcngcacgtggatccgagcagtgtacgttgtagttataattatgtctctcgtacaacacgtaccagacaacgaccccaactcatgatttatgtacgtactagtatcgccgtacgtagggttactaatcgtcttctctgtctacgtagtctacgacaaccgtaccgccctccgtacgtaccctactccgttacggtccgggttcctaccgtacgggtacgttacgggaacggggttaacgggacggggtttacgttacgttttaacgttaccgttacgacgtacggtaccttacgtaagttaaccgtaaggttaacgggtacggtacgaacgttccgtaacccttacgttaccgggttaaccggttcgggtacccgggtagggtaacccggtaaccgtccggtccggttaacccgtaccggtttaccgtaaccggtaccggacccggtaccggtcccgtaccccgggttaccccccgg

SEQ ID NO: 11537 - DNA, 661 bp, Homo sapiens
  misc_feature: GYAE6OF02JTT79.16.86.H09.1.454.CMB.1.raw
  modified_base (218)..(218): a, c, t, g, unknown or other
  misc_feature (218)..(218): n is a, c, g, or t
  modified_base (232)..(232): a, c, t, g, unknown or other
  misc_feature (232)..(232): n is a, c, g, or t
tcagtgtactactccacgaccggtgctcgatttagtgctatagacttgggtttgggggggggtctcgaggaggcagcgctctcaggacatctccaccatggcctgggctctgctgctcctcaccctctcactcagggcacagggtcctgggcccagtctgccctgactcagcctgcctcgtgtctgggtctcctggacagtcgatcatcattcgttcngacacgtgactccngactagtgacggtttggtattataattatcgtctacctggtaccaactacgtacccgagtacaaccgtaccccaaactcatcgtatttaagcgtaggtactaagtaactccggcctaggtacgggttataactcgtcttactgtcgcctacgaagtctaggaccaacgtaccggcccgttcacgtacctactcgtacgtacggcctcgagtccgtaggaggtaccggtagggtacgttaactttagttaacgtgtaacctcgtaccgtactaagttaacgtaaggtaaccgtggggaacctacgtccgtaacgttaccgtacgttaccgggttacgtacgggtaccggaaccgttaggtaccgttcggtaaacccggttcgtaccggttaccaccgggtaccctaacggtcccgtcccggttaccccgg

SEQ ID NO: 11538 - DNA, 252 bp, Homo sapiens
  misc_feature: GYAE6OF02G30YQ.16.86.H09.1.454.CMB.1.raw
  modified_base (246)..(252): a, c, t, g, unknown or other
  misc_feature (246)..(252): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctcggtcactctcgttcccaccctcctcgagtagtacatgagcgggctggcaaggcgcatagnnnnnnn

SEQ ID NO: 11539 - DNA, 741 bp, Homo sapiens
  misc_feature: GYAE6OF02GGQDM.16.86.H09.1.454.CMB.1.raw
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctctggtaccacagtaccaggacaaacgccccaaactcactgtatttatgaggtcgagtaacgtcgtcctcgtaggggtttactaagtcgcttctctggctacgaagtctacgggtaccaacgtacccggtcccttaccccgtacgtaaccctagttcccttaccggtcggggtaccctacccggtacgggccgttacgggaacgggtaaccgggtacgggggtagttaaacgttttaacgttaaccggtcgtaccgacggtacctacgtaaacgttaagtaacggtaaacgggttcgggacgtaaacggtcctaacccgtttaccgttaacccgggtttacggtttacccgggggtacggggtaccggggtaaacccgtaacgggttacccgttaacggtaccccgggttaccgtaaccggggttacccgtaaacgggtacccccgtaaacgggttcccgtaccccgggttacccccccggg

SEQ ID NO: 11540 - DNA, 775 bp, Homo sapiens
  misc_feature: GYAE6OF02I92DB.16.86.H09.1.454.CMB.1.raw
  modified_base (600)..(600): a, c, t, g, unknown or other
  misc_feature (600)..(600): n is a, c, g, or t
  modified_base (623)..(623): a, c, t, g, unknown or other
  misc_feature (623)..(623): n is a, c, g, or t
  modified_base (710)..(710): a, c, t, g, unknown or other
  misc_feature (710)..(710): n is a, c, g, or t
tcagtgtactactccacgaccggtgctcgatttagtgctatagacttggggtttggggggggggtctcaggaggcagcgctctcaggacatctccaccatggcctgggctctgctgctcctcaccctcctcactcagggcacgacgggtcctcgggcccagtcctcgccctgactcgagcctcgcctccgtgtcgtgggtctccgtgacagtcgatcatctatcttctgactacgtgactcgagcgtagtcgtcggttaggtaagttattaattatgtccgttccgtaggtaaccaactacggtaaccacggaccaaacccgtaacccccaaatctaattacgttaacgttttagacggtaacggttacgtaaacggttaaccgcccggttccccttacggggttaacgggttttacctaaacgtcggttacctttacgttccggtaccggtacctttacccgtaaaagggttccgtaccggtaaacccgtaaacctaccccgggtccccttacccgtaccgtaccgtaacgttccgttaccggcggttaccctcggacggtacgtagggaccggtacggtacgggttattaaccgtttnttaacgcgtagtacgtccttaanacgttaacgtaacggaagtccgtaccacgtacctacgttcccgggttacgttacgggtaccgggttacgggaccggtaacgtaaccncggttaaccgtcccgttacggttacggccctaggtaccccgaacggttccctcccggtaccccgg

SEQ ID NO: 11541 - DNA, 253 bp, Homo sapiens
  misc_feature: GYAE6OF02JD1DE.16.86.H09.1.454.CMB.1.raw
  modified_base (242)..(242): a, c, t, g, unknown or other
  misc_feature (242)..(242): n is a, c, g, or t
  modified_base (248)..(253): a, c, t, g, unknown or other
  misc_feature (248)..(253): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctcgccccctcggtcactctgttccccaccctcctcgagtagtacactgagcgggctggcaaggcncatagnnnnnn

SEQ ID NO: 11542 - DNA, 725 bp, Homo sapiens
  misc_feature: GYAE6OF02J1URX.16.86.H09.1.454.CMB.1.raw
  modified_base (299)..(299): a, c, t, g, unknown or other
  misc_feature (299)..(299): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcgagggcacacgggtcctgggcccagtctgccctgactcagcctgccgtccgtgtcgtgggtctccgtggacacgtcgatcatcatcttcagcacgtgactccagcagtgacgttggtattatatatgtctctacgtacacacgtaccaggacaaaccgacccaacncgtactatattagtggtacgtctaacggtacgtccggtccgtacggttagggtttactaagtccgtcttctcgtcggtacctacgtaacgtcgtcgactaaccgccgtcctaccacgtacctactcgtaccgtcggacctccgtacggtcgtaggtaacgggacgtaggggtagttaacgtttacgttacgtcgagtaccgtccgttaacgttaacttaagggtacgttaaacggtcgggaccgttaaacggtcctaccggttaccctttaccggttcggttaccccggggggttaccggttaacggggtaccttaaccggggccttttaacccgggggtaccgttaacccgggtttacccgggttacaaaccccggggttaacccccggtaccgggttacccccggttcccccggtaccccccgg

SEQ ID NO: 11543 - DNA, 652 bp, Homo sapiens
  misc_feature: GYAE6OF02FGINH.16.86.H09.1.454.CMB.1.raw
  modified_base (210)..(210): a, c, t, g, unknown or other
  misc_feature (210)..(210): n is a, c, g, or t
  modified_base (244)..(244): a, c, t, g, unknown or other
  misc_feature (244)..(244): n is a, c, g, or t
  modified_base (255)..(255): a, c, t, g, unknown or other
  misc_feature (255)..(255): n is a, c, g, or t
  modified_base (297)..(297): a, c, t, g, unknown or other
  misc_feature (297)..(297): n is a, c, g, or t
  modified_base (366)..(366): a, c, t, g, unknown or other
  misc_feature (366)..(366): n is a, c, g, or t
  modified_base (644)..(644): a, c, t, g, unknown or other
  misc_feature (644)..(644): n is a, c, g, or t
  modified_base (652)..(652): a, c, t, g, unknown or other
  misc_feature (652)..(652): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggtcctccactggaacctgcagtgacgttggtgttataacgtttgtctctgactaccaangcaccgagacaacgcaaccaattcatgtatttangagtcaactanccgcctgtaggtttcaactcgctttctcgtggacctcagtcnggcaacaccggtcctcctgacctatcctcgtcgggcctaccgaggcgtaggacggtacggtcgacttanaagtttacttagtgactacgtcctaactacgttaactaaacccaaacccaacgacgtaacctacgtaccgttaccgaccggtttacgggttacggttaccggggacgggttaaccgggacgaacgtaccgttaccgaccgtttacgtacggacccgacggtaaccgtacggtcccgtaccgtccccggttacgtcctaccgttccctacccggtcccctacccgttaccgtaccgtagttacgacgtaacgcggacgtcggtacgacggtcggacgcnacgtgctn

SEQ ID NO: 11544 - DNA, 728 bp, Homo sapiens
  misc_feature: GYAE6OF02HRLTG.16.86.H09.1.454.CMB.1.raw
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctcgtgtcgtgggtctccgtggacagtcgatcatcatcttctgcacgtggactccagcgagtgacgttgtagttaataattatgtctcctcggtaccaacgacgtccaggaccaaccgacccccaaatcatgtaactttagtgacgtctaacgtaacgtccggcccttacggttacggggtttactaacgttccggttcttccgttcgtcggtaccttacgtaacgtcggtacgaacctaaacccgaccggttacccctcccgtaacggtaccctagttacccggttcggttaccgggtccctaccgggacggtccggtacgggacggggtaaacccgggtagggttaagttaacgttttaacgtaccgttacggccgtaccgtaccttacgtaacttaacggtaacggtaacggttcggactacccggtaacctaccttcgttaccgggttacgttacggggtcgggttaaccggactaacggtcctacggttaccccggttcgtaccggtaccgacgtaacccggacggttcccgtcccgtaacccccgg

SEQ ID NO: 11545 - DNA, 260 bp, Homo sapiens
  misc_feature: GYAE6OF02F323K.16.86.H09.1.454.CMB.1.raw
  modified_base (245)..(260): a, c, t, g, unknown or other
  misc_feature (245)..(260): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctggtcactctgttcccaccctcctcgagtagtacactgagcgggctggcaaggcgcatagnnnnnnnnnnnnnnnn

SEQ ID NO: 11546 - DNA, 638 bp, Homo sapiens
  misc_feature: GYAE6OF02I6OC3.16.86.H09.1.454.CMB.1.raw
tcagtgtactactccacgaccggtgctcgatttagtgctatagacttgggtttggggggggggtctcaggaggcagcgctctcaggacatctccaccatggcctgggctctgctgctcctcaccctcctcactcagggcacgagggtcctgggcccagtctgccctgactcagcctgcctcgtgtctgggtctccgtggacagtcgatcatcattcttctgctacgtggactccagctagtgacggttggtagttataattatgtctctcggaccaacacgtaccgagacaaacgaccccaaactcatagtatttactggtacgtacgaagtaacgtccggccctcggtaggggtttacttaatccggtacttccgtcgtcggtccttaccgtaacgtcgtacggaccaaccgaccggtcccctcccgtacgaccctactctacgtcggcctcgaggctaggaacgggacggtagggttattaagtttacgttactgtaccgagtccttacgtagtaagtaggtaacgtgacgtacgacctactcgttacgttcggtcgggtacggtacgggaccgtaagccgttcggtaacccgtccgttacggtcctaccgacccggtacggcctaccggtccccg

SEQ ID NO: 11547 - DNA, 615 bp, Homo sapiens
  misc_feature: GYAE6OF02FXWL3.16.86.H09.1.454.CMB.1.raw
  modified_base (206)..(206): a, c, t, g, unknown or other
  misc_feature (206)..(206): n is a, c, g, or t
  modified_base (275)..(275): a, c, t, g, unknown or other
  misc_feature (275)..(275): n is a, c, g, or t
  modified_base (369)..(369): a, c, t, g, unknown or other
  misc_feature (369)..(369): n is a, c, g, or t
  modified_base (519)..(519): a, c, t, g, unknown or other
  misc_feature (519)..(519): n is a, c, g, or t
  modified_base (545)..(545): a, c, t, g, unknown or other
  misc_feature (545)..(545): n is a, c, g, or t
tcagtgtactactccacgaccggtgctcgatttagtgctatagacttggggtttggggggggggtctcaggaggcagcgctctcaggacatctccaccatggcctgggctctgctgctcctcaccctcctcactcagggcacaggtgacgcctccaggggaaggggcttcgagggacctctgggctgatccttggtctctgctctnaggctcaccggggcccagccactgactcacgtggcatgtcgtttcctcccttctttccgagggttcccngggccctagtcgtcgcccctgacctcgacgcctcgcccttccggtgttccgtcgggtcctcgtggactagtcgactcatctattcttcgtgccngtggactccgagcgaaggttcgtaacggtttggttaaacgtttaattaagtttattcgttccgttcgtacggtaaccctaacgtaacgtaaccgtaacggaacaaacccgaccccaaactactactatatttagagtcggtactagtacncgtccgtcgttagggttactatcctnttctcgtgtactacgaacgtcgtacgacgaaccgaccgtccctaccgcgacctagtccgttcgtggtccc

SEQ ID NO: 11548 - DNA, 876 bp, Homo sapiens
  misc_feature: GYAE6OF02HICE0.16.86.H09.1.454.CMB.1.raw
  modified_base (412)..(412): a, c, t, g, unknown or other
  misc_feature (412)..(412): n is a, c, g, or t
  modified_base (432)..(432): a, c, t, g, unknown or other
  misc_feature (432)..(432): n is a, c, g, or t
tcagtgtactactccacgaccggtgctcgatttagtgctatagacttggggtttggggggggggtctcaggaggcagcgctctcaggacatctccaccagtggcctgggctctgctgcctcctccaccctcctcactcgagggccacgaggggttccgtgggtccctccacgtacggaaccagtcaggtgtacggttggtagttatacgtttcgtcctcctagactaccaacacgcctacccgaggactaaaacgcctaaaccctaaattcgtaagtacgtattttacgtgtacgggttacctacttaacggtcccggtcccgttacggttacggggtttactaacgtcgtaccttctacgtcgtcctaccgtaggtctacggaccaccgaccggtccctccgtacgacctnttccgtcgtcggccttacgnggtacgtacggacgacggcggtactagtaatttacttatacgcttaacgtccttacgtaactaaaccttaaccgaacccgtaacgtgtaacccttacccggttacgtaacccggtttacggttaacgggtttaccgtaacccgggggaacgggggttaaacccggaaccggttaaccggtccggttaacccggttacccggtttacggaacggttaccgaccccggtaaaccggttcccggaccgtttcccccgggtacccccgttttacgtacccggttaaccgtttcccggttaacccccgttacccgttacccccggtaccgggttacgttaaaccgtttccgggtaaacccgtacgggtacccgggtaccggggtcccggggaccggttttaaccgggaacgggttacccgggaacccgtaggtttacgggacctagcgg

SEQ ID NO: 11549 - DNA, 742 bp, Homo sapiens
  misc_feature: GYAE6OF02IPF7F.16.86.H09.1.454.CMB.1.raw
  modified_base (626)..(626): a, c, t, g, unknown or other
  misc_feature (626)..(626): n is a, c, g, or t
tcagtgtactactccacgaccggtgctcgatttagtgctatagacttgggtttgggggggggtctcaggaggcagcgctctcgaggacatcctccaccagtggccgtgggctctgctgctcctccaccctctcactcgagggcacgtacgggtcctcgggcccagtctcgccctgactcgagcctgcctcgtgtcgtgggtctccgtggactagtcgatcatctatcttcgtcgctactaggctaccgagcgtaaggttcgtacggtttaggttaagtttaagttaaagttattcgttccgttcccgttacggtaacctaaacgtaccgttaacccgacggaacccgaaaaccggacccccctaaaacttcaacgttacgttaattttaagtacggtacggtacgtaaacggttaaacgtcccggtcccgttaggtacggggttttactaacgtaccggtctttccgtcgtcgtacctacgtaagtctcggaactaacgccgtccctccgtcgactactcgtcgtcgtccgtcgtagtcgtcggaagggtcggaggtgtacgtttacgtacgttcgacgtacgctactaagttaacgtaggtaacgtggtacgacgtaccgttacnccggtttacgtcgggttacgggaccgggtacggaacgtaccggtccgtaccggtacccggttacggtaccggtccgaccggtaacccggtaccggttcccgtccccgttaccccgg

SEQ ID NO: 11550 - DNA, 578 bp, Homo sapiens
  misc_feature: GYAE6OF02FHOU8.16.86.H09.1.454.CMB.1.raw
  modified_base (322)..(322): a, c, t, g, unknown or other
  misc_feature (322)..(322): n is a, c, g, or t
  modified_base (334)..(334): a, c, t, g, unknown or other
  misc_feature (334)..(334): n is a, c, g, or t
  modified_base (338)..(338): a, c, t, g, unknown or other
  misc_feature (338)..(338): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacaggtgacgcctccagggaagggcttcgagggacctctgggctgatccttggtctcctgcctcctcaggctcgaccggggcccagcactgacctcacgtggcagttgtcgttttcctccccttctttccgaggggttcctggggcccctagtcctcgcccctgacctcagccctgcctcgtntcgttggctcgngacngtcatcatcatcttctcgactactggactccagcgtagtcgtacggtttggttaattataacttgtcgtactcgtacgtaccaacgtacgtaccagaccaaaccgaccccaactcatgtattagtgtacgtcttaagaacgtccggtcctacggttacgggtttactacgtctcgttctcgtcgtctaccaggtctcgaccgtaaccgtccgcctccgtcgacctctcgtcgtcggtccg

SEQ ID NO: 11551 - DNA, 654 bp, Homo sapiens
  misc_feature: GYAE6OF02HMTNT.16.86.H09.1.454.CMB.1.raw
  modified_base (171)..(171): a, c, t, g, unknown or other
  misc_feature (171)..(171): n is a, c, g, or t
  modified_base (219)..(219): a, c, t, g, unknown or other
  misc_feature (219)..(219): n is a, c, g, or t
  modified_base (261)..(261): a, c, t, g, unknown or other
  misc_feature (261)..(261): n is a, c, g, or t
  modified_base (329)..(329): a, c, t, g, unknown or other
  misc_feature (329)..(329): n is a, c, g, or t
tcagtgtactactccacgaccggtgctcgatttagtgctatagacttgggtttggggggggggtctcaggaggcagcgctctcgaggacatctccacatggcctgggactctgctgctcctcaccctctcactcagggcacgagggtcctgggcccagtctgccctgactnagcctgcctcgtgtctgggtctcgtaggacagcgatcatcattctcgngcatggactcgagtccagtcgtacgtttagtagtaatatatntactcgtcgtaaccaacgtacgtaccacggtaccaaacgacccccaattcatagtatttagagagtanaacggttaacgccggtacctgttagggttctaatcgtattcctgtacgctacgtaacgtcgtacgacacgaccggtcctcctagaccctacgtctaccggtcggtaccgtccgaggtacgtacggtagggtaacgggtacgggtggtttaaacttacggttacttagacggtacaccgttacgtaagttaaccgtaaggtacggttacggacgttaggtacctacgttacgtaccgttaagtcgggtacgggacggtaaaccggtcgtctaacgtacccggtagtaccggactaccggaccggtaacgtccgacccgttccccgg

SEQ ID NO: 11552 - DNA, 820 bp, Homo sapiens
  misc_feature: GYAE6OF02IG9EY.16.86.H09.1.454.CMB.1.raw
  modified_base (82)..(82): a, c, t, g, unknown or other
  misc_feature (82)..(82): n is a, c, g, or t
tcagtgtactactccacgaccggtgctcgatttagtgctatagacttgggtttggggggggggtctcaggaggcagcgctcncaggacatctccaccatggcctgggctctgctgctcctcaccctcctcactcagggcaacgtggtcgaccgtcctcgaagggggaacgggtccttcgacggggtaccttcgtggggtactggtacttccgtttgggtcctaccgttcggtccttccgtacgaccgggttcctacccggaccgggggtaccctcggactacgttcggaccttcccggaagtccggtctatttcggttaccgtttccctcccggtttctttaccggacgggggttccctacggggcccgtcgtaccgttcggcccctagtccctacgacggtcccttacgggttcctccggttcggttccggttaggtcccctaccggttacggaacttaccgggtcgtaactcaacgtccgtattccgtcgtacgtaccggtagtaccgttaccgtacaacggtcggttaacgtcgggttacgggttttacgtaaattttaaaccgggttaactttcccgtagttccgttacccggttaacggttaaacctaccggtaccgtaacccgttaacgggaacctaaacccggaacccgttaacctacgtttaactacgttacttaggttactacggtaacggtacttaccgtccggttaccgtacgtacggtttacgtacgttacctcgttacgtcgttacgtctacgtcgtactcgacgtacctaccgacttccgacgtcctacgtactccggtacgtacg

SEQ ID NO: 11553 - DNA, 747 bp, Homo sapiens
  misc_feature: GYAE6OF02JL9W4.16.86.H09.1.454.CMB.1.raw
  modified_base (151)..(151): a, c, t, g, unknown or other
  misc_feature (151)..(151): n is a, c, g, or t
  modified_base (211)..(211): a, c, t, g, unknown or other
  misc_feature (211)..(211): n is a, c, g, or t
  modified_base (233)..(233): a, c, t, g, unknown or other
  misc_feature (233)..(233): n is a, c, g, or t
  modified_base (249)..(249): a, c, t, g, unknown or other
  misc_feature (249)..(249): n is a, c, g, or t
  modified_base (349)..(349): a, c, t, g, unknown or other
  misc_feature (349)..(349): n is a, c, g, or t
  modified_base (441)..(441): a, c, t, g, unknown or other
  misc_feature (441)..(441): n is a, c, g, or t
  modified_base (584)..(584): a, c, t, g, unknown or other
  misc_feature (584)..(584): n is a, c, g, or t
tcagtgtactactccacgaccggtgctcgatttagtgctatagacttggggtttggggggggggtctcgagggaggcagcgctctcgaggacatcctccaccatcggcctgggctctgctcgcctcctcaccctctcactcgagggcacgngggtcctcgggccctgtcctcgaccctgactcagcctcgcctcgtgtcgtggtcctacgnggacaggtcatccatcattctnacgcagtacgctaccngtacgtaggtgttacgttaggttaagttattaattcgtcgtcttaccgtacggtaccaacgtacgtaaccgtacggaacaacccgtaaccctataccgtnttaacgtattagcggtacgtactaacgtaccgtccggtccgtacggtttacggtacttacgtcgttcttaccgtcgtcgtacgtaccgtacncggtacgacctaaaccggtccggtaccctccgtaaaccgtcccgttacgtttacccggtacgttccggtacccggtaccggttacggtacgggttacgggtaaggtaccgggttacggtaagttaccgtttaacgtcggtacncgtactaccggagtaccgtaaaggtcggtaaacgtcgaacgttccgacgttacccgtaggttaccgttcgggtaggacccggtagtaacggtaagtccggttcgaaccggtttaccgagtacccgggtccgaccggttaccggttcccgacccgtttacccgg

SEQ ID NO: 11554 - DNA, 890 bp, Homo sapiens
  misc_feature: GYAE6OF02H7TS5.16.86.H09.1.454.CMB.1.raw
  modified_base (168)..(168): a, c, t, g, unknown or other
  misc_feature (168)..(168): n is a, c, g, or t
  modified_base (208)..(208): a, c, t, g, unknown or other
  misc_feature (208)..(208): n is a, c, g, or t
  modified_base (246)..(246): a, c, t, g, unknown or other
  misc_feature (246)..(246): n is a, c, g, or t
tcagtgtactactccacgaccggtgctcgatttagtgctatagacttgggtttggggggggggtctcaggaggcagcgctctcaggacatctccaccatggcctgggctctgctgctctcaccctcctcactcagggcacgagggtcctgggtcctccactggaaccngcagtgacgttggtgttatactttgtctctgactaccaanagccaccaggacaaagccaccaaattcatgtatttacngacgtcactaacgtcggtccctacgtacgggtttctaacgtccgtctttcgtcgtcgtctacccgtaagttcgtacggacctaaccgtacccggtcccttacccgaccgtaacctacttccgttccggtacgggtccctaccggtacgggcgttagggaacggtaccgggacggttaccgttaaggttacttttacggtttaaacttcgggtaccttaacttacccgtttacgtaaactttacgttaaacccccaaaacgtaaccgtaccggtaaccttacccgttacccggttacggttaaacccgtttcggggtttaaccgggttccgggggaaccggggtaacccggggtaaaccgtaaaccggtacccgggtttaccggtaaaccccgggttcggttaaaccgggttaaccgaaccccgggtacccgggtaacccgttaacccgggttcccccgttccccccgggtaaccgggttaccccgttacccgttaccccgtttacccccggtacccccgttaaaccccggttcccgttaacgggtacctttacccggtaaccgtaaccgggtaccgggttaacggtcccggggttaccgaaccgggttccggaaacgggtttcccgacggttaacgtgaccctg

SEQ ID NO: 11555 - DNA, 688 bp, Homo sapiens
  misc_feature: GYAE6OF02GI6QH.16.86.H09.1.454.CMB.1.raw
  modified_base (208)..(208): a, c, t, g, unknown or other
  misc_feature (208)..(208): n is a, c, g, or t
  modified_base (238)..(238): a, c, t, g, unknown or other
  misc_feature (238)..(238): n is a, c, g, or t
  modified_base (276)..(276): a, c, t, g, unknown or other
  misc_feature (276)..(276): n is a, c, g, or t
  modified_base (685)..(685): a, c, t, g, unknown or other
  misc_feature (685)..(685): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctctcatcagggcacagggtcctgggtctccactggaacccagcagtgacgtttggtaggttaatactttgtctctgataccaangcaccaggcaaagcaccaattcatgattangagtcatagccgcctgtacgggtttctatcgtctttcncgtcgacttcgaagtcctaggaccaaccgtacggtccctccgtacgtaccactccgtcgtcggaccttaccgaggtccgtaggaggacggaggtcaggttatttacttagtttcgactacgttacttacaaacttacgtaaacccaaccgtaaaacgccgtactacccgttaccggttacgtaccggtttaacgggtacggtttaccggggaccggggaacgggtaaccccgaaggtcccgttaacggtacccgtacggttacgaccgtaccgaaccgtacgggtcctaccccgggtcccgtccggtcctaccgttccttaccgtaccccgtcccttaccgaccgtacggccgtaacgtccggtaggacccgggtggtaccggtagacggtacggcacgtaacggtacngta

SEQ ID NO: 11556 - DNA, 678 bp, Homo sapiens
  misc_feature: GYAE6OF02F5N2R.16.86.H09.1.454.CMB.1.raw
  modified_base (222)..(222): a, c, t, g, unknown or other
  misc_feature (222)..(222): n is a, c, g, or t
  modified_base (322)..(322): a, c, t, g, unknown or other
  misc_feature (322)..(322): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcgagggcacagggtcctgggcccagtctgccctgactcagcctgcctcgtgtctgggtcctccgtggacagtcgatcatcacttcttcngctacgtggactccagcagttgtacggtttggtagttataattatcgttctccgtagtaccaactacgtaccaggacaaccgaccccaatcatatattangtagtacagtaacgtccggccttcggtacgggttctaacgtccgtacgttcctcgtcgtacctacgtaacgtcgtaggacacgacccggtcctccctagacctatccgtcgtacgggctaccgagggtactcgggaagggtacggtaggggttattaacgtttacgttacgttgacctaggtactacgtaacggtatacggtaagcggtacgacgtccgttaaacccgttgttaccggttacggtaccgggggtccggtaacgggtaacccgaaggttacccgtaaccggttacccggttaccgtaccggttaccgaaccgttaccccggacgttacccgtaccccggtcccccgg

SEQ ID NO: 11557 - DNA, 773 bp, Homo sapiens
  misc_feature: GYAE6OF02FI7RW.16.86.H09.1.454.CMB.1.raw
  modified_base (221)..(221): a, c, t, g, unknown or other
  misc_feature (221)..(221): n is a, c, g, or t
  modified_base (266)..(266): a, c, t, g, unknown or other
  misc_feature (266)..(266): n is a, c, g, or t
  modified_base (332)..(332): a, c, t, g, unknown or other
  misc_feature (332)..(332): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggcccagtctgccctgactcagcctgcctccgtgtctgggtctccgtggacagttcgatcagtcatcttcngccacgtgatcaggcaggtgacgttggtagttataattatcgtcnccgttgtaccgaacacgttaacccaggccaaacgtccccccaaaacttcattcggtaattttacgnggtacggtactaggttaaatcccggccccttacggaagggttttcctaaatcccggtctttccgtacgttcgggctttaccccgaaagggttcctacggggtaccaaacctacccggggtaccctttacccccgtaggtaaaccctagttacccgtaccggtttacgggggccctttacccgtagggtacgttaccgggacggggtaaccggtaaggggttacttaacgtttaaccgtttacggttaccggtaccgtagttacccgtacgtaacgttaacgtacggttaaacggttacgggtctaacggcctaaaccgtttcgttaaccgttacggtttcgggaccggttacgggaacctaacgggtaccttacgggtaccctttaccggacggtttccgaaccggttacccggaacggttcgttacccgtaccccccggg

SEQ ID NO: 11558 - DNA, 920 bp, Homo sapiens
  misc_feature: GYAE6OF02F67GU.16.86.H09.1.454.CMB.1.raw
  modified_base (163)..(163): a, c, t, g, unknown or other
  misc_feature (163)..(163): n is a, c, g, or t
  modified_base (270)..(270): a, c, t, g, unknown or other
  misc_feature (270)..(270): n is a, c, g, or t
tcagtgtactactccacgaccggtgctcgatttagtgctatagacttgggtttgggggggggtctcaggaggcagcgctctcaggacatctccaccatggcctggctctgctgctcctcaccctctcactcaggcacagggtcctgggtcctcactggaaccngcagtgacgttggtgttataacgtttgtcctcctgactaccaactagaccacccagggaccaaaacggccaaaccccgtaaaatttccaagttagtaactttttagnggtaaggttacctaactaacgttccgggtacccccttacgtaacgggggttttccttaaaacgttccggtaccttttccgtaaccgttcggggacccttttacccgaaacggtttccgttacgggaccgtaaaaccggtacccgggtacccccgtttacccccgtacggtaaaccccctaattccccggtttaaccgttcgggggttaccccttaacccggtaacggggttacccgttaacgggggaacgggtaacccggggtaaaccgggtcgttaaccgggtaaatttttaacggtttaacgttttacgggaccttaaacgttaccggttaacttaaactaaccttaaaaccgaaacccgtaaacgtacggtaacccttaccgttacaccggttaccgtttacggttaaccgtttacggggaccgggaaacgggttacccgaaagttcccgtcggtaaccccggttccttaagggtcccacggtacccgaaacgtccgaacccgttcccccgtagtcctaacttcccgttacgtttccccgacccgttccgtaccggtaacgttacgtaaccgtacgtacgggtaccggtaaccggtccggttaaccggaccgttaacgggccgtacgtaacggttacccgagttacc

SEQ ID NO: 11559 - DNA, 761 bp, Homo sapiens
  misc_feature: GYAE6OF02FU693.16.86.H09.1.454.CMB.1.raw
  modified_base (624)..(624): a, c, t, g, unknown or other
  misc_feature (624)..(624): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacgagggtcctgggcccagtctgccctgactcagcctgcctccgtgtctgggtcctctggacagtcgatcatcattcttctgcactggactccgagctaggtgtacggttggttaagttagtaatttgtagtctcctaggtaccaactacgtacccaggaccaaaccgaccccccaaatcgactgttaattacgaggtaggtactaggtaacgtcccggtccccttaggtacggggttttactaacgtacgtccgttcttcgtcggcctacgtaacggtcgtacggtaccaaccggtacccggtcccttacccgcgaccgttacttccgtaaccggtgggtccccttaccgagggtaccgtacggggaaagggaccgggtacggggttagttaacgtttaactttaccgggtgacgtacggttaaccttagtaaacgtttaacggaagggttacgtaaggggtccaacgggtaccttaacccgttntttaccgggttaaccgggtttcgggtacccggggttaagggaacccggtaaacggtccggtcccggtttaacccggttacccggtaccgggtaccgacccggaccttaccgggacccggtcccgttaaccccccggg

SEQ ID NO: 11560 - DNA, 876 bp, Homo sapiens
  misc_feature: GYAE6OF02HC3G4.16.86.H09.1.454.CMB.1.raw
  modified_base (178)..(178): a, c, t, g, unknown or other
  misc_feature (178)..(178): n is a, c, g, or t
  modified_base (871)..(871): a, c, t, g, unknown or other
  misc_feature (871)..(871): n is a, c, g, or t
tcagtgtactactccacgaccggtgctcgatttagtgctatagacttgggtttggggggggggtctcgaggaggcagcgctctcaggacatctccaccatggcctgggctctgcctgctcctcaccctcctcaactcgagggctacgagggtcctgggtccctccacgtacggaaccngcagtgtacgttggtagttataactttcgtactcgtagactaaccaacgcgaccaacccgaggacaaaacgccaacccgtaaatttcaattacggtaattttacgacgtacggtacctaacgtaacgtccggtacccgttacggtaaggggtttacctaagttccgtacctttcgtcgtacggtccttaccgtaacgtcgtaggacctaaccgtaccggtccctaccgtacgtaaccctgttcctcggtccgggtacctacgacggtaccgtaggtaacggtaccggtaggtaccgtacgtttaacgttaagtttacgtcgtaacttacgttccttaacgtaaacttaaccgtaaaccgtaaaacctaacggtaaccgtaccgtaccgttaccgtacgttaaccggttacggtttaaccgggtaccggggtacgggtaaccgggaaccgtaacggtaccgtaaccggttaacccggttaccggtaaccggttaccgtaaccggtaacccggaaccggtaccggttacccggtccccgttaccggtaccgttacccgtttaaccgttaccccgtttaccccgttacccgttcccgttaaccggttacgttaaccggttaccggtaaccggtcggtaaaaaaccggtccgggtacggttaaccggaccggtaccggtaccgtacgtacggtacgngtacg

SEQ ID NO: 11561 - DNA, 272 bp, Homo sapiens
  misc_feature: GYAE6OF02IOFU7.16.86.H09.1.454.CMB.1.raw
  modified_base (230)..(230): a, c, t, g, unknown or other
  misc_feature (230)..(230): n is a, c, g, or t
  modified_base (246)..(272): a, c, t, g, unknown or other
  misc_feature (246)..(272): n is a, c, g, or t
tcagtgtactactccacgaccggtgctcgatttagtgctatagacttgggtttgggaacctatgaacattctgtaggggccactgtcttctccacggtgctcccttcatgcgtgacctggcagcactctcgtattcggcggtgggaccaagctgaccgtcctaggtcagcccaaggctgccccctggtcactctgttcccacctcctcgagttagtacactgagccgggntggcaaggcgcatagnnnnnnnnnnnnnnnnnnnnnnnnnnn

SEQ ID NO: 11562 - DNA, 739 bp, Homo sapiens
  misc_feature: GYAE6OF02HUAYR.16.86.H09.1.454.CMB.1.raw
  modified_base (212)..(212): a, c, t, g, unknown or other
  misc_feature (212)..(212): n is a, c, g, or t
  modified_base (248)..(248): a, c, t, g, unknown or other
  misc_feature (248)..(248): n is a, c, g, or t
  modified_base (735)..(735): a, c, t, g, unknown or other
  misc_feature (735)..(735): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggtccctcactggaaccagcagtgacgttggtagttataactttgtctcctgactaccaacngccaccaggacaaagcaacccaaattcatgtattangaggtcactagtcgcctgtagggttactaatcgtcttctcgtcggctaccgtaagttctggaccaaccgtccggtcccctaccgtcgaccctatccgttacgtcgggtccctaccgacggtaccgtacggaacgggaccggtacgtcgttaaggttaactttaacgtttagttcgtaactcgttactaacctaaattaacctaaacccaaaccgaacgtaacgtactaaccgttaccttacggtacgttagggttaccggttacggggaccgggtaacgggaaccgtaaacgccgttaacggtaccccgttaggtaccggtaccgacccgtacccggaacggtcccgtaccccggtccccgttacggtaccctaccgtttcccgtacccggtttcccccgacccgttacgtaaccggtacttaccggtaaccgtcggttacggaccgggtccgggtagttaccggacgacgggctaacggacgtcgntacg

SEQ ID NO: 11563 - DNA, 792 bp, Homo sapiens
  misc_feature: GYAE6OF02F7RFI.16.86.H09.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcctcactcagggcacagggtcctgggcccagtctgccctgactcagcctgcctcgtgtcgtgggtctccgtggacngtcgatcatnattcttcngccacgtggactccagcgtagtgtacggttgtagttataattatcgtctcgtacgtaccaactacgtaccaggacaaaccgacccccaaagtcatagtactttagtagtacggtacgaagttaacgtcccgtcccttaggttacggggtttacctaacgttccgttcctttaccgttcgttaccggtaccttaccgtaaacggttccgtaacggaccctaaacccggtacccggtccccttacccgtacgtaccctacttccgtccggttcggggaccttcccggagggtaccgttacgggaacgggtaccgggtagggtttacgttaacgtttaacgttaccgtcgggtactaacggttaccttacgtaaagttaacgttaagggtaaccgggtacggaccgtacgtaaccctacgttaccgtttacgggtttaaccgggttcccgggacggggtaaccgggtaaacccggtaacgggttaccctacccgggttaacccggtttacccgtacgggtcccgtaacccgggttaccccgtaaccgggttcccgtaacccccgggttccccccgg

SEQ ID NO: 11564 - DNA, 703 bp, Homo sapiens
  misc_feature: GYAE6OF02JR2IQ.16.86.H09.1.454.CMB.1.raw
  modified_base (152)..(152): a, c, t, g, unknown or other
  misc_feature (152)..(152): n is a, c, g, or t
  modified_base (160)..(160): a, c, t, g, unknown or other
  misc_feature (160)..(160): n is a, c, g, or t
  modified_base (204)..(204): a, c, t, g, unknown or other
  misc_feature (204)..(204): n is a, c, g, or t
  modified_base (209)..(209): a, c, t, g, unknown or other
  misc_feature (209)..(209): n is a, c, g, or t
  modified_base (217)..(217): a, c, t, g, unknown or other
  misc_feature (217)..(217): n is a, c, g, or t
  modified_base (377)..(377): a, c, t, g, unknown or other
  misc_feature (377)..(377): n is a, c, g, or t
tcagtgtactactccacgaccggtgctcgatttagtgctatagacttgggtttgggggggggggtctcaggaggcagcgctctcaggacatctccaccatggcctgggctctgctgctcctcaccctcctcactcgagggcacgagggtccngggacccngtctcgccctgactcagcctcgcctcgtgtcgtgggtcctacgngtacngttcgatnactctattcgttccgtagccacgttcggaaccttccgaagtcgtaaggttcggtacggtttaggttaattaacgttattacgtcgttcgttacgtaccggtaacctaacgtacgtaccgaacgaacgaaaccctacccgtaactctatacgttattacgngtaacgtctaacgtacgtcccggtacgttcggtaacggttatacgttctacttcgtgtcgttacctacgtcgtcggtacaccgtaaccggtacctccctcgttaacgaccttacgtcgtcggtaccggtcctaccggtacgtcggtcgggacggtacggaccgttgttaacgtttacgtttacttacgtacgtactacttacttactaactacggtaaacctacggactacctactcgtactcgtacgttcgtacgggtcggaccggtacggacgtagtaccggacgtaccggttacgacgtaccggtaccgaccgtacgtcccgg

SEQ ID NO: 11565 - DNA, 739 bp, Homo sapiens
  misc_feature: GYAE6OF02JQKVD.16.86.H09.1.454.CMB.1.raw
  modified_base (322)..(322): a, c, t, g, unknown or other
  misc_feature (322)..(322): n is a, c, g, or t
  modified_base (598)..(598): a, c, t, g, unknown or other
  misc_feature (598)..(598): n is a, c, g, or t
  modified_base (672)..(672): a, c, t, g, unknown or other
  misc_feature (672)..(672): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcgacgggcacgaggtcgacgccgtccgaggggaagggtcctcgacggacctcgtgggctgtactccgttcggtctcctgcgtctcgcggccgtaccgacccggggccagactacgtcgacctcgacgtcggctatcggttcttccttccttcgttccgcgggtcctacgggcctatccgtaccgtctcntcgactcccgtagcccgtcgtgtcgtacggtccctcggtaggactcggactagcgtctactcggttcttaccggataccggtacggttacgtacgtaccggactttaccgggtagtttacgggtttaacggtttaagttttaagtaaagtttccttaacggtttccctaccgttaccggggtaaactaaccggtaacgtacccggtaccgaaacgtaaaccaaccctaaccgtattacgaacgtttacgttacgtacgtacgggtactaccggttnttaaaccgggtccgtttcggtaacgtttaccggtactccgttaaccttgttaccgtccgacgttacgtccggtnttaccggaccacttaacccggccctacgtcctacggttaccgtccgttacggtaggtcccgtcccgg

SEQ ID NO: 11566 - DNA, 729 bp, Homo sapiens
  misc_feature: GYAE6OF02IOD2K.16.86.H09.1.454.CMB.1.raw
  modified_base (641)..(641): a, c, t, g, unknown or other
  misc_feature (641)..(641): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctctcactcagggcacaggtgacgccctaccgaggggaacgggcttcgagggacccttgtgggctgatccgttggtcctcctcgccttcctgacggtcctaccgacccggggcccagcgaacttcgacctcactggctattgtcgtttcctcccttactttccgacggggttccgtcgggacccctagttcgtccgtcccctgaactcgacgtcccttacgccctccgttgtcggtcggtacctccgacggtactcgtacgtactactcttccgtattccggttctaccggtccgtaacgtcggtactccgtaaaggccgttaggtcgttaacgggtttagtaaacgtttaaattaacgtttcgttcgttaccgtccgtaacggtacctaaacctacgggtacccgtaaaggtacccgaaaaccccgtaaccccaacttactagtttaacgttactttagacggtacgtagtaactccggtacccgttccgttaagggtcggtttacacgttcccgtntttacgtcgtcgaccttacgtacggtcgtactaccgacccggttaccgtcccgtacgtacccggtcaccgtttcgacggtcgtacccg

SEQ ID NO: 11567 - DNA, 760 bp, Homo sapiens
  misc_feature: GYAE6OF02HQ4EX.16.86.H09.1.454.CMB.1.raw
  modified_base (250)..(250): a, c, t, g, unknown or other
  misc_feature (250)..(250): n is a, c, g, or t
  modified_base (300)..(300): a, c, t, g, unknown or other
  misc_feature (300)..(300): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctctcactcagggcacagggtcctgggtcctccatggaaccagcagtgacgttggtggttaataacttttgtctcctgataccaacacgcacccaggacaaaagccaacccaaattcatgtatttangagtcaacttaagtccggccctagtaggggttttaccaagtcgtacttcncgtggctaccgaagtcgtcggacaaccgacggtccctccgtagaccctaatcgttctgggccttccgaacggtctaggaacggacggaacggtctaggaatttagtttattcgactaacttcgtacaatttaaactaaacctaaaaccctaaacgacgtaactaaccgttccctaacgtaaccgtagggttaacgtttccggggaacgggtaacgggtaaccgtaaaaggtccgttaacggtaccccggttacccgttaagggttacccaacgggtaccccgtaaagggtcccttacccggttaccccccgtacggttcccgtaacccttccgttcccgttaacccccctacccgttaccttaaccggtacggtttaaccggttaccgaacggttaccggaccggtacggggtcccgtttaacgggaacaccggggttacacccgtaagtaccggatacg

SEQ ID NO: 11568 - DNA, 663 bp, Homo sapiens
  misc_feature: GYAE6OF02HMNQS.16.86.H09.1.454.CMB.1.raw
  modified_base (229)..(229): a, c, t, g, unknown or other
  misc_feature (229)..(229): n is a, c, g, or t
  modified_base (278)..(278): a, c, t, g, unknown or other
  misc_feature (278)..(278): n is a, c, g, or t
  modified_base (337)..(337): a, c, t, g, unknown or other
  misc_feature (337)..(337): n is a, c, g, or t
  modified_base (376)..(376): a, c, t, g, unknown or other
  misc_feature (376)..(376): n is a, c, g, or t
tcagtgtactactccacgaccggtgctcgatttagtgctatagacttgggtttgggggggggtctcaggaggcagcgctctcaggacatctccaccatggcctgggctactgctgcctcctcaccctctcactcagggcacgagggtcctgggcccagtctcgccctgactcagcctcgcctccggtagtcgtgggtctccgtggacagtccgatcatcagttcttacngctaactggactccgagcgtagtgtacggttggttaattacgtaatttntcgtctccgtaggaaccagtaccgaccgagacaaacccgacccaatcatgttaattagnggtagactagttacgccgtaccgttggtaaggtttccancgttcttcgctcgtaacctagtacgtcacgtacccgtacgccccgtaccgtccgactaaccgtgtccgtacggtcggttacccgcggaacgtcgtaacgggtaaggtacgggtattaccgtaatttcgttacgtcgaacgtctcgaacgttataggaaacgtgtccggtcaactttccacgtttacggtacgttcgggtacgggtcggtaccggaaacctcgttcggtacccgttacgtaaccggtcgtccggtaaaccgccgttacccgcccttccggtacccccg

SEQ ID NO: 11569 - DNA, 319 bp, Homo sapiens
  misc_feature: GYAE6OF02GG6A0.16.86.H09.1.454.CMB.1.raw
  modified_base (87)..(87): a, c, t, g, unknown or other
  misc_feature (87)..(87): n is a, c, g, or t
  modified_base (225)..(225): a, c, t, g, unknown or other
  misc_feature (225)..(225): n is a, c, g, or t
  modified_base (230)..(230): a, c, t, g, unknown or other
  misc_feature (230)..(230): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (264)..(264): a, c, t, g, unknown or other
  misc_feature (264)..(264): n is a, c, g, or t
  modified_base (266)..(319): a, c, t, g, unknown or other
  misc_feature (266)..(319): n is a, c, g, or t
tcagtgtactactccacgaccggtgctcgatttagtgctatagacttgggtttgggaacctatgaacattctgtaggggccactgtnttctccacggtgctcccttcatgcgtgacctggcagcactgtcgtattcggcggtgggacaagctgaccgtcctaggtcacgccctaaggcctcggcccctgtcacgtcttcgttccccaccttctacgagtagtacncgagnggcggactggacaagggccataaanagcngatcnannnnnnnnnnnnnnnnnnnnnnnnnnnnnnnnnnnnnnnnnnnnnnnnnnnnnn

SEQ ID NO: 11570 - DNA, 849 bp, Homo sapiens
  misc_feature: GYAE6OF02FJ1TR.16.86.H09.1.454.CMB.1.raw
  modified_base (196)..(196): a, c, t, g, unknown or other
  misc_feature (196)..(196): n is a, c, g, or t
tcagtgtactactccacgaccggtgctcgatttagtgctatagacttgggtttggggggggggtctcaggaggcagcgctctcaggacatctccaccatggcctgggctctgctgctcctcaccctcctcactcagggcacagggtcctgggcccagtctgccctgactcagcctgcctcgtgtctgggtctccgnggacagtcgatcatcattcttctagcacgtggaactccagctaggtcgtacggtttggttagttaattaagttatcgttctccgtaggtaaccaacgtacgtacccgaggtaccaaaccgacccctaaacgtctagtcgtaactttagtcggacggtactaagtaacgtccggtaccgtacgtacggggtttactaacgttcgtccgttactcgtcggtactaccgttaaagtccgtacgaactaaacccgggtacccggtacccgtttacccgacggtaaccctacgttaccggttccggtacgggtacccttaaccggacgggttaacgttacggggaacgggggtaaaccgggttaaggggttcggttaaaactttacgttaaccgtcggaaccgttcggtaacctaccggtaaacgttaacggttaaacgggttaaacgggtaccgggttacgaaccggtaccgttaaaccggttcggttaacccgtttacggggttacccgggggtacggggtttaacggaacccggtaaccggtacccgttaacccgggtaaccccggtttaaccggtttaacccgggttacccgggtaaacccggttaaccccggtaaccggggttaccccgttacccccgggttacccccccggg

SEQ ID NO: 11571 - DNA, 730 bp, Homo sapiens
  misc_feature: GYAE6OF02GDD4H.16.86.H09.1.454.CMB.1.raw
  modified_base (173)..(173): a, c, t, g, unknown or other
  misc_feature (173)..(173): n is a, c, g, or t
  modified_base (244)..(244): a, c, t, g, unknown or other
  misc_feature (244)..(244): n is a, c, g, or t
tcagtgtactactccacgaccggtgctcgatttagtgctatagacttggggtttgggggggggtctcaggaggcagcgctctcaggacatctccaccatggcctgggctctgctgctcctcaccctcctcactcagggcacgagggtcctgggcccagtctgccctgactacncgcctcgcctccgtgtcgtgggtctcctagggaccagtcgatcactcacttcttcgtgcctaagtcggacnccgagctaggtaggtaccgtttaggtagttaattaagttacgttcgtcttaccgtacggtacaacctaccgtacccgaggaaccaaccgtaacccctaacgtactataggttcttagtaggtagtacaagttaacgcccggtcctacggttacgggtttacctaacggttccgtacttccgtacgttcgacccgtacgtaacgtcggtacgaaccgaccgtacccgtccctccgtacgacctcttacgtcgtcggcctacgaggtcacgggacggtaacggtgggtataactttgtaacgtcgaagtcgtacctaagtaagttaacgtacggaacggttcgaccaggttacctcgttaaccgttggttaaccgccgggggttacggaccgggtaacctaacgttcccggtaccggtttacccggtacgttaaccgggccgtaaaccggtaccccggggactttaccccggtaccccggttccccgg

SEQ ID NO: 11572 - DNA, 740 bp, Homo sapiens
  misc_feature: GYAE6OF02F4EST.16.86.H09.1.454.CMB.1.raw
  modified_base (148)..(148): a, c, t, g, unknown or other
  misc_feature (148)..(148): n is a, c, g, or t
  modified_base (268)..(268): a, c, t, g, unknown or other
  misc_feature (268)..(268): n is a, c, g, or t
  modified_base (322)..(322): a, c, t, g, unknown or other
  misc_feature (322)..(322): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctctcactcagggcacgagggtccngggcccagtctgccctgactgagcctagcctcgtgtcgtgggtcctccgtggacaggtcgatctatcagttcttcgtcaccatcggactccgagtcaggtgtacgttggtattatattancgttctcgtaggtaccaagtcgtaccgagaccaaccgacccctaagtcgaattnttaacgtttagacggtatacgtaagtaccgtccgggtccttagggttacggtttactacgtcgttccttacgtcgtacgtactaccgttaacggtcgtacggtaacccaacggtccccggttccttcccggaacgtaacctcggttcgtaccggtaccggtcccgttacggcgttacggaacggggtacggtaggggtacggttaattaactttaacgtctagggtcctaactcggttaatagttaaaccgggtagtaaggggtcaaccgttcgacgtttaccgttcggttacggtcccggggtacgggttaacgggtccgaaacggtccggttaaccccggtaaggttaccccggtcgtttaaccggggacctacccgggtaaacccggtcgtttcccggtacccccggttccccgg

SEQ ID NO: 11573 - DNA, 718 bp, Homo sapiens
  misc_feature: GYAE6OF02IYH7X.16.86.H09.1.454.CMB.1.raw
  modified_base (300)..(300): a, c, t, g, unknown or other
  misc_feature (300)..(300): n is a, c, g, or t
  modified_base (360)..(360): a, c, t, g, unknown or other
  misc_feature (360)..(360): n is a, c, g, or t
  modified_base (385)..(385): a, c, t, g, unknown or other
  misc_feature (385)..(385): n is a, c, g, or t
  modified_base (411)..(411): a, c, t, g, unknown or other
  misc_feature (411)..(411): n is a, c, g, or t
tcagtgtactactccacgaccggtgctcgatttagtgctatagacttggggtttgggggggggggtctcagggaggcagcgctctcaggacatctccaccatggcctgggctctgctcgctcctcaccctctcactcagggcacgtaggggtcctggggtccctccacgttacggaacccagaccgaggttaggtacggtttgggttaggtttattaacttttggtcctcctagacctaaccaacgacgcccgacccgaggtaccgaaaacgccaaaccctaaattcatagtatttacgngtacggtacaacttaacgtccggcctacggtagggtttacctatcgtcttctcgtgtccnctagtctgaccacgccgtacctccncgacctagtcgtcgtacggcctacgnggcgagacgggaggctcgtagtacttattgtcgatctactctaattaccgaacaacctacgacgaccttactaccgttacgtacgtacgggttacgttaccgggacgggtaacgtaaccgacgttcccggtaacgttaacccgttccggaccggtacacccggaacgtacgtcccgtaccccggtcccgtcgtaccgttccctacccgttccgttacccgtcctacccggttataacgttcaccgtaaccggcggaaggtcccgggttacggccgggtaacggtacgaccgtacggtagacgtctag

SEQ ID NO: 11574 - DNA, 713 bp, Homo sapiens
  misc_feature: GYAE6OF02F23RI.16.86.H09.1.454.CMB.1.raw
  modified_base (218)..(219): a, c, t, g, unknown or other
  misc_feature (218)..(219): n is a, c, g, or t
  modified_base (416)..(416): a, c, t, g, unknown or other
  misc_feature (416)..(416): n is a, c, g, or t
tcagtgtactactccacgaccggtgctcgatttagtgctatagacttgggtttgggggggggtctcaggaggcagcgctctcaggacatctccaccatggcctgggctctgctgctcctcaccctcccactcagggcacgagggtcctgggcccagtctgccctgacgtcagcctgcctcgtgtctgggtctcctggacagtcgatcatcatcgttcnncacgtggactccagctagtcgacgtttagtagttataagttatagtcttctcggtacaacacgtaccagacctaaacgaccccaactccatcgtattacgtggagtacagtacgtccgtccgtcgtaggggtttacctatcctacttctcgtcgtctcgacgtcgtcgacaacgaccggtcctacctcgaacccgtntccgtagtcggtctacgacggtccgtaggacggtaccgggtaggtacgttaagttaccgttacgtcgacgtaccgtacgtactaacgttaagtaaacgggtacgttacgggaacctacgggttaacccttacgttaacccggtttaaggttacccgggtttacgggtaccggggtaccgggtaaacccgtacggttacccggttaacccggtaacccggttccggtttaacccgggtaccgttaaccggaccccggttaaccggtccccggtaccccgttacccccgggtttcccgg

SEQ ID NO: 11575 - DNA, 784 bp, Homo sapiens
  misc_feature: GYAE6OF02FT73Z.16.86.H09.1.454.CMB.1.raw
  modified_base (239)..(239): a, c, t, g, unknown or other
  misc_feature (239)..(239): n is a, c, g, or t
tcagtgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctctgataccacagcaccaggcaaagcaccaaattcatgatttangagtacactaatcggccctcgagggtttctaatccgtcttctcgtgccttccgaagtccgtggaccaacgccggccctccgtgacctattccgtcgtgggtcctccgagggtcctaggtaacggacggacggtcgttagtaagtttacttaagtttcgaccgttaacttaccgtttaccgaaatttaaccgttaaacccaaaaaccccgtaaacgtaccggtacccttaacctttacccggttaccggtaacggtttacggggttaaccgtttaaccggggggaccggggttaaaccggggaacccgtaaacgggtaccgttaccgggacccgtttacccggtaacgggttccgaaccggtacccgaaacgggtcccttacccgggtcccccgttcgggttacccaaccgtttccgttaccccggttaccccctacccgttccccgtaccggtttaccgtaaaccggtaccgtaccggttacggaccgggttccgggtaccgtgggtacccgtaacgggacccgtaagttaccggtacggtcacg

SEQ ID NO: 11576 - DNA, 542 bp, Homo sapiens
  misc_feature: GYAE6OF01BX6ZX.48.83.H06.1.454.CMB.1.raw
  modified_base (332)..(332): a, c, t, g, unknown or other
  misc_feature (332)..(332): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatcccctgagcgattcnctggctccaactctgggaaccactgcccacctcgaccatcacggggacccaggccttggatgaggctgactatcactgtcaggcgtgggacagcgaacacgtgcgtagttttcgggacgggggaccgaggcgtggaccggtcggcgggtcgaggacccgacggccgtccgcccccgtccggtccaccttccgtccgttcccctacccccg

SEQ ID NO: 11577 - DNA, 533 bp, Homo sapiens
  misc_feature: GYAE6OF01BHQZM.48.83.H06.1.454.CMB.1.raw
  modified_base (231)..(231): a, c, t, g, unknown or other
  misc_feature (231)..(231): n is a, c, g, or t
  modified_base (467)..(467): a, c, t, g, unknown or other
  misc_feature (467)..(467): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctctgtttgacataaagttgggganaaatatgtttgttggtatcaacagaagccaggccagtcccctgtgttggtcatccgtgaagataacaagcggccctcaggcatccctgacgcgattctctggcctccaactcgtagggaaccacgtcgacccacccgtgaccatccgacggggacccaggccgttggatgacggctgactagtcacgtcgtcaggcgtggacagcaacgctgtcgtagtttcgggacggggaccgnggcgtcggaccgtcggcggtcgacgcccgaggccgtcgccccgtcgccacgtcctcgtcccgtccc

SEQ ID NO: 11578 - DNA, 550 bp, Homo sapiens
  misc_feature: GYAE6OF01ETOJL.48.83.H06.1.454.CMB.1.raw
  modified_base (232)..(232): a, c, t, g, unknown or other
  misc_feature (232)..(232): n is a, c, g, or t
  modified_base (328)..(328): a, c, t, g, unknown or other
  misc_feature (328)..(328): n is a, c, g, or t
  modified_base (350)..(350): a, c, t, g, unknown or other
  misc_feature (350)..(350): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttgacataaattgggganaatatgtttgttggtatcaacagaagccaggccagtcccctgtgttggtcatccgtgaagataacaagcggccctcaggcatccctgagcgattcnctggctccaactctagggaacnctgcccaccctgacccatcgacggggacccaggccgttggagtgaggctgactatcactgtcaggcgtgggacagacaacacgtgacgtacgtttcgggcgggggaccgaggcgtcggaccggtcggcgggtccgacggccccgaaggcccgtacggccccccgtcggtcccaccgttcccgttccgttccccgtccccg

SEQ ID NO: 11579 - DNA, 544 bp, Homo sapiens
  misc_feature: GYAE6OF01CF639.48.83.H06.1.454.CMB.1.raw
  modified_base (233)..(233): a, c, t, g, unknown or other
  misc_feature (233)..(233): n is a, c, g, or t
  modified_base (356)..(356): a, c, t, g, unknown or other
  misc_feature (356)..(356): n is a, c, g, or t
tcagagtatacatacacgaccggtgctcgatttagatcacgtgcgtcgcggggctgggcctcaggaagcagcatcggaggtgcctcagccatggcatggatccctctctccctcggcgtccttgcttactgcacaggttccgtggcctcctatgagctgactcagccaccctcagtgtccgtgtccccaggacagacagccagcatctcctgttttggacataaattgggganaaatatgtttgttggtatcaacagaagccaggccagtcccctgtgttggtcagtccgtagaagataaacaagcggccctcaggcatccctgagcgattctctggctccaactctagggaaccnctcgcccacctgaccatcgacggggacccaggccttggatgaggctagactagtcactgtcaggcgtgggacagacaacacgtgtcgtagtttcgggacgggggtaccgaggccgtcggaccggtcgggccggtcgacgacccgacggccgtcgcccccgtccggtccactcctcgtccccgtccccg

SEQ ID NO: 11580 - DNA, 587 bp, Homo sapiens
  misc_feature: GYAE6OF01CNGQB.48.83.H06.1.454.CMB.1.raw
  modified_base (231)..(231): a, c, t, g, unknown or other
  misc_feature (231)..(231): n is a, c, g, or t
  modified_base (249)..(249): a, c, t, g, unknown or other
  misc_feature (249)..(249): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccacctcagtgtccgtgtccccaggacagacagccagcatctcctgtttggacataagttgggganaatatgttgtgtatcaanagaagcaggccagtcctgtgtgtcatccgtagagataacagcggcctcagcatccctgagcgattctcgtacgctccaactcgtagggaacacgtcgacccaccgtgaccagtccgacggggacccaggccgttggagtgacgtcgtagactatctaacgtgtacgaggacgtggacagacgaacgacgtcggacgttacggtttacggggaccgggggtaccgacgggccggttacggacccggttcgggcccggtaccgacgggaccccggtaaacgggcccgtaccggcccccgtacgggtccctaacccgtccgttccggttcccccgtccccg

SEQ ID NO: 11581 - DNA, 534 bp, Homo sapiens
  misc_feature: GYAE6OF01CZ729.48.83.H06.1.454.CMB.1.raw
  modified_base (234)..(234): a, c, t, g, unknown or other
  misc_feature (234)..(234): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattggggganaaatatgtttgttggtatcaacagaagccaggccagtcccctgtgttggtcatccgtgaagataacaagcggccctcaggcatccctgacgcgattctctggcctccaactctgggaacactgcccaccctgaccagtcgacggggacccacggccttggagtgaggctcgactatcactgtcgaggcgtggacagcaacactgcgtagtttcgggcgggggacacggcgtcgaccggtcggcggtcgacgcccgaaggccgtccgccccgtcggtccaccgtctccgttccctaccccg

SEQ ID NO: 11582 - DNA, 555 bp, Homo sapiens
  misc_feature: GYAE6OF01CTZLQ.48.83.H06.1.454.CMB.1.raw
  modified_base (232)..(232): a, c, t, g, unknown or other
  misc_feature (232)..(232): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttggacataaattgggganaaatatgtttgttggtatcaacagaagccaggccagtcccctgtgttggtcatccgtgaagataacaagcggcctcaggcatccctgacgcgattctcgtggctccaactcgtagggaacctactcgacccaccctgacccagtcgacgggggacccaggccgttggatgaggctagactatcactgtcgaggcgtgggacagacaacacgtcgtcgtagtttcgggacgggggaccaggcgtcggaccggtcggccggtcgacggcccgaacggccgtccggcccccgtcggtaccaccgttccgtccgttccccgtccccg

SEQ ID NO: 11583 - DNA, 682 bp, Homo sapiens
  misc_feature: GYAE6OF01D8WAU.48.83.H06.1.454.CMB.1.raw
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttgacataagtgggganaatntgttgtgtatcaanagaagccaggccacgtcccctgttgttggtcagtccggtagaaagactaaacgaacggccggtccctacgacggccaactccccgtagacgtcgtatttccgtcgtcggtcctacctaacgtcgtaacgggaacctacgtccgacccctacccgtacgaccctacggtaccgggaccgggggaccctacgggtccgttaggacgttcggacggtcgtacgtactacgtcctacgtcgtacgacggtcggtacggaccgacgacaacgtacgtcggtaccggttacgggtttccgggggaccgggggtaccgacgggtaccggtaccgggtacccgggtccgggtaccgggtccgacccggacccggtaacgggtccccgtcccggtccccggttccggtaccctacccgttcccgttcccgtccccgtaccccg

SEQ ID NO: 11584 - DNA, 539 bp, Homo sapiens
  misc_feature: GYAE6OF01BU2NH.48.83.H06.1.454.CMB.1.raw
  modified_base (233)..(233): a, c, t, g, unknown or other
  misc_feature (233)..(233): n is a, c, g, or t
  modified_base (329)..(329): a, c, t, g, unknown or other
  misc_feature (329)..(329): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggganaaatatgtttgttggtatcaacagaagccaggccagtcccctgtgttgtcatccgtgaagataacaagccggcctcaggcatccctgagcgattcnctggctaccaactcgtgggaacacgtcgcccaccctgacccagtcgacggggacccaggccgtggagtgaggccgtgactatctactgtcgaggcgtgggacagcacacgtgcgtagtttcgggcggggaccgaggcgtcggaccgtcgggcggtcgacgcccgacggccgtcgcccccgtcggtccaccgtccgtcgttccccgtcccc

SEQ ID NO: 11585 - DNA, 828 bp, Homo sapiens
  misc_feature: GYAE6OF01DPDJ8.48.83.H06.1.454.CMB.1.raw
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcacgccaccctcagtcgtccgtcgtccccaggacagacagccagcatctccttgtttggactaagtaaagttggggataaatagttgtttgtagtatcaacagaagccaggccacgtccctgtgtggtcacgtcgtagaagtactaacgaacgccggtaccctacgaggtcactccgtagacgtcgtactttcgcgtgggtacctaccgtaaacgtccgtaacgggaaacctaccttaccgaccccgtaacccgttacggaaacccctacggttacccgggaaccgggggacccgtaacgggtccccgtttagggaacggttacggtaacgggtaccttaccgggtaacttaaccgtaccgttaccggttaccggttaccggtaaccggggtaccgggtttaacggggaaccggtaaacgtacccgtaaacccgtacggttaccggggtaaccggtttaacgggttttaccccggggggcccggggggtaaccctaaccggggtccggttaccggggaccccgggttacggggtaccccgggtaccgtacccgggtaacccccggtaaacgggtccccggttacccccggtacccccccggtttacccggggttacccctacccggtttccccgtttaccccgggttcccccccgtttacccccgg

SEQ ID NO: 11586 - DNA, 560 bp, Homo sapiens
  misc_feature: GYAE6OF01BJC4Z.48.83.H06.1.454.CMB.1.raw
  modified_base (228)..(228): a, c, t, g, unknown or other
  misc_feature (228)..(228): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctctgtttgacataatgggganaatatgttgtgtatcaacagaagcaggccagtcccctgtgttggtcatccgtgaagataacgaagccggccctcaggcatccctgagcgacttctctggctccaactctagggaacactcgacccaccgtgaccacgtcgacggggacccacggtccgttggagtgaggtcgtagactatcgtactgtcgaggcgtagggacagacaacacgtgcgtacgtttcgggcggggacgacggcgtcggaccggtcggtccggacgtacggacccggaacggtccgtccggcccccgttccggtaccctaccgtccgttccgttccccgtaccccg

SEQ ID NO: 11587 - DNA, 742 bp, Homo sapiens
  misc_feature: GYAE6OF01DUNGZ.48.83.H06.1.454.CMB.1.raw
  modified_base (254)..(254): a, c, t, g, unknown or other
  misc_feature (254)..(254): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtcgtccgtgtccccaggacagacagccagcatctcctgtttgactataagttggggataaatatgtttagtgtatcaanagaagccagccagtcccctgtgttgtcatccgtagaagataacaaggccgccctagagcctaactcccgtagagcgtattcctcgtcgcctaccaactcgtagggaacacgtcgccccaaccgtcgaaccctacgtaccggaccggggaacccctacgggcccgttagggaagtcggtaacggtccgtacgtaaccgttacgtaccgacgttacggtaccggtagggtacgggtacggaaccgtacgaccgtaaaccgtaccgtagtacccgggtaaacggtttttccgggggaaccggggggtaccgtaaccgggaccggttaccgggtaaccccgggttccggggaccgggtacccgtaacccggggtacccccggtaaacgggttccccgttacccccgggtaccccccccggttaccggggttaccccggttaaacccgtttccccggtttcccccgggttttccccccggttaccccccccgg

SEQ ID NO: 11588 - DNA, 630 bp, Homo sapiens
  misc_feature: GYAE6OF01DT8FA.48.83.H06.1.454.CMB.1.raw
  modified_base (163)..(163): a, c, t, g, unknown or other
  misc_feature (163)..(163): n is a, c, g, or t
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (317)..(317): a, c, t, g, unknown or other
  misc_feature (317)..(317): n is a, c, g, or t
  modified_base (342)..(342): a, c, t, g, unknown or other
  misc_feature (342)..(342): n is a, c, g, or t
  modified_base (451)..(451): a, c, t, g, unknown or other
  misc_feature (451)..(451): n is a, c, g, or t
  modified_base (488)..(488): a, c, t, g, unknown or other
  misc_feature (488)..(488): n is a, c, g, or t
tcagagtatacatacacgaccggtgctcgatttagatcacgtgcgtcggcgggctgggcctcaggaagcagcatcggaggtgcctcagccatggcactggactccctctccttcctcggcgttcctgctactgcactggtcgtggcctctagtgagctgactnacgcctaccgtcaggtgtccgtcgtccccaggaccagacagcagcatctctgtttgacataagtggggaanaatnttagtttgttggtactacaacaagaacgccgagccacgtcccctgtgtggtcatccgtagtagataacgagccggcctnacggtcactccctggagctacttcncgtcggtctccgaacgtcgtacgggaacctacgtcgaccccaccttacgaccctacgttacggaccggggacccagggtcccttagggagtggacggtctaggaccttnacgtagttcgtacgaggcgtagggaccagcgtaacgngtcgtacgtacggtttcggggccggggtacacgggtccgttacggaacccggttgggaccgtaccggacggtacccgaagggttccccaaccggccccccgttcggtccctaacgtttccccgtccgttccccctaccccgg

SEQ ID NO: 11589 - DNA, 560 bp, Homo sapiens
  misc_feature: GYAE6OF01CDLJL.48.83.H06.1.454.CMB.1.raw
  modified_base (235)..(235): a, c, t, g, unknown or other
  misc_feature (235)..(235): n is a, c, g, or t
  modified_base (240)..(240): a, c, t, g, unknown or other
  misc_feature (240)..(240): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtcccccaggacagacagccagcatctcctgttttggacataaagttgggganaaatntgtttgttggtatcaacagaagccaggccagtcccctgtgttggtcatccgtgaagataacaagcgccctcgaggcatccctgagcgattctctggctccaactcgtggaacactgcccacccgtgacccagtccgacggggaccccaggccgttaggagtggaggctgtactactctacgtcgtcgaggtcggtagggacagcaacacgtgcgtacgtttcggggacggggaccgaggcgtcggaccggtcggcggtcgacggacccgacggccgtccgcccccgtccggtacctaccgtccgtccgttccccgtcccc

SEQ ID NO: 11590 - DNA, 781 bp, Homo sapiens
  misc_feature: GYAE6OF01BSZHR.48.83.H06.1.454.CMB.1.raw
  modified_base (238)..(238): a, c, t, g, unknown or other
  misc_feature (238)..(238): n is a, c, g, or t
  modified_base (348)..(348): a, c, t, g, unknown or other
  misc_feature (348)..(348): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacgaggttccgtggcctcctatgagctgactcacgcccaccctcgagtcgtccgtcgtccccaggacagacagccagcatctcttgtttgactagtaagtgggganaaattgtgttgtgtatacaacgagaagccgaacggcctacgtcccgtgttgttcggtctacgtcgtagaaagacgtaacaacggccggtccacgacggacacgttcccgngtaacgcgtacgttcgtcgtcggacctaccgaacgttcgtacgggaacctacgtcgaccctaccgtcgaacctacgaccgggacgggaccctagggtccgttaggacgttggacggtacgtacgtaacgttactaccgtaacgttcggtaccggtacgggaccgggttaacggggaaccttaacgggaccctaaaacccggttccggttacgggtaacccgggttttaacgggggttttacccgggggggaacccggggggtacccgtaacgggttccgggtaccgggtaaccccggggtttcccgggaccgggttaacccggaaccccgggtacccggtaaccgggttccccgttaccccggggtacccccgttaccgggttcccgttaaaccccgtttccccggttccccggtttccccccggttaccccg

SEQ ID NO: 11591 - DNA, 661 bp, Homo sapiens
  misc_feature: GYAE6OF01AP2Q4.48.83.H06.1.454.CMB.1.raw
  modified_base (229)..(229): a, c, t, g, unknown or other
  misc_feature (229)..(229): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtcgtccccaggacagacagccagcatctctgtttgacataatgggganaatatgtttgtgtatcaacagaagcaggccacgtcccctggtgttggtcagttccgtagaagaactaaacaacggccggaccctcgacggcactccctgacgcgtacttcgtctggcctaccaactcgtaggaccacgtcgcccaccctagaccacgtaccggacggggacccagggtaccgttggatacggacggtcctacgtactactaccgacgtacgacggacggtcggtacggacgacgaccgaactacgtacggtccgttacgggtttaccgggggaccgggggaccgtacgggtcggtaccggtacccggggtcgggtaccgggtaccgtacccggtaccccgggtaaccggtcccggtaaccccgtccccccggttcgggttaccctacccggtttccccgttcccggttcccccgtccccccg

SEQ ID NO: 11592 - DNA, 783 bp, Homo sapiens
  misc_feature: GYAE6OF01E1OQ9.48.83.H06.1.454.CMB.1.raw
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcacgcccaccctcagtcgtccgtcgtccccgaggacagacacgccagctactccttccgttggttttacggaactaagttaaaggtgggggaataaattagttgttttggttaggtatacaaacgagaacgccgacggccacgttccccttggttgttcggtctacgttccggagtaagaactaaacgaacggccggtccctacgacggccacttcccgtaggacgtaccggtacttcgtccgtcggtccctacgtaaccttcggtacgggaacctacgtccgacccctacccgtacgaacccgtacgtaccggggaaccgggggaccccgtaacgggtccggttagggtacgtaggacggtacgtagtaaccttacgtacgtaccgttggtacggacggtcggtacgggaccaacggacccgtaacgaccgtacgggtaccggtttacggggtttaccgggggaccggggtaccggacgggtccggtacccgggtacccgggtccgggtacccgggtacccgacccgggaccccggtacgggccccggttaccccgggccccccgttacggggttaccccttacccggtttcccgtttcccccgttcccccgtacccccg

SEQ ID NO: 11593 - DNA, 672 bp, Homo sapiens
  misc_feature: GYAE6OF01D1G4Z.48.83.H06.1.454.CMB.1.raw
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (308)..(308): a, c, t, g, unknown or other
  misc_feature (308)..(308): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttgacataagtgggganaatntgttgttggtatacaacagaagccaggccagtcccctgtgttggtcatccgtgaagataacgaagccggccctnaggcatccctgagcgattctntggcctaccactccgtacgggaacacgtcgacccncctacgacccacgtccggaacgggggaccccaggtccgttaggagtcggaggccgttagaccttatacctacgtacggtcgacgggcggtacgggacgacgacgaaccaacgttcggtaccgttacggttttcccgggggaccggggggtaccgacgggtccgtaccggggtacccgggtccgggtacccggggttaccgaccgggtacccccggaaacgggtccccggttaccccggtaccccccccggtttcggggtacccgttaccccggtttccccgttccccgtttcccccgttacccccccg

SEQ ID NO: 11594 - DNA, 742 bp, Homo sapiens
  misc_feature: GYAE6OF01EC8EI.48.83.H06.1.454.CMB.1.raw
  modified_base (135)..(135): a, c, t, g, unknown or other
  misc_feature (135)..(135): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacnggttccgtggcctccgtatgagctgactcacgcccaccctcagtcgtcccgtcgtccccaggacagacacgccagcatcttccgttgtttgactagttaaggtggggaataattatgtttgttagtatacaacgtagacgccagccacgtcccgtgtgttgtcagtcgtagaagactaacgacgcgtccctacgaggccagtccctagacgacgtacttctcgtcgccctactacctcggtacggaactacgtccgaccctacccgtacgaccaacgtacggaaccggggtacccgtacgggtcccgtaggacgttaggacggtacgtaacggtaccttacgtaccgtacgttacggtacggtacgggtcgggttacgggaaccgtagaacccgtaaacggtacccggttacgggtaccgggtttaccgggttttaccggggggaacccgggggtaccgtacgggttcccggtaaccgggtacccgggtacccgggtccgggtaaccggtaacccggacccccggtaaacggtccccgtaacccggtcccccgttaccggttaccccgttaccgtttacccgttccccgttcccccgttaacccccg

SEQ ID NO: 11595 - DNA, 818 bp, Homo sapiens
  misc_feature: GYAE6OF01CUY95.48.83.H06.1.454.CMB.1.raw
  modified_base (130)..(130): a, c, t, g, unknown or other
  misc_feature (130)..(130): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttacngcacaggttccgtggcctctagtgagctgactcacgcccaccctcagtcgtccgtcgtccccaggacacgacacgccagctatccttccgtttaggttttcgaactaagttaaagggttaggggaaagtaaaagttgtttaggttttaggttacggtactaaacgaaacgtaacgaacgccgaacggtccctaccggttccccgttgggttacgttacggtactacggtttaccggtaagtaacgtaaacgttaaaaccgaccgggtacccggtcccgttaacggacggtaccacgtccccggtaggaccgtaccggttactttccggtaccgtacggttacccgttaacccgtacgtaaccgggttaacggaaacccttacccgggccctaaccccgttaccggtaaccacccggttaaaggtcccggggaacccgggtaacccgtaccggttacggtacggtaacggtcggtacggacgttaacgtacgtacgtacccgttaggacgttacggacgggtcggtaacgacgaacggtaaccaccgtaggtaccgggttcgttacgggtccggggtaacggtccgacgggtcgtccgggcccgggtcggccggtaccgaccggaaccgtcggtaccccgttcccgacccgttacggcttacccggttcccggtccctcccgttacccg

SEQ ID NO: 11596 - DNA, 794 bp, Homo sapiens
  misc_feature: GYAE6OF01BXCB6.48.83.H06.1.454.CMB.1.raw
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggccctctatgagctgactcacgcccaccctcagtcgtccgtcgtccccgaggacagacacgccagcactccttccgttgtttggaactaagttaaggttagggggaataaattgttggttttgttaggtactacaaacgagaacgccgacggacctacgttcccccgtggttggttcggtacctacgttccggtagaaagtaactaacgaacggcccggaccctacgacggcctacgtcccgtagacgtcgtacttccgtacgtcggtaccctacccgaacttccggtaacgggaacctaccgtaccgaccccacccgttacgacccctacgtaccgggacccgggggaacccgtacgggtccgttagggtacgtacgggtacggtccgtaacgtaccgttacgtacctacgtcgtacggtacggtacgggtacggaacgacgaaccgaacctacggtacggtaccggtttacgggtttacccgggggaccgggggaccggtaccgggtccggtacccgggtacccggggtccgggtacccgggtaccggtaccggaccccgggaaccgggtccccgtccccgggtccccccggttaccggtaccccgttacccgtttccccggttaccccgttcccccgttaacccccg

SEQ ID NO: 11597 - DNA, 695 bp, Homo sapiens
  misc_feature: GYAE6OF01A7YB0.48.83.H06.1.454.CMB.1.raw
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcacgcccaccctcagtcgtccgtcgtccccaggacagacagccagcatctcctgtttgactagtaagtggggataatagtgtttgtgtatacgaacagaacgccacggccacgtccccgtgtacgttcggtctacgtccgtagaacgtactaaacgacggccgtacctacgacggctacgtcccgtaggacgtcgtacttcctcgtcgcctacctaacgtcgtaacgggtaccactccgaccctaccgtacgtaccgacgttacccggggaccggggtaccctacgggtccgtagacggttacggacggtactacgtaccttacgtaccgtacgtcggtacgaggtccggtacggatacgcaacgtcgtcggtacggttaccgggtcggggaccgggtacgacggtccggtacggtacccggtccgggtacggtcccggaacccgtcccggtacgggtccccgtacccccgggttcccccgtacgggttcccctacccggtttccccgttcccccggttacccccgttccccg

SEQ ID NO: 11598 - DNA, 384 bp, Homo sapiens
  misc_feature: GYAE6OF01CLDWW.48.83.H06.1.454.CMB.1.raw
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (344)..(344): a, c, t, g, unknown or other
  misc_feature (344)..(344): n is a, c, g, or t
  modified_base (347)..(348): a, c, t, g, unknown or other
  misc_feature (347)..(348): n is a, c, g, or t
  modified_base (354)..(354): a, c, t, g, unknown or other
  misc_feature (354)..(354): n is a, c, g, or t
  modified_base (358)..(384): a, c, t, g, unknown or other
  misc_feature (358)..(384): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagcccaccctcagtcgtccgtcgtcccccaggacagacagccagcatctctgtttgacataagtgggganaatntgttgttggtatcaacagaagcaggccagtcccctgtgtggtcatccgtgaatataacagccgcctcgaggccatcccgtgacgcgggctggcaagggcgacagtancannagctgntagnnnnnnnnnnnnnnnnnnnnnnnnnnn

SEQ ID NO: 11599 - DNA, 684 bp, Homo sapiens
  misc_feature: GYAE6OF01EPEON.48.83.H06.1.454.CMB.1.raw
  modified_base (186)..(186): a, c, t, g, unknown or other
  misc_feature (186)..(186): n is a, c, g, or t
  modified_base (220)..(220): a, c, t, g, unknown or other
  misc_feature (220)..(220): n is a, c, g, or t
  modified_base (425)..(425): a, c, t, g, unknown or other
  misc_feature (425)..(425): n is a, c, g, or t
  modified_base (646)..(646): a, c, t, g, unknown or other
  misc_feature (646)..(646): n is a, c, g, or t
tcagagtatacatacacgaccggtgctcgatttagatcacgtgcgtcgcggggctgggcctcaggaagcagcatcggaggtgcctcagccatggcatggatccctctccttcctcggcgtccttgcttactgcacgtaggttccgtcggcccttcctagtgagctagacacacgcccaccctggtntcagtcgcccaggacacgacggcaggatcacgtnctctgcaagacgtacgttcgactaacgttacttaagttttttggttttaggactcaaggacgtaagaagtcgaacggccgaaccggaccccaagtccctggtacctcgtaagttagtagtaacgaacggtacgtaggtaggtaacgtaccggtccgttacggacgggttaccctccggtaaggtccgtaccgttacgtttacccncgggttccgtccctaccgtagtacccggttacggtacgggaaaccaccctaacgttccgtaacgttcctaacgtaaccgttacgtaccgtaggacggggtaaccggtcgggaacgtaaggacgggtacgagtacgtacttacgtatacgttgacgttacgagacggtaacataacgtcgacgatacggaacttagtaggttccggtacgggaggaaccggnaaccgtcacgcggttacgtaccgagccgaaggtacccg

SEQ ID NO: 11600 - DNA, 703 bp, Homo sapiens
  misc_feature: GYAE6OF01BTOOB.48.83.H06.1.454.CMB.1.raw
  modified_base (174)..(174): a, c, t, g, unknown or other
  misc_feature (174)..(174): n is a, c, g, or t
  modified_base (231)..(231): a, c, t, g, unknown or other
  misc_feature (231)..(231): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcacgccaccctnagtcgtccgtcgtccccaggacagacagcagcatctctgttgactataagtgggganaatgtgttgtgatcaacgagacgcaggcctacgtccctagtcgtgtctagtccgtagaacgactaaacgacgccggtacctagacggtcacgtccctagacgtcgtacttctcgtacgtactaccgtaactcgacgggtaactccgtcgaccctaaccgtcgaacctacgtaccgggaccgggacccgaggtccggtagtacgtaggacgtaccgtacgtaccgtacgtaccgtacgtacggtaccggacgggtacgggttacgggaaccgttaacgaccgtaaaccgtaccgtacggtaccgggttaaccgggttttaccggggggaccggggttaccgaaccgggtccggtaacgggtaccccgggtcgggtacccggtacgacccggtaacccggtacgggtccccgtaccccgtccccggttaccgtacccgtacccgtttccggttccccgttccccgttacccccg

SEQ ID NO: 11601 - DNA, 327 bp, Homo sapiens
  misc_feature: GYAE6OF01B14DL.48.83.H06.1.454.CMB.1.raw
  modified_base (112)..(112): a, c, t, g, unknown or other
  misc_feature (112)..(112): n is a, c, g, or t
  modified_base (272)..(327): a, c, t, g, unknown or other
  misc_feature (272)..(327): n is a, c, g, or t
tcagagtatacatacacgaccggtgctcgatttagatcacgtgcgtcgcggggctgggcctcaggaagcagcatcggaggtgcctcagccatggcatggatcctctcttccncggcgtccttgcttatgcactggttccgtgcctcctatgagctgactcacgcccaccctgagtccgtccgtccgtcccaaggacagacgacgcctaagctaacgtcctcgttgtttagaactaagttaaaggtggggaataaattgttggttagtagtannnnnnnnnnnnnnnnnnnnnnnnnnnnnnnnnnnnnnnnnnnnnnnnnnnnnnnn

SEQ ID NO: 11602 - DNA, 805 bp, Homo sapiens
  misc_feature: GYAE6OF01DCZCL.48.83.H06.1.454.CMB.1.raw
tcagagtatacatacacgaccggtgctcgatttagatcacgtgcgtcgcggggctgggcctcaggaagcagcatcggaggtgcctcagccatggcatggatccctctcttcctcggcgtccttgcttactgcacacggttccgtggcctcctatgagctgactcacgccaccctcagttcgtcccgtcgtccccgaaggacagacgacgccagctactccttccttgttttacggactaagttaaagttgggggaataaagtattggtttggttaggtatacaacgtaagaacgccgacgacctacgtccccgtggttcggttcggtacacgttccgtagaacgtacgtaacgaaccggccggccctacgaacggtctactcccgtaggacgtcgtacttcgtaccgtcgtacctaccgtaccgtcgtacgggtaacctacgtaccgaccccgtacccgtacgaaccgtacggtaccggggaaccggggtaccccgtacgggttacccgttacgggtaacgtacgggtacggtaccgttacgtaaccgtttacgacggtaacccggttcgtaccgggtacgggtacggttaccgggacacggtaacctaacgtacggtacggttacggttaccggggttaccgggggacggggaccggtacggtccggtaccgggtacccgggttccgggtaccgtaccgggaaccgggtaaccccggtacgggtcccggttaccccggtcccccggtttaaccggtaccccgttaacccggttttcccgttccccgttttaccccctaccccgg

SEQ ID NO: 11603 - DNA, 517 bp, Homo sapiens
  misc_feature: GYAE6OF02G6RRQ.48.83.H06.1.454.CMB.1.raw
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcaggggacccaggccttggatgaggctgactatcactgtcaggcgtgggacagcaacactgcgagtttcgggcggggaccagggcgtgaccgtcggcggtcgacgcccgaaggcctcgccccgtcggtccaccgtctcgtccctacccg

SEQ ID NO: 11604 - DNA, 552 bp, Homo sapiens
  misc_feature: GYAE6OF02GCA33.48.83.H06.1.454.CMB.1.raw
  modified_base (233)..(233): a, c, t, g, unknown or other
  misc_feature (233)..(233): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggganaaatatgtttgttggtatcaacagaagccaggccagtcccctgtgttggtcatccgtgaagataacaagcggccctcaggcatcccctgagcgattctctggctccaactctagggaacactgcccaccctgacccagtcgacggggacccacggccttgggatggaggctgactatcactgtcaggcgtgggacagcaacgactgcgtagttttcgggccgggggaccgacgggcgtcggaccggtcgggccgggtcgacggacccgaacggccgtccgccccgtcggtccgtaccgtccgttccgtccccgtccccg

SEQ ID NO: 11605 - DNA, 539 bp, Homo sapiens
  misc_feature: GYAE6OF02H9P98.48.83.H06.1.454.CMB.1.raw
  modified_base (234)..(234): a, c, t, g, unknown or other
  misc_feature (234)..(234): n is a, c, g, or t
  modified_base (309)..(309): a, c, t, g, unknown or other
  misc_feature (309)..(309): n is a, c, g, or t
  modified_base (329)..(329): a, c, t, g, unknown or other
  misc_feature (329)..(329): n is a, c, g, or t
  modified_base (348)..(348): a, c, t, g, unknown or other
  misc_feature (348)..(348): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgctttactgcacaggttccgtggcctcctatgagctgactcagccaccctcagtgtccgtgtccccaggacagacagccagcatctcctgttttggacataaattgggganaaatatgtttgttggtatcaacagaagccaggccagtcccctgtgttggtcatccgtgaagataacagcggcctnaggcatccctgagcgattcnctggctcaactctggaacnctgcccaccctgacctagtcgacggggacccacggccgttggagtgacggctagactatcactgtcgaggtcgtgggacagcaacactgcgtagtttcgggcgggggacaggcgtcggaccggtcggcggtcgacggcccgaacggccgtcggccccgtcggtccgaccgtccgtccgttccccgtccccg

SEQ ID NO: 11606 - DNA, 537 bp, Homo sapiens
  misc_feature: GYAE6OF02H7C27.48.83.H06.1.454.CMB.1.raw
  modified_base (231)..(231): a, c, t, g, unknown or other
  misc_feature (231)..(231): n is a, c, g, or t
  modified_base (348)..(348): a, c, t, g, unknown or other
  misc_feature (348)..(348): n is a, c, g, or t
  modified_base (431)..(431): a, c, t, g, unknown or other
  misc_feature (431)..(431): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttgacataaattgggganaatatgtttgttggtatcaacagaagccaggccagtcccctgtgttggtcatccgtgaagataacaagcggccctcaggcatccctgagcgattctctggctccaactctgggaacncgtgcccacctgaccagtcgaggggacccaggccttggatggaggctggactatacacgtgtcagggcgtgggacagcgaacnctgcgtagttttcgggcggggtacaggctcggaccgtcggacggtcgacgccgaacggtcgtccggcccccgtcggtccctacgtccgttccgttccccgtccccg

SEQ ID NO: 11607 - DNA, 524 bp, Homo sapiens
  misc_feature: GYAE6OF02FKC8S.48.83.H06.1.454.CMB.1.raw
  modified_base (232)..(232): a, c, t, g, unknown or other
  misc_feature (232)..(232): n is a, c, g, or t
  modified_base (307)..(307): a, c, t, g, unknown or other
  misc_feature (307)..(307): n is a, c, g, or t
  modified_base (348)..(348): a, c, t, g, unknown or other
  misc_feature (348)..(348): n is a, c, g, or t
  modified_base (427)..(427): a, c, t, g, unknown or other
  misc_feature (427)..(427): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttggacataaattgggganaatatgtttgttggtatcaacagaagccaggccagtcccctgtgttggtcatccgtgaagataacaagcggcctnaggcatccctgagcgattctctggctccaactctaggaacnctgccaccctgacccatcgacggggacccaggccgttggatgaggctgactatcactgtcgaggcgtggacagacaacncgtgcgtagtttcgggcggggacagggctggaccgtcggccggtcgacggcccgacggccgtcgccccgtcggtccaccgtctccgtccctaccccg

SEQ ID NO: 11608 - DNA, 683 bp, Homo sapiens
  misc_feature: GYAE6OF02H0BMP.48.83.H06.1.454.CMB.1.raw
  modified_base (236)..(236): a, c, t, g, unknown or other
  misc_feature (236)..(236): n is a, c, g, or t
  modified_base (255)..(255): a, c, t, g, unknown or other
  misc_feature (255)..(255): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctccttgtttggacataaagttgggggaanaaatatgtttgttggtatnaacagaagcagcagtcccctgtgtgtcatccgtgaagataacaagcgcctcgaggcactcctgagcgtattctcgtggcctaccaacctcgtacgggaacacgtacgccaccccgtgaaccctacgtaccggaacggggaccccgacggtacccggttaggacggtaggacggtacgtacggtaaccttaagtacctaaccgttacgtacgtacgggtacggggtacgggaacgaacgaccgtaaaccgtaccgtacggtacggttacggtttttccgggggaaccgggggggtacccgtaaagggccgtacgggtacccgggttccgggaccgggttaccgaccggtacccgaaacgggtaccgttcccggacccccggttcccggtacctaccccggttacctttcccgtcccccgttaacccccg

SEQ ID NO: 11609 - DNA, 555 bp, Homo sapiens
  misc_feature: GYAE6OF02IIM4R.48.83.H06.1.454.CMB.1.raw
  modified_base (235)..(235): a, c, t, g, unknown or other
  misc_feature (235)..(235): n is a, c, g, or t
  modified_base (312)..(312): a, c, t, g, unknown or other
  misc_feature (312)..(312): n is a, c, g, or t
  modified_base (437)..(437): a, c, t, g, unknown or other
  misc_feature (437)..(437): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaagttggggganaaatatgtttgttggtatcaacagaagccaggccagtcccctgtgttggtcatccgtgaagataacaagcggccctnaggcatccctgacgcgattctcgtggcctccaactcgtagggaactactcgccctaccctgacccagtcgacgggggacccaggccgttggatgaggctgactatctactgtcgaggcgtggacngcaacgctgacgtacgtttcgggcggggaccagggcgtcggaccggtcgggcggtcacggcccgaacggtccgtccggcccccgtcggtccaccgttccgttccgttcccctaccccg

SEQ ID NO: 11610 - DNA, 595 bp, Homo sapiens
  misc_feature: GYAE6OF02HK9EG.48.83.H06.1.454.CMB.1.raw
  modified_base (232)..(232): a, c, t, g, unknown or other
  misc_feature (232)..(232): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttggacataaattgggganaaatatgtttgttggtatcaacagaagccaggccagtcccctgtgttggtcatccgtgaagataacaagccgcctcaggcatcccgtgagcgattctctggcctccaactcgtacgggaactctcgacccacccgtgacccagtcgaacgggggaccccaggtccgttggacgtgaggtctaggactatcacgtgtcgagggcgtcgggacagacaacgactacgcgtacgttttccggggacgggggtaccgacgggcgtacggacccggtcgggtccgggtcaccggacccggaacggtccgtacccggcccccgttaccggtacccgtacccgttccgttcccggttacccccgtccccg

SEQ ID NO: 11611 - DNA, 567 bp, Homo sapiens
  misc_feature: GYAE6OF02F02IO.48.83.H06.1.454.CMB.1.raw
  modified_base (232)..(232): a, c, t, g, unknown or other
  misc_feature (232)..(232): n is a, c, g, or t
  modified_base (307)..(307): a, c, t, g, unknown or other
  misc_feature (307)..(307): n is a, c, g, or t
  modified_base (316)..(316): a, c, t, g, unknown or other
  misc_feature (316)..(316): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttggacataaattgggganaatatgtttgttggtatcaacagaagccaggccagtcccctgtgttggtcatccgtgaagataacaagcggcctnaggcatccngagcgattctctcggctaccaacttcacgggaacactcgcccaccctgaccagtcgacggggacccacggtccttggagtggacggcgtgtactatcacgtgtcgagggtcgtggacgagacaacacgtgcgtagtttcgggacggtacggaccgacgccgtcgtaccggtccgtaaggttaccacggtacccgaaggtcccgtaccggcccccgttaccggtccacccgttccgtcccggtttacccccc

SEQ ID NO: 11612 - DNA, 660 bp, Homo sapiens
  misc_feature: GYAE6OF02HJWXY.48.83.H06.1.454.CMB.1.raw
  modified_base (230)..(230): a, c, t, g, unknown or other
  misc_feature (230)..(230): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttgacataagtgggganaatatgtttgttggtatcaacagaagcaggccagtcccctgtgttggtcagtccgtgaagataacgaagccgccctcgaggcatcccgtgacgcgtattctctggcctccaactcgtagggaaccacgtcgccctacccgtgaacccagtaccggacggggaccccgtacggcccgtttagggacttgggaacggtccgtacgaaccttacgttccgtaaccgttcggtacgacgggtcggtacgggaacctaacggaccgtaacgaccgtgtaccggttacggtttccgggggaccggggggtaccacgggtacgtaccgggtacccgggtcgggtaccgggtaccgaaccggacccgtaacgggtccgtaccccggtcccccggttacggtcccgtaccgttccgttcccggttcccccgtacccccg

SEQ ID NO: 11613 - DNA, 791 bp, Homo sapiens
  misc_feature: GYAE6OF02G66Y3.48.83.H06.1.454.CMB.1.raw
  modified_base (232)..(232): a, c, t, g, unknown or other
  misc_feature (232)..(232): n is a, c, g, or t
  modified_base (287)..(287): a, c, t, g, unknown or other
  misc_feature (287)..(287): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgtttgacataaagttgggganaatatgttgttggtatcaacagaagccaggccacgtccctgtgttggcagtccgngaagataacgaagccgccctcaggcactcccgtgacgtcgtacttctcgtcggccttaccaaacgtcgtacgggaaactaccgtcgcccctaacccgtgaacccctaacgttaccggaacgggggtaaccccgacgggtacccgtttacgggacgtacgggaacgggtacgttacggtaaccttaacgttaccgtaaccgttacggtaccggtacggggtaccgggttacggggaaccgtaacggaacccgtaaacccgtaaccggttacggtaccgggttaccgggtttttacccggggggaccgggggggtaacccgtaacggggtaccggttaccgggtacccggggttccggggacccgggttaacccggaacccggtaccccgggtaaaccggggtaccccggttaccccgggtacccccccggtttaccccggggttaccccgttaaccccggtttaccccggtttaccccggtttacccccccgttaacccccccgg

SEQ ID NO: 11614 - DNA, 622 bp, Homo sapiens
  misc_feature: GYAE6OF02J1AWT.48.83.H06.1.454.CMB.1.raw
  modified_base (234)..(234): a, c, t, g, unknown or other
  misc_feature (234)..(234): n is a, c, g, or t
  modified_base (238)..(238): a, c, t, g, unknown or other
  misc_feature (238)..(238): n is a, c, g, or t
  modified_base (256)..(256): a, c, t, g, unknown or other
  misc_feature (256)..(256): n is a, c, g, or t
  modified_base (268)..(268): a, c, t, g, unknown or other
  misc_feature (268)..(268): n is a, c, g, or t
  modified_base (283)..(283): a, c, t, g, unknown or other
  misc_feature (283)..(283): n is a, c, g, or t
  modified_base (287)..(287): a, c, t, g, unknown or other
  misc_feature (287)..(287): n is a, c, g, or t
  modified_base (296)..(296): a, c, t, g, unknown or other
  misc_feature (296)..(296): n is a, c, g, or t
  modified_base (311)..(311): a, c, t, g, unknown or other
  misc_feature (311)..(311): n is a, c, g, or t
  modified_base (320)..(320): a, c, t, g, unknown or other
  misc_feature (320)..(320): n is a, c, g, or t
tcagagtatacatacacgaccggtgctcgatttagatcacgtgcgtcgcgggctgggcctcaggaagcagcatcggaggtgcctcagccatggcatggatccctctcttcctcggcgtccttgcttactgcacaggttccgtggcctcctatgagctgactcagccaccctcagtcgtccgtcgtccccaggacagacagccagcactctccttgtttgacataagttgggganaatntgttgtgtatcaacagancagccagtcccngtgtgcatccgagantaanagcgacctnacggcactcctgacncgtacttcncgtcggctaccgaactcgtacggaactacgtccggcccaaccctgacccagtaccggaacggggacccctagggtacccgttagggacgtggaacggtcgtaagtaccgtactccgtaccgttgtacgacggtaggtacggacgacggtacaaccgtacgtcgtacgggttacgtttcggggacccggggtacgtacggtccgtaccgggaccggttcggtaccgggtcgaaccggtccgaacggtacccgtccgtcccccggtcggtccctacggtccgttacccgtttccccgtaccccg

SEQ ID NO: 11615 - DNA, 780 bp, Homo sapiens
  misc_feature: GYAE6OF02I03J0.48.83.H06.1.454.CMB.1.raw
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctccatgagctgactcagccaccctcagtgtccgtgtccccaggacagacagccagcatctcctgtttcggacataaacgttgggggaagaaatatgtttgttggtatctaacagaagccaggccacgtccccgtgtcgtggtcagtccgtgaagaataaaacgccggaccctcgacggcacgtccctgacgcgtattacctctcgggctaccgaaccttcgacgggtaaactacctcgacccctaacccgtcggaccctaacggttaccggaacgggggggtaaccccccaacggggtcccgttttacgggaacggttacgggaaccgggttacgtaccggtaaccttaacgtacccgtaacgttcgggtaccgtacgggggtaccggttcggggaaaccgacgggtaacccgtaaaccgtaaccggtttaccgggtaccgggtttacggggttttacccggggggaaccgggggggtaacctaaccggggttacccgtaccgggtacccggggtacgggtaacccggtcccggtaaccggtaccccgaagggtccccgtaccgggtccccccgttaacggggtccctacgtttaccccggttccggtttaccccccggacccctttacccgg

SEQ ID NO: 11616 - DNA, 529 bp, Homo sapiens
  misc_feature: GYAE6OF02F3DNN.48.83.H06.1.454.CMB.1.raw
  modified_base (233)..(233): a, c, t, g, unknown or other
  misc_feature (233)..(233): n is a, c, g, or t
  modified_base (320)..(320): a, c, t, g, unknown or other
  misc_feature (320)..(320): n is a, c, g, or t
  modified_base (347)..(347): a, c, t, g, unknown or other
  misc_feature (347)..(347): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggganaatatgttgttggtatcaacagaagccaggccagtccccctgtgttgtcatccgtgaagataacaagcgcctcaggcatccctgagngattctctggctccaactctgggaacnctgcccaccctgaccatcgagggggacccaggccttggatggaggctgactatcactgtcaggcgtgggacagacaacactgcgtagttttcgggcggacgggaccgagcctggaccgtccgtaagggtccacgcccgacggcctccgtccccgtccggtacctccgtccgtccgttccccc

SEQ ID NO: 11617 - DNA, 630 bp, Homo sapiens
  misc_feature: GYAE6OF02GHO6S.48.83.H06.1.454.CMB.1.raw
  modified_base (234)..(234): a, c, t, g, unknown or other
  misc_feature (234)..(234): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataagttggggganaaatatgtttgttggtatcaacagaagccaggccagtcccctgtgttgtcatccgtgaagataacaagcgccctcaggcatcctgagcgattctctggcctaccaactcgtacgggaacactcgacccaccctgacccagtcgacgggggacccacgggtccgttggatcggacggcgttacgaccttacgtcctaacgtcggtacgagggtcggtacgggacacgaccaacgacgtcgacggttacggttttccggggaccgggggtaccgacgggtcgtaccggtacccggtccgggtccggtccgaaccggaccccggtaacgggtcccgtcccggtacccccggttcgggtacccgtacccgttccgtttacccgttccccgttaacccccg

SEQ ID NO: 11618 - DNA, 684 bp, Homo sapiens
  misc_feature: GYAE6OF02FH7V2.48.83.H06.1.454.CMB.1.raw
  modified_base (232)..(232): a, c, t, g, unknown or other
  misc_feature (232)..(232): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagccatctcctgtttggacataattgggganaaatatgtttgttggtatcaacagagccaggccagtcccctgtcgttgtcatccgtgaagataacaagcggccctcaggcatcccctgagcgattctctggctccaactctagggaaccactcgacccaccctgaccctagtaccgacggggacccgacggtcccgttaggacgttcggacgggtcctagtacctactccgtacttcggtacgacgggccggttcgggacgacggaccaaaccgtacgtacggtaccggttaacgtttttaccgggggacccgggggtaacccggtacgggtaccgtaccgggtacccggttacccggggtaccgggttacccggtaaccgggacccccggtaacgggtacccgttacccggtcccccccggttaccgggttaccccgtacccgttcccggttacccggtttaccccccttaacccccccgg

SEQ ID NO: 11619 - DNA, 689 bp, Homo sapiens
  misc_feature: GYAE6OF02HRTN0.48.83.H06.1.454.CMB.1.raw
  modified_base (232)..(232): a, c, t, g, unknown or other
  misc_feature (232)..(232): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctccttgtttgacataagttgggganaatatgtttgttgtatcaacagaagcaggccagtcccctgtgttggtcatccgtagaagataacgagccggcctacgaggccactcccgtagacgacgtattcctcgtcggcctaccaacgtcgtacggaactactcgaccaccctcgaccacgtacgacggggacccgacggtccgttaggacgtaggacggtacgtacggtaacgtaactaccgtaacggtttcggtacggacgggtaccgggttacggggaaccgtaacggaaccgaaacgtaaccgtcggtaaccggttaccgggttttaccgggggacccggggggtaaccgtaacgggcgttaccgggtacccgggttaccggggtccgggtacgtaccggacccggtaacggtacccgtacccggcccccggttaccggtcccgttacccggttccgttcccggttacccccgtcccccg

SEQ ID NO: 11620 - DNA, 527 bp, Homo sapiens
  misc_feature: GYAE6OF02FWSAV.48.83.H06.1.454.CMB.1.raw
  modified_base (234)..(234): a, c, t, g, unknown or other
  misc_feature (234)..(234): n is a, c, g, or t
  modified_base (350)..(350): a, c, t, g, unknown or other
  misc_feature (350)..(350): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagatgactcagccaccctcagtgtccgtgtccccaggacagacagccagcatctcctgttttggacataaattggggganaaatatgtttgttggtatcaacagaagccaggccagtcccctgtgttggtcatccgtgaagataacaagcggcctcaggcatccctgagcgattctctggctccaactctggaacnctgcccacctgacccatccgaggggacccaggcctggatgagtctgactatccactcgtcaggcgtgggacagcaacactgcgtagtttcgggcggggacgaggtcgtcgccggtacggcggtcgacgtcccgaaggcctcggccccgtcggtccacgtccgtcgtccccgtccccg

SEQ ID NO: 11621 - DNA, 798 bp, Homo sapiens
  misc_feature: GYAE6OF02GABHW.48.83.H06.1.454.CMB.1.raw
  modified_base (233)..(233): a, c, t, g, unknown or other
  misc_feature (233)..(233): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccggtcgtccccaggacagacagccagcatctctgtttggacataagttgggganaatatgtttgttggtatcaacagaagccaggccagtcccctagtgttggtcatccgtagaagataacaagccggccctacgaggctacgtccctggacgcgtattcctagttcgggcctaccgaacttcggtaggggaaacctacgttcgacccctacccgtagaacccctagtaccggaaccggggggaaccccacggggtcccgttagggacgttcgggaggtaccgtacggtaaccgttacgtaccgtacgttcggttacggaccgggttacgggttacggggaccacggtaacccgaaaccgttacggtaccgggtaccggtttaccggggtttttaaccggggggacccggggggggtaacccgtaaggggtacccggttacccggggtacccgggttaccgggggacccggggtttacccggaaccgggtaacccccgggtaaacggggttcccccgttaccccgggtaccccccccgggttttaccggggttacccgttaacccccggttttccccggttttaccccgggttacccccccttttaaaccccccccggg

SEQ ID NO: 11622 - DNA, 699 bp, Homo sapiens
  misc_feature: GYAE6OF02HK0TZ.48.83.H06.1.454.CMB.1.raw
  modified_base (234)..(234): a, c, t, g, unknown or other
  misc_feature (234)..(234): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacacgccagcatctccttgtttggacataaagtgggganaatatgtttgtgtatcaacagaagccagcctacgtcccctgtgttgtcagtccgtagaagataacagccgacctgacggcacgtccagagctattcctgcggtcctaccgaactcgtacggaacctacgtcgacccaccgtgaaccctacgtacgggaccggggacccgacggtacccgttagggacgtacggaggtctaaggaccttacgtccgtaaccggttgtaccggacgggtacgggtaccgggaacgtacgaaccgtaactaccggtcggaaccggttaccgggtttaccgggggaaccggggggtaaccgacggggtacccgtaccgggtacccgggttacgggacccgggttccgaacccgggacccgggtaaacgggtccccggtaccccggtacccccggttaccggtacccgttaccccggtttaccgttcccggttacccccgttaacccccg

SEQ ID NO: 11623 - DNA, 718 bp, Homo sapiens
  misc_feature: GYAE6OF02IM0RO.48.83.H06.1.454.CMB.1.raw
  modified_base (233)..(233): a, c, t, g, unknown or other
  misc_feature (233)..(233): n is a, c, g, or t
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (329)..(329): a, c, t, g, unknown or other
  misc_feature (329)..(329): n is a, c, g, or t
tcagagtatacatacacgaccggtgctcgatttagatcacgtgcgtcgcggggctgggcctcaggaagcagcatcgggaggtgcctcagccatggcatggatccctctcttcctcggcgtccttgcttactgcacaggttccgtggcctcctatgagctgactcacgccaccctcagtgtccgtgtccccaggacagacagccagcatctccttgtttgactataagtggganaatntgttgtggtatcaacagaanccgaggccacgtcccgtgtgttggtcagtccgtgaagataacgaacgccggccctgacggcctacgtcccgngacgcgtaactttctcgtcggtcctaccgtaacttcggtacgggtaaacctaccgttaccgacccctaacccgttacgaaccccgtaacgtacccggggtaacggggggacccccctaagggtcccgttaacgggacgttacggacgggtacctacggtacgttaactaccgttacggttacgtacggtacgggtcggttaacgggaaccgagacccgtaaacgacgtacggtaccgggtttaacgggtttaccgggggaccgggggggtacccacggggtacgtccgggtacccggtacggggccgtacccgggtaacgcccggtaacggtcccgtacccggtccccgtaccggttccgtacccggtcccttccgtccccctaccccg

SEQ ID NO: 11624 - DNA, 662 bp, Homo sapiens
  misc_feature: GYAE6OF02JF1SS.48.83.H06.1.454.CMB.1.raw
  modified_base (134)..(134): a, c, t, g, unknown or other
  misc_feature (134)..(134): n is a, c, g, or t
  modified_base (174)..(174): a, c, t, g, unknown or other
  misc_feature (174)..(174): n is a, c, g, or t
  modified_base (200)..(200): a, c, t, g, unknown or other
  misc_feature (200)..(200): n is a, c, g, or t
  modified_base (527)..(527): a, c, t, g, unknown or other
  misc_feature (527)..(527): n is a, c, g, or t
tcagagtatacatacacgaccggtgctcgatttagatcacgtgcgtcgcgggctgggcctcaggaagcagcatcggaggtgcctcagccatggcatggatccctctcttcctcggcgtccttgcttactgcacnggttccgtggcctcctatgagctgactcagcccaccctcngtcgtccgtcgtccccaggacagacngccagcatctcttgtttcgatagtaagtgggataatgttgtttgtgtactcgaaagtacgaacgtccgaacggcctacgtccccgttgttgttacgtcacgtccgagaagtacaacgacggccgcccgtagacggctaaccgtccgagtagtaccgtacttcgtcgcgtacctaccacgtacgtacgggaacctagtacccgccctaccgtaccgccgtaacgtccgggacccggggtaccctacgggtccgttacgcgggtacgtaggtcccgttaactacctaccgtcgttacgtaccgtcgggaacgggccgtacgaaccgtanaaccgacgtacgtcggtacggtttacggtccggggacgggtacgacggttaccgaccggtacggacgcggtccgaacggaccgtcgtacccggtccgccctcggcccttacgcccgtttccccggacttccccgg

SEQ ID NO: 11625 - DNA, 635 bp, Homo sapiens
  misc_feature: GYAE6OF02G5MR6.48.83.H06.1.454.CMB.1.raw
  modified_base (237)..(237): a, c, t, g, unknown or other
  misc_feature (237)..(237): n is a, c, g, or t
  modified_base (257)..(257): a, c, t, g, unknown or other
  misc_feature (257)..(257): n is a, c, g, or t
  modified_base (284)..(284): a, c, t, g, unknown or other
  misc_feature (284)..(284): n is a, c, g, or t
  modified_base (288)..(288): a, c, t, g, unknown or other
  misc_feature (288)..(288): n is a, c, g, or t
  modified_base (302)..(302): a, c, t, g, unknown or other
  misc_feature (302)..(302): n is a, c, g, or t
  modified_base (311)..(311): a, c, t, g, unknown or other
  misc_feature (311)..(311): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (323)..(323): a, c, t, g, unknown or other
  misc_feature (323)..(323): n is a, c, g, or t
  modified_base (351)..(351): a, c, t, g, unknown or other
  misc_feature (351)..(351): n is a, c, g, or t
tcagagtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcacgcccaccctcagtcgtccgtcgtccccaggacagacagccagcatctccttgtttgacagtaagttgggganaatagtgttgtggtatcaanagaagccaggccagtccctgtgtgtcntcgngagatacagcgccnagcactccngngcgnttctcngcctctactcgtacggaacactcacccncctacgacctacgtcgggaccggggacccgacgggtccgtagggtacgtaggacggctacggtactactacgtaacgttcggtacgcgggtacgggtaccggacgagtaccaacgtccgtacggtacggttacggtttccggggaccggggggtaccaccggggtacgtaccgggacccggttccgggtacggtacggtacccggacccggtaacgggtacccgtcccggtccccccggttacggtacccgtacccgttccgttcccgttaccccctaaccccg

SEQ ID NO: 11626 - DNA, 692 bp, Homo sapiens
  misc_feature: GYAE6OF02I1F7X.48.83.H06.1.454.CMB.1.raw
  modified_base (157)..(157): a, c, t, g, unknown or other
  misc_feature (157)..(157): n is a, c, g, or t
  modified_base (164)..(164): a, c, t, g, unknown or other
  misc_feature (164)..(164): n is a, c, g, or t
  modified_base (491)..(491): a, c, t, g, unknown or other
  misc_feature (491)..(491): n is a, c, g, or t
  modified_base (529)..(529): a, c, t, g, unknown or other
  misc_feature (529)..(529): n is a, c, g, or t
  modified_base (536)..(536): a, c, t, g, unknown or other
  misc_feature (536)..(536): n is a, c, g, or t
  modified_base (545)..(545): a, c, t, g, unknown or other
  misc_feature (545)..(545): n is a, c, g, or t
  modified_base (558)..(558): a, c, t, g, unknown or other
  misc_feature (558)..(558): n is a, c, g, or t
  modified_base (576)..(576): a, c, t, g, unknown or other
  misc_feature (576)..(576): n is a, c, g, or t
tcagagtatacatacacgaccggtgctcgatttagatcacgtgcgtcgcgggggctgggcctcaggaagcagcatcggaggtgcctcagccatggcatggatccctctcttcctcggcgtccttgcttactgcacaggttccgtggcctcctatganctgactnagcccacctcagtgtccgtcgtccccaaggacagacacgcctagacctactccttccgttaggtttttacggaacgtaattaaaaggttggggggaataaaaacttgttaggtttttggttagggttacttaccgaaagaacggtaaacgtccccgagggccccgtaaccggttccccgttacgggttaggttccggtaccgtacggttcccgtaaggaacgtaagtaacgaaacgccggtccctacgacggtaccgtactcccgtagacgcggtactcgtcgtcgtctaccagtacgtacggactacgtcgcccacctgacctacnccgggacggccgagcgtacggaatcgagtcgagactanctacgtnacgagtcgngacgacagaacgngcgtcggtagtcccgggnggggaccgtacgggtcgtcggtacggtaccgggccggtaagccggaaccggtaacccggcgttacccggccccggtacggtcctaaccggtcccgttccgtaccccccgttacccg

SEQ ID NO: 11627 - DNA, 729 bp, Homo sapiens
  misc_feature: GYAE6OF02HLI6Y.48.83.H06.1.454.CMB.1.raw
  modified_base (246)..(246): a, c, t, g, unknown or other
  misc_feature (246)..(246): n is a, c, g, or t
tcagagtatacatacacgaccggtgctcgatttagatcacgtgcgtcgcggggctgggccgtcaggaagcagcatcggaggtgcctcagccatggcatggatccctctcttcctcggcgtccttgcttactgcacaggttccgtggcctctatcgagcctgactcagccaccctcagtgtccgtcgtccccaggacacgacacgccagcatctaccttgtttcgacataagttggggaagtaaatnttgtttgttaggtataccaactagaagtccaacggcctacgtccccgtaggtacgttcggttcagttccggtacgaagaacttaaccgaagacccggaccctagaaccgggtccacgttacccctcggacggtacgttactttccgtacgtccgggtacctacccgtaacgttccggtacggaaacctacgtcgtaccccgtacccgtcgaaccctcgtacgggaccggggaccccgtacggtaccccggttaggacttaggacgggtactacggtaacttacgtacttacgtacggtacggtacgggcggttcggaaaccgcgtaacggtaaccctacggtacggtaccggttacggtttccgggggaacgggggtacctacggggtccctagggtaccccgacggtaccgggtacaccggtaccgaacggtccgtaccggtccccgtacgtccgacccttcggtacccttaccctacccgg

SEQ ID NO: 11628 - DNA, 249 bp, Homo sapiens
  misc_feature: GYAE6OF01BE8OG.16.5.A05.1.454.CMB.1.raw
  modified_base (246)..(249): a, c, t, g, unknown or other
  misc_feature (246)..(249): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgccatctgagagtagtacactgagcgggctggcaaggcgcatagnnnn

SEQ ID NO: 11629 - DNA, 248 bp, Homo sapiens
  misc_feature: GYAE6OF01A8DA8.16.5.A05.1.454.CMB.1.raw
  modified_base (246)..(248): a, c, t, g, unknown or other
  misc_feature (246)..(248): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgccatctgagagtagtacactgagcgggctggcaaggcgcatagnnn

SEQ ID NO: 11630 - DNA, 250 bp, Homo sapiens
  misc_feature: GYAE6OF01B5IG0.16.5.A05.1.454.CMB.1.raw
  modified_base (246)..(250): a, c, t, g, unknown or other
  misc_feature (246)..(250): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgccatctgagagtagtacactgagcgggctggcaaggcgcatagnnnnn

SEQ ID NO: 11631 - DNA, 250 bp, Homo sapiens
  misc_feature: GYAE6OF01ATZ8J.16.5.A05.1.454.CMB.1.raw
  modified_base (245)..(250): a, c, t, g, unknown or other
  misc_feature (245)..(250): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgactgtggctgcaccatctgtcttcatcttcccgccatctgagagtagtacactgagcgggctggcaaggcgcatagnnnnnn

SEQ ID NO: 11632 - DNA, 251 bp, Homo sapiens
  misc_feature: GYAE6OF01AS6MO.16.5.A05.1.454.CMB.1.raw
  modified_base (246)..(251): a, c, t, g, unknown or other
  misc_feature (246)..(251): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgccatctgagagtagtacactgagcgggctggcaaggcgcatagnnnnnn

SEQ ID NO: 11633 - DNA, 249 bp, Homo sapiens
  misc_feature: GYAE6OF01DJHXT.16.5.A05.1.454.CMB.1.raw
  modified_base (245)..(249): a, c, t, g, unknown or other
  misc_feature (245)..(249): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgcatctgagagtagtacactgagcgggctggcaaggcgcatagnnnnn

SEQ ID NO: 11634 - DNA, 258 bp, Homo sapiens
  misc_feature: GYAE6OF01ECUYV.16.5.A05.1.454.CMB.1.raw
  modified_base (255)..(258): a, c, t, g, unknown or other
  misc_feature (255)..(258): n is a, c, g, or t
tcagtgtactactccacgaccggtgctcgatttagatagatagacagggacagatttcacactgaagatcagcgagggtaggaaactggaggatggtcggtagtttattactgcatgcaagctactactttttcctcactacttttggccaggggaccaggctaggaaatcaaacgaactgtggctgcaccatctgtcttcatccttcccgccatctgagagtagtacactgagcgggctggcaaggcgcatagnnnn

SEQ ID NO: 11635 - DNA, 246 bp, Homo sapiens
  misc_feature: GYAE6OF01AY321.16.5.A05.1.454.CMB.1.raw
  modified_base (244)..(246): a, c, t, g, unknown or other
  misc_feature (244)..(246): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgactgtggctgcaccatctgtcttcatcttcccgcatctgagagtagtacactgagcgggctggcaaggcgcatagnnn

SEQ ID NO: 11636 - DNA, 248 bp, Homo sapiens
  misc_feature: GYAE6OF01C8D2J.16.5.A05.1.454.CMB.1.raw
  modified_base (245)..(248): a, c, t, g, unknown or other
  misc_feature (245)..(248): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgcatctgagagtagtacactgagcgggctggcaaggcgcatagnnnn

SEQ ID NO: 11637 - DNA, 247 bp, Homo sapiens
  misc_feature: GYAE6OF01BKU7T.16.5.A05.1.454.CMB.1.raw
  modified_base (246)..(247): a, c, t, g, unknown or other
  misc_feature (246)..(247): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgccatctgagagtagtacactgagcgggctggcaaggcgcatagnn

SEQ ID NO: 11638 - DNA, 247 bp, Homo sapiens; identical to SEQ ID NO: 11637
  misc_feature: GYAE6OF01E3G5Y.16.5.A05.1.454.CMB.1.raw
  modified_base (246)..(247): a, c, t, g, unknown or other
  misc_feature (246)..(247): n is a, c, g, or t

SEQ ID NO: 11639 - DNA, 248 bp, Homo sapiens; identical to SEQ ID NO: 11629
  misc_feature: GYAE6OF01C8WD5.16.5.A05.1.454.CMB.1.raw
  modified_base (246)..(248): a, c, t, g, unknown or other
  misc_feature (246)..(248): n is a, c, g, or t

SEQ ID NO: 11640 - DNA, 249 bp, Homo sapiens; identical to SEQ ID NO: 11628
  misc_feature: GYAE6OF01AZCUE.16.5.A05.1.454.CMB.1.raw
  modified_base (246)..(249): a, c, t, g, unknown or other
  misc_feature (246)..(249): n is a, c, g, or t

SEQ ID NO: 11641 - DNA, 248 bp, Homo sapiens
  misc_feature: GYAE6OF01D5OTL.16.5.A05.1.454.CMB.1.raw
  modified_base (244)..(248): a, c, t, g, unknown or other
  misc_feature (244)..(248): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgactgtgctgcaccatctgtcttcatcttcccgccatctgagagtagtacactgagcgggctggcaaggcgcatagnnnnn

SEQ ID NO: 11642 - DNA, 248 bp, Homo sapiens
  misc_feature: GYAE6OF01C3QAO.16.5.A05.1.454.CMB.1.raw
  modified_base (245)..(248): a, c, t, g, unknown or other
  misc_feature (245)..(248): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttccgccatctgagagtagtacactgagcgggctggcaaggcgcatagnnnn

SEQ ID NO: 11643 - DNA, 247 bp, Homo sapiens
  misc_feature: GYAE6OF01C85P8.16.5.A05.1.454.CMB.1.raw
  modified_base (244)..(247): a, c, t, g, unknown or other
  misc_feature (244)..(247): n is a, c, g, or t
tcagtgtactactccacgaccggtgctcgatttagatagatagacaggacagatttcacactgaagatcagcagggtggaaactgaggatgtcggagtttatactgcatgcaagctacacttttcctcacacttttggccagggaccaggctggaaatcaaacgaactgtggctgcaccatctgtcttcatccttcccgccatctgagagtagtacactgagcgggctggcaaggcgctatagnnnn

SEQ ID NO: 11644 - DNA, 559 bp, Homo sapiens
  misc_feature: GYAE6OF01CNB0X.16.5.A05.1.454.CMB.1.raw
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtcgtggggggaggcgtggtccatccgtgggaactccctgacactctcctgcgtagcctctgggttcgtcttcaggaattatggcatgcacgtggggtcccgccaggcctccgaggccaagggggctgggaggtggggtggcggttatttcatatgatggaaataagaaagactatgacagactccggtagaacgggccatcaccatcctacagacgacaacttaccaaaacacgtactatactgaccactagaacagcctagacgaccgtagacggacacggcttagttcgtttactggtcgacgtaaactcctacgtacttagtgtacttctttagacttcggtctactttacg

SEQ ID NO: 11645 - DNA, 340 bp, Homo sapiens
  misc_feature: GYAE6OF01CUZW2.16.5.A05.1.454.CMB.1.raw
  modified_base (291)..(291): a, c, t, g, unknown or other
  misc_feature (291)..(291): n is a, c, g, or t
  modified_base (324)..(324): a, c, t, g, unknown or other
  misc_feature (324)..(324): n is a, c, g, or t
  modified_base (330)..(340): a, c, t, g, unknown or other
  misc_feature (330)..(340): n is a, c, g, or t
tcagtgtactactccacgaccggtgctcgatttagatagatagacagggttgcagtgggcgggctggccaccccctgcctcatgtctaggtcccagccccgcccactgcaaccctgtgcccgtcatgcccagcaggctcctgctccagcccagcccccagagagcagaccccaggtgcgtggccccgggggttttgctgagcctcagtcactgtgttatgtcttcggaactggaccaaggtcacgtctaggtcagccaaggccaacccgatgcactctcgttcccacctcncgagtagtacacgtgagcggctggcaaggcganagtagnnnnnnnnnnn

SEQ ID NO: 11646 - DNA, 245 bp, Homo sapiens
  misc_feature: GYAE6OF01E5TSC.16.5.A05.1.454.CMB.1.raw
  modified_base (244)..(245): a, c, t, g, unknown or other
  misc_feature (244)..(245): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgactgtggctgcaccatctgtcttcatcttcccgccatctgagagtatacactgagcgggctggcaaggcgcatagnn

SEQ ID NO: 11647 - DNA, 247 bp, Homo sapiens
  misc_feature: GYAE6OF01DS94T.16.5.A05.1.454.CMB.1.raw
  modified_base (246)..(247): a, c, t, g, unknown or other
  misc_feature (246)..(247): n is a, c, g, or t
tcagtgtactactccacgaccggtgctcgatttagatagatagacagggacagatttcacactgaagatcagcagggtggaaactgaggatgtcggagtttattactgcatgcaagctacacttttttcctcacacttttggccaggggaccaggctggaaatcaaacgaactgtggctgcaccatctgtcttcatcttcccgcatctgagagtagtacactgagcgggctggcaaggcgcatagnn

SEQ ID NO: 11648 - DNA, 252 bp, Homo sapiens
  misc_feature: GYAE6OF01BM8PZ.16.5.A05.1.454.CMB.1.raw
  modified_base (246)..(252): a, c, t, g, unknown or other
  misc_feature (246)..(252): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgccatctgagagtagtacactgagcgggctggcaaggcgcatagnnnnnnn

SEQ ID NO: 11649 - DNA, 265 bp, Homo sapiens
  misc_feature: GYAE6OF01CFH3M.16.5.A05.1.454.CMB.1.raw
  modified_base (130)..(130): a, c, t, g, unknown or other
  misc_feature (130)..(130): n is a, c, g, or t
  modified_base (253)..(265): a, c, t, g, unknown or other
  misc_feature (253)..(265): n is a, c, g, or t
tcagtgtactactccacgaccggtgctcgatttagatagatagacagggacgagatttcacactgaagatcagcagggtggaaactgaggatgtcggagtttattactgcatgcaagctacactttttcncactacgttttggccaggggaccaggctaggaaatcaaaacgactgtggctgcaccatctgtcttcatcttccgcatctgagagtagtacactggagcgggctgggacaaggcgacaataagnnnnnnnnnnnnn

SEQ ID NO: 11650 - DNA, 595 bp, Homo sapiens
  misc_feature: GYAE6OF01BHCTL.16.5.A05.1.454.CMB.1.raw
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgcttgggttttcctcgttgcttcttttaagaggtgtccagtgtcaggtgcaacgtggtggagtcgtgggggaggcgtggtccatccgtgggaacgtccctgacactctcctgcgtagcctcgttgggttcgtcttcaggtaattagtggcatgcacgtcggggtcccgccgaggtcctccgagggcgaaggggcgtgggaggtggggtggtcggtttatttcgattagtgagtaggaaaataagaaagactagtgcagacgtcgagaacgggccactcacactctaccagacgaactaactaaccaaaacgtacgtacctatctacacacctacgaacacgccgtaggacacgtggaacgacgacgtactacgtttagttacgttgtacgtacgtaacttcctacgtacttagtattactttctttacgtacttcgtccttacgttaacg

SEQ ID NO: 11651 - DNA, 254 bp, Homo sapiens
  misc_feature: GYAE6OF01CKXCC.16.5.A05.1.454.CMB.1.raw
  modified_base (249)..(254): a, c, t, g, unknown or other
  misc_feature (249)..(254): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcactacttttggccgggggaccaggctggaaatcaaaacgactgtggctgcaccatctgtcttcatccttcccgccatctgagagtagtacactgagcgggctggcaaaggcgcatagnnnnnn

SEQ ID NO: 11652 - DNA, 278 bp, Homo sapiens
  misc_feature: GYAE6OF01AYWJA.16.5.A05.1.454.CMB.1.raw
  modified_base (256)..(278): a, c, t, g, unknown or other
  misc_feature (256)..(278): n is a, c, g, or t
tcagtgtactactccacgaccggtgctcgatttagatagatagacagggacagatttcacactgaagatcagcagggtggaaactgaggatgtcggagtttattactgcatgcaagctacacttttttcctcactacttttggccaggggtaccaggctaggaaatccaaaacgaactgtggctgcaccatctgtcttcatccttcccgcatctagagagtagtacacgtgagcgggctgggcaaggcgacatagnnnnnnnnnnnnnnnnnnnnnnn

SEQ ID NO: 11653 - DNA, 250 bp, Homo sapiens
  misc_feature: GYAE6OF01BEU3N.16.5.A05.1.454.CMB.1.raw
  modified_base (244)..(250): a, c, t, g, unknown or other
  misc_feature (244)..(250): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtgctgcaccatctgtcttcatcttcccgcatctgagagtagtacactgagcgggctggcaaggcgcatagnnnnnnn

SEQ ID NO: 11654 - DNA, 568 bp, Homo sapiens
  misc_feature: GYAE6OF01DRSO5.16.5.A05.1.454.CMB.1.raw
  modified_base (286)..(286): a, c, t, g, unknown or other
  misc_feature (286)..(286): n is a, c, g, or t
  modified_base (304)..(304): a, c, t, g, unknown or other
  misc_feature (304)..(304): n is a, c, g, or t
  modified_base (463)..(463): a, c, t, g, unknown or other
  misc_feature (463)..(463): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgcttgggtttttcctcgttgcttcttttaagaggtgtccagtgtcaggtgcaactggtggagtcgtgggggagcgtggtccatccgtgggaactccctgacactctcctgcgtagcctcgtgggttctcttcaggtaattnggcatgcacgtgggtccnccgaggcctccgaggcgaaggggctggaggtgggtggtcgttattcatatgataggaaaactaagaatactatgacagtactcgtaggacgggcctagtcacatcctacagacgactaacttaaccaaaactacgtactactcgtcgcctactagaacncgcctagacgaccgtgacgtacacgtcttacttcgtttactcgtacgacgtaaactccgtacgttacttattgtacgtttctttacgtattacgtcttacttacg

SEQ ID NO: 11655 - DNA, 584 bp, Homo sapiens
  misc_feature: GYAE6OF01BJL0E.16.5.A05.1.454.CMB.1.raw
  modified_base (293)..(293): a, c, t, g, unknown or other
  misc_feature (293)..(293): n is a, c, g, or t
  modified_base (315)..(315): a, c, t, g, unknown or other
  misc_feature (315)..(315): n is a, c, g, or t
  modified_base (387)..(387): a, c, t, g, unknown or other
  misc_feature (387)..(387): n is a, c, g, or t
  modified_base (390)..(390): a, c, t, g, unknown or other
  misc_feature (390)..(390): n is a, c, g, or t
  modified_base (469)..(469): a, c, t, g, unknown or other
  misc_feature (469)..(469): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgcttcttttaagaggtgtccagtgtcaggtgcaacgtggtggagtcgtgggggagcgtggtccagtccgtgggaactccctgaccactctcctgcgtagccttcgttgggttctcttcgaggtaatttagnggcagtcgcacgtcgggtcccncgaggcctccgagggccgaagggggctgggagtgggtggtcggtttattcgatagtgataggaaataagaantangcagactcgaggaacggccactcactatctacagacgaacaacttaaccaaaactcgtactactctgaccactagaacngccgtagacgactaggacgacgacggacttagttcgttttactggtacgacgtaacttccgtacgttacttattgttaactttcgtttacgtaccgttggttactaccgtttacg

SEQ ID NO: 11656 - DNA, 255 bp, Homo sapiens
  misc_feature: GYAE6OF01C4O4D.16.5.A05.1.454.CMB.1.raw
  modified_base (244)..(255): a, c, t, g, unknown or other
  misc_feature (244)..(255): n is a, c, g, or t
tcagtgtactactccacgaccggtgctcgatttagatagatagacagggacagatttcacactgaagatcagcagggtggaaactgaggatgtcggtagtttattactgcatgcaagctactactttttcctcactacttttggccaggggaccaggctggaaatcaaacgactgtggctgcacatctgtcttcatctccgccatctgagagtagacactgagcggctggcaaggcgcagtagnnnnnnnnnnnn

SEQ ID NO: 11657 - DNA, 254 bp, Homo sapiens
  misc_feature: GYAE6OF01EGEX5.16.5.A05.1.454.CMB.1.raw
  modified_base (131)..(131): a, c, t, g, unknown or other
  misc_feature (131)..(131): n is a, c, g, or t
  modified_base (250)..(254): a, c, t, g, unknown or other
  misc_feature (250)..(254): n is a, c, g, or t
tcagtgtactactccacgaccggtgctcgatttagatagatagacagggacagatttcacactgaagatcagcagggtggaaactgaggatgtcggagtttattactgcatgcaagctacacttttttccncactacttttggccaggggaccaggctggaaatcaaaacgaactgtggctgcaccatctgtcttcatccttcccgccatctgagagtagtacatggagcgggctggcaaggcgcatagnnnnn

SEQ ID NO: 11658 - DNA, 709 bp, Homo sapiens
  misc_feature: GYAE6OF01DRYBH.16.5.A05.1.454.CMB.1.raw
  modified_base (177)..(177): a, c, t, g, unknown or other
  misc_feature (177)..(177): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttggctgcgctgggttttcctcgttgctcttttaagaggtntccagtgtcaggtgcaacgtggtggagtcgtgggggagtcgtggtccatccgtggaactccctgacactctcctgcgtacgcctcgtggttcctctttcgaaggtaatttagcggtacacgtgacctacggtcgggtcccgccgtaggtcctaccgaggcgtaagggggcctagggagggttgggttgggtaccggtttatttccgaattagtagtaagtaagggtaaaactaaaggaaaagtacttaagtcggaacgtacggtaaccgttccggtaagggaaaccggggtaccctaccgtccgaaccgtaacttcccgtacgaaacgggtaaactaaaccgtaaaaccttaaaccgaaaaaccgtcgtaactaactcgtacgactaccgtactaacgcgtccagaccgtaccgtaggaacgtactaccggtattacgtttaccgtttagtacggtagtaaccgtaaccttccgtaacggtacttagttacgttactttcggttactaccgggttcttctaacgtttaaccg

SEQ ID NO: 11659 - DNA, 818 bp, Homo sapiens
  misc_feature: GYAE6OF01A1GS6.16.5.A05.1.454.CMB.1.raw
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgcttcttttaagaggttgtccagtgtcaggtgcaacgtgggtggagtcgtgggggggacgtcggtcggtccagtccggtaggggaaccgtccctagacctccttcctcctggtaccgtacggtcccttcggtttcggggttccgtttccttaccggtaaaggtaatttaggcggtactacgttcggcctacgggttccggggccccgaccggtacggtccctaccggaggggaccggaaggggggttcgtagggggtagggtcggggggttcgggttacggtttttaacctttcgaaagttttaggtaaggtaaaggtaaacggtaaaaaaggttaaaacggaaaacgtacttaaggtcgaacgtaccgtaacccggttacggtaagggtaaacccgggccctaaacctacccgtaacctacgttacccgtaaccgaaaggtaaacccgtaaacttaaaccctaaaacccgtaaaaaccgtccggtttaacctaacttccgtacgtaaccctaccggtaacaaccgtccgccgttaacgacgtaccgtaggaccggtacaccggttattcgttagtttaccaggtacgtaaccgtaaccgttcccgtaacgttattacgtagttactttcgttactagttcgttacttcgttaacg

SEQ ID NO: 11660 - DNA, 718 bp, Homo sapiens
  misc_feature: GYAE6OF01CYIIA.16.5.A05.1.454.CMB.1.raw
  modified_base (182)..(182): a, c, t, g, unknown or other
  misc_feature (182)..(182): n is a, c, g, or t
  modified_base (325)..(325): a, c, t, g, unknown or other
  misc_feature (325)..(325): n is a, c, g, or t
  modified_base (348)..(348): a, c, t, g, unknown or other
  misc_feature (348)..(348): n is a, c, g, or t
tcagtgtactactccacgaccggtgctcgatttagatagatagacaggggagctctgggagaggagcccagctactagaggtccggcggtgtttccagttcggtgatcagcactgaacacagaggactcacatggagttcggctgcggtcgttgggttttcctggttgcttagttttaaagnggtgtccaggtcgtcaggtcgacaagtgggtggagtcggtggggggagtcggtggtccagtccggtagggaacttcccgagactacgtcgtccgtggccgttcgccttggttcgggttactccttagaaggtaattcgtcggntatcgcgtacggtcgggccaacnggttccacggaggcggagggtcgtagggagggtttggggacggttcggtttatcgtagtacggttaggaagtaaaggggtaaaacctaaaggaaacgtcgtaagcggtacgagtaccggtacggtagggaccggacctacgaccacgtactccgacaaggacaaactaactaaccgaaagtcgtactagtccaacgaccaactaacgaaccgacgccgaaggtacgtaaccgaggaaccgacctacggttacgttacgttacgtttacgccgtaaggaacccgttaacttccgttaacgttagtttacgtaccgttttacccgtttcggttactaacgggttttcctaaccgtttacgtttaaacccggg

SEQ ID NO: 11661 - DNA, 404 bp, Homo sapiens
  misc_feature: GYAE6OF01ETPCI.16.5.A05.1.454.CMB.1.raw
  modified_base (382)..(404): a, c, t, g, unknown or other
  misc_feature (382)..(404): n is a, c, g, or t
tcagtgtactactccacgaccggtgctcgatttagatagatagacagggttgcagtgggcggggctggccacccccctgcctcatgtctaggtcccagcccccgcccactgcaacccctgtcgccccgtcatgcccagcaggcctcctgctccagcccacgcccccagagagcagaccccaggtgcgtcgggtcccccgggggttttgtctgacgcctcagtcactgtgttatgtcttcggaactggaccaaggtccaccgtcgtaggtcacgcccgaaggcccaaccccatgtccacttccgtcgttaccccaccctccgtacggagttacgtacctacgtggacgccggggctagggaccaacgggcgtaccaagtacgnnnnnnnnnnnnnnnnnnnnnnn

SEQ ID NO: 11662 - DNA, 647 bp, Homo sapiens
  misc_feature: GYAE6OF01BUXSM.16.5.A05.1.454.CMB.1.raw
  modified_base (326)..(326): a, c, t, g, unknown or other
  misc_feature (326)..(326): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaacgtggtggagtcgtgggggagcgtggtccatccgtagggaacgtccctgaccactcgtcctaggcgtacgccttcgttggggttcctcgtttcgaagggtaattagtggactagtgctacgtggggtcccnccgaggcctccgaggcggaaggggctgggagtgggtggtcgttatttcgatagtgataggaaataagaaagctaagtcgacacggacgtcgtagggaacggtcctacgtacgaccactcgtaccgaagtagaacctaactaacccaaaacgtaccgtactactctacgccactacgacacgtaccgtagaccgtactacggaacggaccgtacggtactacgtttacgtttacgttacgtacggtaccgtaacgttaccgtacgttaacttagttacgttacgtttactttacgtacgtttcgttacgttaccgttaaccg

SEQ ID NO: 11663 - DNA, 905 bp, Homo sapiens
  misc_feature: GYAE6OF01EJ1EQ.16.5.A05.1.454.CMB.1.raw
tcagtgtactactccacgaccggtgctcgatttagatagatagacagggggagctctgggagaggacgcccagcactagaagtcggcggtgtttccagttcggtgatcagcactgaacacagagactcacatggtagtttgggctgcgtcttgggttttcctcgttgtcttcgttttaaggaggttcgtcctagtgtcgagggtgactaacgtgggtggaggttcgggtggggggacgtcggttcggtcccaagttcccggtaggggaaccttcccgtagacctcgttccgtccgtggtccggttacggtccgtttcggttacggggtttccgtcgttttacggaaggttaaacgtttaggtcggtaccgtagttcggtaaccgttaccgggttccggggtcccggaccgacgggtcccgtacccggaggggaaccgggtaacggggggtccggttggggtaaggggttcgggggttacgggttacgttttaatttacggaagtttaggtaacggtaaaggttaaaagggtaaaaataaaagggtaaaacgttacttaacgggtacgtaaccggtaaacggttacccgggttacccgggaagggaaacccgggttacccgtaacccttaccgaaccgttaccgttaaccgtaccgaaaggaacccgtaaaaccttaaaccgttaaaacccgtaaaaccgtaccgggtttaacctacgttaccgaccgtaaccgacctaacggaaccgacgtaaccgtacggaacctaacggtacggtaacgtaccgtaaggtttacttaacggtttcgtttaccgtaggttaccgaacgttaacccgttcttaacggttacttacgttaagttcttttggtttaacaccgtttacgttcccgtaattaaaccggg

SEQ ID NO: 11664 - DNA, 766 bp, Homo sapiens
  misc_feature: GYAE6OF01CKWCK.16.5.A05.1.454.CMB.1.raw
  modified_base (180)..(180): a, c, t, g, unknown or other
  misc_feature (180)..(180): n is a, c, g, or t
  modified_base (683)..(683): a, c, t, g, unknown or other
  misc_feature (683)..(683): n is a, c, g, or t
  modified_base (696)..(696): a, c, t, g, unknown or other
  misc_feature (696)..(696): n is a, c, g, or t
tcagtgtactactccacgaccggtgctcgatttagatagatagacaggggagctctgggagaggagcccagcactagaagtcggcggtgtttccattcggtgatcagcactgaacacaggaggactcaccatgggtagttggctgcgtcttgggttttccctgttgcttcgttttaaagnggtgtccagtgtcgaggtgcaacgtggtggagtcggtggggggagtcggtcggtccagttccgtagggaactcccgtagactaccttctccgtaggccgttacgtccttcggttcgggttccttacttgaaggttaagtttgcgggtactaagtcgtaccgacggttccggggtacccacggacgtccctacggaacggtcggaaacgggggtccttaggggacgggttgggggtcggttaccggtttatttaccgagttaggtacggaaagtaaacgggtaaaataaaaggaaacggtacttagtaacgtaccgtaaacggtaccccggttaggtacgggaaaccgggtccctaacgtaacccaccgttatacccgtaaccgaaacgggtaaactaaacccttaaacgttaaaacccgaaaagtaccggttacctaatacccggtcaacctaccgaagtaacccgacgttacgacgacgtaccgaggtacggaactacggtnttacgtgtttacnggtacgtaaccgtacttccgaattcgttaatacgttcttacggttacaggtttcgtccgttaattaccgg

SEQ ID NO: 11665 - DNA, 347 bp, Homo sapiens
  misc_feature: GYAE6OF01DQAR6.16.5.A05.1.454.CMB.1.raw
  modified_base (337)..(347): a, c, t, g, unknown or other
  misc_feature (337)..(347): n is a, c, g, or t
tcagtgtactactccacgaccggtgctcgatttagatagatagacagggttgcagtgggcgggctggccacccccctgcctcatgtctaggtcccagcccccgcccactgccaaccctgtcgcccgtcatgcccagcaggctcctgctccagcccagcccccagagagcacgaccccaggtgcgtcgggtccccggggttttgtctgacgcctcagtcactgtgttatgtctcggaactggaccagtcaccgtctaggcagcccaagcccaacccatgcactctcgtcccacctcctgagtgtacacgtgacggcgggctggacaggcgacagtagnnnnnnnnnnn

SEQ ID NO: 11666 - DNA, 656 bp, Homo sapiens
  misc_feature: GYAE6OF01C457Z.16.5.A05.1.454.CMB.1.raw
  modified_base (317)..(317): a, c, t, g, unknown or other
  misc_feature (317)..(317): n is a, c, g, or t
  modified_base (529)..(529): a, c, t, g, unknown or other
  misc_feature (529)..(529): n is a, c, g, or t
  modified_base (587)..(587): a, c, t, g, unknown or other
  misc_feature (587)..(587): n is a, c, g, or t
tcagtgtactactccacgaccggtgctcgatttagatagatagacaggggagctctgggagaggagcccagcactagaagtcggcggtgtttccattcggtgatcagcactgaacacagaggggactcaccatggagtttgggctgcgctgggttttcctcgttgctcttttaagaggtgtccagtgtcaggtgcaactggtggagtcgtgggggagcgtggtccatcctgggaactccctgactactctcctggcgtgccttctcggggttcgtccttcgaggtaatttatgggctatcgcaccgttggggtcccnccgaggccttccgagggccaagggggtctggggacggttggggcgggttaccggttttatttcgaagttatggaaagtaggaaaaacttaaggaaaacgtactagtgacagtacgttccggagaacgggcccactaccaacctattccaccgaagactaaccgtaaacttaacccaaaaacgacgggttctaatcccgtagccctaaccgtnaaccgactccgaggaaccgtcgtaggacggaccttacggtccttagttagtttacccnggttcgaacgtaacttccgtacttaacttcgttagtcgtttctttacgatttcggtctttaacgttacg

SEQ ID NO: 11667 - DNA, 272 bp, Homo sapiens
  misc_feature: GYAE6OF01BZ4F9.16.5.A05.1.454.CMB.1.raw
  modified_base (257)..(272): a, c, t, g, unknown or other
  misc_feature (257)..(272): n is a, c, g, or t
tcagtgtactactccacgaccggtgctcgatttagatagatagacagggacagatttcacactgaagatcagcagggtggaaactgaggatgtcggagtttattactgcatgcaagctactacttttttcctcactacttttggccgaggggaccaggctaggaaatacaaacgaactgtggctgcaccatctgtctcattccttcccgccatctgagagttagtacactgacggcgggctggacaaggcgcagtgnnnnnnnnnnnnnnnn

SEQ ID NO: 11668 - DNA, 295 bp, Homo sapiens
  misc_feature: GYAE6OF01D661F.16.5.A05.1.454.CMB.1.raw
  modified_base (196)..(196): a, c, t, g, unknown or other
  misc_feature (196)..(196): n is a, c, g, or t
  modified_base (269)..(295): a, c, t, g, unknown or other
  misc_feature (269)..(295): n is a, c, g, or t
tcagtgtactactccacgaccggtgctcgatttagatagatagacagggacagatttcacactgaagatcagcaggggtggaaactggaggatggtcggtagtttattactgcatgcaagctactactttttctcactacttttggccgagggaccaggctaggaaatacaaacgaactgtggctgcaactatctntctcatccttcccgcatctagagtaacgtagtactacgtggaggcgggcgtaggacgaacggcgtacaagagnnnnnnnnnnnnnnnnnnnnnnnnnnn

SEQ ID NO: 11669 - DNA, 725 bp, Homo sapiens
  misc_feature: GYAE6OF01EXN6M.16.5.A05.1.454.CMB.1.raw
  modified_base (184)..(184): a, c, t, g, unknown or other
  misc_feature (184)..(184): n is a, c, g, or t
  modified_base (261)..(261): a, c, t, g, unknown or other
  misc_feature (261)..(261): n is a, c, g, or t
  modified_base (265)..(265): a, c, t, g, unknown or other
  misc_feature (265)..(265): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (574)..(574): a, c, t, g, unknown or other
  misc_feature (574)..(574): n is a, c, g, or t
  modified_base (707)..(707): a, c, t, g, unknown or other
  misc_feature (707)..(707): n is a, c, g, or t
tcagtgtactactccacgaccggtgctcgattttagatagatagacaggggagctctgggagaggagcccagcactagaagtcggcggttgtttccattcggtgatcagcactgaacacagaggactcacatggagtttgggctgcgtcgttgggttttcctcgttgctttacgtttttaaggnggttgtccaggttgtcgaggtgactaacgtgggtggagtcggtggggggagtcgtggtccatccgtagggactcccngacnctctccgngcgtgccttgtggttctctcgaggtattgngcagtgctacggtcgggcccacgacgggtcctacccggagggaccggaaggggtcgttagggggtaggttgggggttcggttacggtttttatttacgaagttagtaggtaagttaaacgggaaaaataaaggaacgtacttaggtcgacgtaaggacccgttacggaggacgggacccttaactaccgtacctactaccgtacgaacgtaacgtaaactaaccttaaaccgaaaaccgttcggttactacgtacgtacgacctaccgtanaccgtacgccgtaggtaaccgaccgtacggaacgtacgacgtttacttaggtttaccgtttacgttacgacgtaaccgttaaccttacgttacgttaacgttattagttacgttttcgtttaggtaccgtttnttaccgttacgttaaccg

SEQ ID NO: 11670 - DNA, 633 bp, Homo sapiens
  misc_feature: GYAE6OF01BLEMR.16.5.A05.1.454.CMB.1.raw
  modified_base (293)..(293): a, c, t, g, unknown or other
  misc_feature (293)..(293): n is a, c, g, or t
  modified_base (313)..(313): a, c, t, g, unknown or other
  misc_feature (313)..(313): n is a, c, g, or t
  modified_base (317)..(317): a, c, t, g, unknown or other
  misc_feature (317)..(317): n is a, c, g, or t
  modified_base (366)..(366): a, c, t, g, unknown or other
  misc_feature (366)..(366): n is a, c, g, or t
  modified_base (383)..(383): a, c, t, g, unknown or other
  misc_feature (383)..(383): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgcttcttttaagaggtgtccagtgtcaggtgcaacgtggtggagtcgtgggggagcgtggtccagtccgtgggaacgtccctgaccactctccgtgcgtacgcctcgtgggttctcttcaaggtaatttanggctatgcacgttgggcccnccgnggcctccgaggcgaaggggctgggaggtgggtggtcggtttattcagtntgataggaaataagaanactatgcagacgtcgtagacgggccactcacactcctcgagaacgactaactaaccgaaaacgcgtactactcctgaccactacgaacacgccgtagaacgtaccgtaggtaacggaaccgtacggtacgttaacgtttcggttttaacgtagttaccgtaaaccgttaacgttacccgtaccgttaactttacgttagttaccgttttacttttacggtacgtttcgttacctttaaccgtttaaccgg

SEQ ID NO: 11671 - DNA, 470 bp, Homo sapiens
  misc_feature: GYAE6OF01CI6TV.16.5.A05.1.454.CMB.1.raw
  modified_base (125)..(125): a, c, t, g, unknown or other
  misc_feature (125)..(125): n is a, c, g, or t
  modified_base (429)..(430): a, c, t, g, unknown or other
  misc_feature (429)..(430): n is a, c, g, or t
  modified_base (432)..(433): a, c, t, g, unknown or other
  misc_feature (432)..(433): n is a, c, g, or t
  modified_base (438)..(470): a, c, t, g, unknown or other
  misc_feature (438)..(470): n is a, c, g, or t
tcagtgtactactccacgaccggtgctcgatttagatagatagacagggttgcagtgggcgggctggccaccccctgcctcatagtctaggtcccagccccgccactgcaaccctgtcgcccgtnatgaccagcaggctcctgctccgagcccacggccccagacgcgcgacgaccctaggtcgccgttcggggtccccggggttttaggcctgacgtcctctcgtccacgttgttacgttacttcggttccttacgggtaaacgtccgggaaccctaggtccctaaccgttcgtacggtacaccggacccgaacgaccccgtaacccgtctcgtacctccgttccgttcccgtaccctaccgtccgtaggtacgtacgtaccgtacgtcggtcggtccggtacgtcggacgacgggctacgtagcggnngnnagctnnnnnnnnnnnnnnnnnnnnnnnnnnnnnnnnn

SEQ ID NO: 11672 - DNA, 692 bp, Homo sapiens
  misc_feature: GYAE6OF01BU4M7.16.5.A05.1.454.CMB.1.raw
  modified_base (288)..(288): a, c, t, g, unknown or other
  misc_feature (288)..(288): n is a, c, g, or t
  modified_base (294)..(294): a, c, t, g, unknown or other
  misc_feature (294)..(294): n is a, c, g, or t
  modified_base (305)..(305): a, c, t, g, unknown or other
  misc_feature (305)..(305): n is a, c, g, or t
  modified_base (318)..(318): a, c, t, g, unknown or other
  misc_feature (318)..(318): n is a, c, g, or t
  modified_base (325)..(325): a, c, t, g, unknown or other
  misc_feature (325)..(325): n is a, c, g, or t
tcagtgtactactccacgaccggtgctcgatttagatagatagacagggggagctctgggagaggagcccagcactagaagtcggcggtgtttccattcggtgatcagcactgaacacagaggactcaccatggagtttgggctgcgtccggtttcctcgttgcttctttaagaggtgtccagtgtcgaggtgacaacgtggtggagtcggtgggggaggcgtggtccagtcctgggactcctgacctactctcctgcgtagccgtcgttggtctctacgagtattgngcagtncacgtcggccncgcgcctcgaggngagggcngggaggtgggtgtcgttattcagttatagagtaaggaaaataaagaaacgtactatcggaacacggtaaccgtacgggacggaaccgggaccctaacgtccaacccgtactaccgtaaccgagtaaacgtaaactaaaacctaaaccgtaaaacggtaccgttacttaacctccgtacgaacctaacccgtaacgtaaccgaccgtacggtaacggtaaccgtaaccggtacggaaccgtaaccgtaccggttacttacgtttaccgtttacgtacgtaccgtaacggtaccttccggtaacttaacgttcgtacgtttactttcgttacggttcgttaacgtaccgtttacttaaccgttaacggg

SEQ ID NO: 11673 - DNA, 813 bp, Homo sapiens
  misc_feature: GYAE6OF01AGV1G.16.5.A05.1.454.CMB.1.raw
  modified_base (89)..(89): a, c, t, g, unknown or other
  misc_feature (89)..(89): n is a, c, g, or t
  modified_base (102)..(102): a, c, t, g, unknown or other
  misc_feature (102)..(102): n is a, c, g, or t
  modified_base (237)..(237): a, c, t, g, unknown or other
  misc_feature (237)..(237): n is a, c, g, or t
tcagtgtactactccacgaccggtgctcgatttagatagatagacaggggagctctgggagaggagcccagcactagaagtcggcggtntttccattcggtnatcagcactgaacacgagaggacctcacctagtagggtagtttggggcttggccgtcgtttgggtttttcccttcgttcgctttacgttttaaggagttgtccagtggtactagggtcgacaacggtgggtaggngttcggtggggggacgtcggttcggtaccgtagtcccggtagggaaccgttccccgtaggaacctccgttcccgtccgtcggtaccgtcgtcccggtttacggttcgggtttccttacgttagaacggtaatttcggtcgacttcgtcgaccggtacggttccggggtcccgaccgaccgggtcctaccggaacggtacggggtacggggtccggtagggttcgggtacggggtttcgtaccgttttagtacagtttaggaacggttaagtaaacggtaaatacgggaatccgtgtacgacgtacggtccgaggtacggaaccggtacccaccgtcacgtaccgtacgtaccggagtaacccgtaacgtaaacccgttaaccgaaaacgttcgtaccttacgttcccgacggtaaccctaacgtaataccgaccgttcggtagaccgtaccgggtacaccggtactacggtacttaacggttcttacggacgtacccgtaacgtccttaccggtacgtactttaagaccgtttacgtttgttacccgttaacgttccttacgttaaccgtaaccgg

SEQ ID NO: 11674 - DNA, 878 bp, Homo sapiens
  misc_feature: GYAE6OF01BK7ED.16.5.A05.1.454.CMB.1.raw
tcagtgtactactccacgaccggtgctcgattttagatagatagacaggggagctctgggagaggagcccagcactagaagtcggcggtgtttccattcggtgatcagcactgaacacagaggactcacagtggtagtttgggctgcgtcgttcgggtttttcccttcgtttgtctttacgtttttaaggaggttcgttccgtagttcggtcgagggtcgtacctaacgttgggtggtaggttcgggttagggggggacggtcggttcgggtaccgtacgttacccggttagggggtaaccgttccccgtcggaacccgtccttcccgttcccgttcggtaccggttacgtcccgttccggtttacgggggttttcccgttccgttttaacggaagggttaaagttttaggtcggtactaagtccgaccgttaccggtccggggttccccgcccggtaccgggtcccgtacccggagggaccgggtaacgggggttcgggttaggggcgggttacggggggttcggttaacgggtttttatttacgtaagttaaggttaaggtaaggttaaacggaaaaagtttaaacgaaagttaacgtaagtaccgtacgaacgtaccggttacggacgggtaaccgggaccctacgtaccaaccgtaccttccgaacaaggtaaccaaacgttaaacctaaaccgtaaaaccgtcgttacttacgccgtacacctaaccgtacgacgaacgtccgtaacggtaccgtagtacggacggtaaccgtgttacgttagtttcgtttatcggttacgtacgttaccttaccgttagttacgttagtacgttacgttttactttcggtacttaccgtttctacgttaacg

SEQ ID NO: 11675 - DNA, 836 bp, Homo sapiens
  misc_feature: GYAE6OF01DTMOZ.16.5.A05.1.454.CMB.1.raw
  modified_base (275)..(275): a, c, t, g, unknown or other
  misc_feature (275)..(275): n is a, c, g, or t
tcagtgtactactccacgaccggtgctcgatttagatagatagacaggggagctctgggagaggagcccagcactagaagtcggcggtgtttccattcggtgatcagcactgaacacagaggacctcaccatggtagtttgggctgcgtcgttgggtttttcctcgttgcttcttttaaggaggtgtccagtgtcaggtgcaacgtggtggagtcgtggggggacgtcggtggtccatccgtagggaactccctagacctactctccgtgcgtanccttgttgggttcctcttcgaaggtaattagtcggctagtgacctacggttcgggggtaccgccagggtccctaaccggacgggaccggtaaacggggggtccgtgggggtaacgggttcggggttacgggttacggttttaacgttcctaaagttagttcggtaaaggttaaagggtaaaaaaattaaagggaaaacgttacttaggtaccggactaagggtacccgttacgggtaagggaaacccggggtaccctaacctaccgtaacccgtacgttaccctaaccggaacgtaaacgtaaacccgtaaaacgtttaaacccccgaaaaaccggtccggtttaacctaacttacccgttaccgaacccgtaacccgtaacgtaaaccgtacggtacccgtacggaaaccggttacccggaaggtaaccgggaaccgttacggttactttaacggtttacgttttaccgtaacggttacgtaaccgttaaacgttacccgttaacgttacttagtacggttactttcggttacgttacgttccttaacgttaacctacgg

SEQ ID NO: 11676 - DNA, 243 bp, Homo sapiens
  misc_feature: GYAE6OF02H5JIU.16.5.A05.1.454.CMB.1.raw
  modified_base (241)..(243): a, c, t, g, unknown or other
  misc_feature (241)..(243): n is a, c, g, or t
tcagtgtactactccacgaccggtgctcgatttagatagatagacagggacagatttcacactgaagatcagcagggtggaactgaggatgtcggagttattactgcatgcaagctacacttttcctcacactttggccagggaccaggctggaaatcaaacgaactgtggctgcaccatctgtcttcatcttcccgccatctgagagtagtacactgagcgggctggcaaggcgcatagnnn

SEQ ID NO: 11677 - DNA, 247 bp, Homo sapiens; identical to SEQ ID NO: 11637
  misc_feature: GYAE6OF02IU622.16.5.A05.1.454.CMB.1.raw
  modified_base (246)..(247): a, c, t, g, unknown or other
  misc_feature (246)..(247): n is a, c, g, or t

SEQ ID NO: 11678 - DNA, 527 bp, Homo sapiens
  misc_feature: GYAE6OF02IDH8Q.16.5.A05.1.454.CMB.1.raw
  modified_base (403)..(403): a, c, t, g, unknown or other
  misc_feature (403)..(403): n is a, c, g, or t
  modified_base (428)..(428): a, c, t, g, unknown or other
  misc_feature (428)..(428): n is a, c, g, or t
  modified_base (467)..(467): a, c, t, g, unknown or other
  misc_feature (467)..(467): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtctgggggagcgtggtccatcctgggaagtccctgacactctcctgcgtagcctctgggttcgtcttcaggaattatggcatgcactgggtccgcaggcctccaggcaaggggctgggagtggggtggcggttatttcgatatgatggaaataagaaagactatgcagactccgtgaagggccgactcacatctcaganacaataccaaaacacggtctatctnccactgaacagcctagacgacctgagacacggctagttnttactgtgacgtaaactcctacgtacttagtgtattctttagacttcggtctactttacg

SEQ ID NO: 11679 - DNA, 344 bp, Homo sapiens
  misc_feature: GYAE6OF02GP6UA.16.5.A05.1.454.CMB.1.raw
  modified_base (337)..(344): a, c, t, g, unknown or other
  misc_feature (337)..(344): n is a, c, g, or t
tcagtgtactactccacgaccggtgctcgatttagatagatagacagggttgcagtgggcggggctggccaccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtcagcccaaggccaaccccactgtcactctgttccccaccctctcgagtagtacactgagcgggctggcaaggcgcatagnnnnnnnn

SEQ ID NO: 11680 - DNA, 599 bp, Homo sapiens
  misc_feature: GYAE6OF02IX3A6.16.5.A05.1.454.CMB.1.raw
  modified_base (380)..(380): a, c, t, g, unknown or other
  misc_feature (380)..(380): n is a, c, g, or t
  modified_base (410)..(410): a, c, t, g, unknown or other
  misc_feature (410)..(410): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtctggggggagcgtggtccatccgtgggaactccctgaccactcctcctgcgtacgcctcgtggggtttccgttcttccgaagggtaaatttagtcgggctatgccacggttggggtccccgccgaggcctccgaggcgaacgggggctgggagtggggtggtcggttattcgatntgagtaggaaaataagaaagtactatcganagactcggtaggacgggccgactaccgacctatcctacagacgactaataaccaaaacgacgtactaatctgaccacctacgaacacgcctagacgacctggacgacgacgtcttaagttgtttactgtcgacgtaactcctacgtacttagtagtacttcgtttcgacgttcggttactactttaacg

SEQ ID NO: 11681 - DNA, 534 bp, Homo sapiens
  misc_feature: GYAE6OF02FIIZT.16.5.A05.1.454.CMB.1.raw
  modified_base (408)..(408): a, c, t, g, unknown or other
  misc_feature (408)..(408): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggtttcctcgttgctcttttaagaggtgtccagtgtcaggtgcaactggtggagtcgtgggggaggcgtggtccatcctgggaagtccctgacactctcctgcgtagcctctgggttcgtcttcaggaattatggcatgcactgggtccgccaggctccaggcaaggggctgggagtggggtggcggttatttcgatatgatggaaataaggaaagactatgcagactccggtaggaagggccactcaccatctcaganacaattaccaaaacacgtactactctgcacctgaacagcctagacgacctagacgacgacggctattgtttactgtagacgtaatcctacgtacttatgtacttctttgtactcggtctactttac

SEQ ID NO: 11682 - DNA, 525 bp, Homo sapiens
  misc_feature: GYAE6OF02GOE4M.16.5.A05.1.454.CMB.1.raw
  modified_base (461)..(461): a, c, t, g, unknown or other
  misc_feature (461)..(461): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtctgggggaggcgtggtccatcctgggaagtccctgacactctcctgcgtagcctctgggttctcttcaggaattatggcatgcactgggtccgccaggctccgaggcaaggggctgggagtggggtggcggttattcatatgatggaaatagaaagctatgcagactccgtggaacgggccactcaccatctcagagacaactaccaaaacacgtactatctgcactacgaacagctagacgactgacggacacgntattgtttactgtgacgtaatcctacgtacttagtgtacttcgtttagacttggtacctattac

SEQ ID NO: 11683 - DNA, 390 bp, Homo sapiens
  misc_feature: GYAE6OF02JMJGH.16.5.A05.1.454.CMB.1.raw
  modified_base (281)..(281): a, c, t, g, unknown or other
  misc_feature (281)..(281): n is a, c, g, or t
  modified_base (361)..(390): a, c, t, g, unknown or other
  misc_feature (361)..(390): n is a, c, g, or t
tcagtgtactactccacgaccggtgctcgatttagatagatagacagggttgcagtgggcggggctggccaccccctgcctcatgtctaggtcccagccccgcccactcgcaaccctgtgcccgtcatgcccagcaggctcctgctccagcccagcccccagagagcacgaccccaggtgctcgggccccgggggttttggtctgacgcctcagtcactgtgttatgtcttcggaactgggaccaaggtcaccgtcctaggtcagcccaaggcccaacccntcgtcacctctcgttccccaccctcctgacgtacgtaccatcggacgccgggctacgggacaacgggccgactaagtcgnnnnnnnnnnnnnnnnnnnnnnnnnnnnnn

SEQ ID NO: 11684 - DNA, 542 bp, Homo sapiens
  misc_feature: GYAE6OF02GC53R.16.5.A05.1.454.CMB.1.raw
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
  modified_base (436)..(436): a, c, t, g, unknown or other
  misc_feature (436)..(436): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtcgtgggggagcgtggtccatcctgggaatccctgacactctcctgcgtagcctctgggttctcttcaggaattatggcatgcacgtgggtccgccaggctccgaggcaaggggctgggagtgggtgcggttattcatatgataggaaataagaaagactagtgacagacctccggtaggaacgggccactcaccatcnccagagacaacttaccaaaacncgtactatctnaccactagaacacgcctagacgacctggacgacacggctattgtttactgtagacgtaactcctacgtaacttatagtattctttagacttcgtacctacttaacg

SEQ ID NO: 11685 - DNA, 252 bp, Homo sapiens
  misc_feature: GYAE6OF02I8MOA.16.5.A05.1.454.CMB.1.raw
  modified_base (247)..(252): a, c, t, g, unknown or other
  misc_feature (247)..(252): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcactacttttggccaggggaccaggctggaaatcaaacgaactgtggctgcaccatctgtcttcatcttcccgccatctgagagtagtacactgagcgggctggcaaggcgcatagnnnnnn

SEQ ID NO: 11686 - DNA, 570 bp, Homo sapiens
  misc_feature: GYAE6OF02FVGV7.16.5.A05.1.454.CMB.1.raw
  modified_base (354)..(354): a, c, t, g, unknown or other
  misc_feature (354)..(354): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtctgggggagcgtggtccatcctgggaactccctgacactctcctgcgtagcctcgtgggttcgtcttcgaggaattatggcatgcacgtgggtcccgccaggcctccgaggcgaaggggctgggagtggggtggcggtttattcattangataggaaataagaaagtactagtgacagactccggtaggaacgggccactcaccatcctacagacgacaacttaaccaaaacgtacgtactatctacgcctaccgtagaacacgccgtagacgacgtaggacgacgacgctagttcgtttacgtgtacgacgtaactcctacgtacttagtgtacttcgtttacgtacgttgttacctatttacg

SEQ ID NO: 11687 - DNA, 664 bp, Homo sapiens
  misc_feature: GYAE6OF02IP0U7.16.5.A05.1.454.CMB.1.raw
  modified_base (174)..(174): a, c, t, g, unknown or other
  misc_feature (174)..(174): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagnggtgtccagtgtcaggtgcaacgtggtggagtcgtgggggaggcgtggtccagtccgtgggaactccctgaccactcctcctgcgtacgccttcgtgggttcgtcttcgaaggtaattagtggcatcgcacggttgggtcccgccgaggcctaccgaggcgaaggggctgggaggttggggtggtcggtttattcatagtgtataggaaataaggaaagtactagtgacagaccgtccggtaggaacggggccctactaccacctactcctacgaacggaacgaactaaactaacccgaaaaacgtaccggttacttactctacgacctaccgtaacgaacacgtaccgtaggaaccgtaccgtagggaacggaaccgtacggtactttaacgttcgttttacgtcgtacggtaaccgtaacttaccgtacgttaacttacgtacgttactttaccgttttagaaccgtttcggttaccttacgttaacg

SEQ ID NO: 11688 - DNA, 591 bp, Homo sapiens
  misc_feature: GYAE6OF02IP20G.16.5.A05.1.454.CMB.1.raw
  modified_base (311)..(311): a, c, t, g, unknown or other
  misc_feature (311)..(311): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtcgtgggggaggcgtggtccatccgtgggacgtccctgaccactctcctgcgtagcctcgtgggttcgtcttcgaggtaattagtggcatgacacgttggggtcccnccgagggcctccgagggcgaaggggtctgggaggtggggtgtcgggtttattcgatagtgagtaggaaaataaggaaagtactatcgacaacgtacctcggtaggaacgggccgactaccacctaatctccagagacaactaaccaaaacgtacgtactatctcactacctagacagcctagacgaccgtgacgacgcggtactagttagtttactgtacgacgtaacttccgtacgtaacttagtagtactttctttcgtacttcggttcttacttacg

SEQ ID NO: 11689 - DNA, 598 bp, Homo sapiens
  misc_feature: GYAE6OF02GMVGA.16.5.A05.1.454.CMB.1.raw
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtcgtgggggaggcgtggtccatcctgggatccctgacactctctgcgtagcctctgggttctcttcaggtaattagtggcatgcactcgggtccgccaggcctccgaggcaagggggctagggagtgggtggtcggtttattcatatgataggaaataagaaagactagtgacaagtactccggtaggaacgggccgactccgacctactcctaccgagacgaacaactaaccaaaaccgtacggtactactctacgacacctagaacacgtccacggacgacgtcggaacgacgacggtactagttcgtttacgtgttacgacgtaaactccgttacggtaactttactagttacgtttccgtttagtaccgtttggttacctactttaaccg

SEQ ID NO: 11690 - DNA, 712 bp, Homo sapiens
  misc_feature: GYAE6OF02I9BUI.16.5.A05.1.454.CMB.1.raw
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttccncgttgctcttttaagnggtgtccagtgtcaggtgcaactggtggagtcgtgggggagcgtggtccatccgtgggaagtcccctagacactctcctgccgtagccttcgtgggttcgtcttacaaggtaattagtggactagtcgcctacgttcggggtcccgccaggtcctaccgaggggaccgaagggggtcctggggaggttgggggtcggtacggtttatttcgaattatggaagttagggaaaaattaaggaaaacgtattaagcggaccgaagtacccgtaccgggtaggaaaccggggccctaactaccgaacccgacttacctaccgaacgaaacgtaaacctaaacgttaaacccaaaaaaccgtaccgggttacttaactaccgttacgaccctaaccgtacgtaacgaacgtccgtagaacgtacccgtaggacgggaaccacggtacttaacgttacgttttacctggttacgtaacggtaaacttacccgtacgtaacttacgtagttacttcgttttagccgtttagttacctactttacg

SEQ ID NO: 11691 - DNA, 248 bp, Homo sapiens
  misc_feature: GYAE6OF02GK1QM.16.5.A05.1.454.CMB.1.raw
  modified_base (244)..(248): a, c, t, g, unknown or other
  misc_feature (244)..(248): n is a, c, g, or t
tcagtgtactactccacgaccggtgctcgatttagatagatagacagggacagatttcacactgaagatcagcagggtggaaactgaggatgtcggagtttattactgcatgcaagctacactttttcctcacacttttggccaggggaccaggctggaaatcaaacgaactgtggctgcaccatctgtcttcatcttcccgcatctgagagtgtacactgagcgggctggcaaggcgcatagnnnnn

SEQ ID NO: 11692 - DNA, 263 bp, Homo sapiens
  misc_feature: GYAE6OF02IIZ51.16.5.A05.1.454.CMB.1.raw
  modified_base (253)..(263): a, c, t, g, unknown or other
  misc_feature (253)..(263): n is a, c, g, or t
tcagtgtactactccacgaccggtgctcgatttagatagatagacagggacagattttcacactgaagatcagcagggtggaaactgaggatgtcggagtttattactgcatgcaagctactactttttcctcactacttttggccgaggggaccaggctaggaaatcaaacgaactgtggctgcaccatctgtcttcatccttcccgccatctgagagtagtacactgagcgggctggcaaggcgcagtagnnnnnnnnnnn

SEQ ID NO: 11693 - DNA, 684 bp, Homo sapiens
  misc_feature: GYAE6OF02G2JB9.16.5.A05.1.454.CMB.1.raw
  modified_base (173)..(173): a, c, t, g, unknown or other
  misc_feature (173)..(173): n is a, c, g, or t
  modified_base (177)..(177): a, c, t, g, unknown or other
  misc_feature (177)..(177): n is a, c, g, or t
  modified_base (246)..(246): a, c, t, g, unknown or other
  misc_feature (246)..(246): n is a, c, g, or t
  modified_base (311)..(311): a, c, t, g, unknown or other
  misc_feature (311)..(311): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctctttaagnggtntccagtgtcaggtgcaacgtggtggagtcgtggggggagcgtggtccatccgtgggaacgtccctgacnctctcctgcgtagcctcgttgggttctcttcgaggtaattgtggcatcgctacgtcggggtcccncgaggcctaccgaggccggaaggggctaggggaggtggggtggtcggtttattcgagtatggaagtaaggaaaataaggaaagtactaagtgacgtaagacccgttacggtaggaacgggccctaactaccaacctactcctaccgaagaacaactaaacttaaccgaaaaacgtaccggtacttacgtacctacgacctaccgtacgaaccgtacgacccgtaggaccgtaaccgtaggaacggaccgtaacggtcttaacgttagtttacgtacggttacgtaaccgtaaacgttcccgttaacggttaactttacgtacgttacgttttaccgtttacggtaaccgtttcggttaccttaaccgttaacg

SEQ ID NO: 11694 - DNA, 652 bp, Homo sapiens
  misc_feature: GYAE6OF02HGFV0.16.5.A05.1.454.CMB.1.raw
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctcgttgctcttttaagaggtgtccagtgtcaggtgcaactggtggagtcgtgggggaggcgtggtccatccgtgggaatccctgacactctcctgcgtagcctcgtggggttccgtcttcgaaggtaattagtggcatgcacgtgggtcccgcgaggcctccgaggcgaagggggctgggagtagggtggtacggtttatttcagttagtaggagtaggaaaataaaggaaagacttagtacgacaagtaccgtcggtaggaacgggcccgtaactaccgaacctacttcctaccgagaacgaacctaaacttaacccaaaaacgtaccggtaccttaactcctgaccaccgtacgaacctacgaccgtagacgtaccgtaggaacggtaccgaacggtcttaagttacgtttacgtggtacgtaccggtaaacttccgtacgtactttacgtagttacgtttcgtttacgtacgttcggttacctactttaacg

SEQ ID NO: 11695 - DNA, 751 bp, Homo sapiens
  misc_feature: GYAE6OF02J11J3.16.5.A05.1.454.CMB.1.raw
  modified_base (702)..(702): a, c, t, g, unknown or other
  misc_feature (702)..(702): n is a, c, g, or t
tcagtgtactactccacgaccggtgctcgatttagatagatagacagggagctctgggagaggagcccagcactagaagtcggcggtgtttccattcggtgatcagcactgaacacagaggactcaccatggagtttggctgcgctggttttcctcgtgcttcttttaagaggtcgtccagtgtcaggtcgcaacgtggttggagtcgtagggggacggcgtcggtcccagttcccgtaggggtaacgttcccctaggacctctccgttccgtggcgttacgccgtcgttaggttccgtaccttcgaggtacttagtggtacagtcgtcgacgtcgggtccgcgtacggtcctaccggacggaccgaaggggtcctggggtacggttgggtcgggtaccggttttatttacaacgtttacgtaggtaagttaaaccggtaaaagtaaacggtaaaaggtcccgttaattcgggaaccgtaggtaaccccgtacgggttaacgggaaacgggtcctaaaccgtccgaaccttacgtaccgtaccgaacggtactaaacctaaacttaaaccgaaaacgttccgtaactacgttcgagtcccacgtaacgacgtacgaccgtagaccgtacgtcggaacgtaccgcggttacttagttacgtttagtagtacgtaacgttaaaccgtccgttataacccgtttntcgtttacgttactttcggaaccgtttcgtaccgttaacctttaacggg

SEQ ID NO: 11696 - DNA, 667 bp, Homo sapiens
  misc_feature: GYAE6OF02JEP7E.16.5.A05.1.454.CMB.1.raw
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggtttcctcgttgctctttaagaggtgtccagtgtcaggtgcaactggtggagtctgggggaggcggtggtccatcctgggaacgtccctgacactctcctgcgtagcctcgtgggttcgtcttcaggattatggcatcgcacgttgggtcccgccgaggcctccgaggcgaaggggctgggacggtgggtggtcggtttattcgaattataggtagtaggaaaattaaggaaacgtactagtggacaaggtacctacggtaggtaacgggaccgtacctaccgaacctacgtccgtaccgaaggaacgaactaaacttaaccgaaaaaccgtacgtacttaacgtacgtacgacctacctacgaacgtacgacctacggacgaccgtaggaacggtaaccgacggtacttaacgtttacgtttactaggtacgtaccggtaaacttcccgttaacgtacgtttacgttacgttaacgtttcgtttacgtaccggttcgttacccgtactttaaccgg

SEQ ID NO: 11697 - DNA, 747 bp, Homo sapiens
  misc_feature: GYAE6OF02IEITZ.16.5.A05.1.454.CMB.1.raw
  modified_base (267)..(267): a, c, t, g, unknown or other
  misc_feature (267)..(267): n is a, c, g, or t
  modified_base (291)..(291): a, c, t, g, unknown or other
  misc_feature (291)..(291): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgcttggggttttcctcgttgctctttttaagaggtgtccagtgtcaggtgcaactggtggagtcgtggggggaggcgtggtccatccgtgggaacgtccctgacactctcctgcgtagcctntcgggttctcttcaggtattacgnggctatgccacgttcgggcccgccgtacggctcccggaggtcggaaaggggtctgggtaggttgggggtcgtcggtttatttcgattacgtgtaatgggaaaataaggtaaaagtacgtaagtaggacaagtaccgtccggtagggaaaccgggcccgtaacttaccaaccctattaccctcgtaacggaacgtaaacctaaacgttaaaccccaaaaacgtacccggttaactaacgtttccacggtaccctacccgttaaggaacccgtacgccctaacgggtaccgtaaccggttaggaaccggggtaccgaaccgggtacttttaagtttacgtttttaccggttacggttaaccggtaacggttaaaccgttccccgttacgttaaccgtttagtacggttacttttaccgttttcggtaccgtttacggttacccttacttttaacccgg

SEQ ID NO: 11698 - DNA, 351 bp, Homo sapiens
  misc_feature: GYAE6OF02IZABE.16.5.A05.1.454.CMB.1.raw
  modified_base (340)..(351): a, c, t, g, unknown or other
  misc_feature (340)..(351): n is a, c, g, or t
tcagtgtactactccacgaccggtgctcgatttagatagatagacagggttgcagtgggcggggctggccacccccctgcctcatgtctaggtcccagccccgcccactgcaaccctgtgcccgtcatgcccagcaggctcctgctccagcccagcccccagagagcagaccccaggtgctggccccgggggttttggtctgagcctcagtcactgtgttatgtcttcggaactgggaccaaggtcaccgtcctaggtcagcccaaggccaaccccactgtcactctgttccccgccctcctcgagtacgtacactgagcgggctggcaaggcgcatagnnnnnnnnnnnn

SEQ ID NO: 11699 - DNA, 595 bp, Homo sapiens
  misc_feature: GYAE6OF02GE09I.16.5.A05.1.454.CMB.1.raw
  modified_base (176)..(176): a, c, t, g, unknown or other
  misc_feature (176)..(176): n is a, c, g, or t
  modified_base (246)..(246): a, c, t, g, unknown or other
  misc_feature (246)..(246): n is a, c, g, or t
  modified_base (284)..(284): a, c, t, g, unknown or other
  misc_feature (284)..(284): n is a, c, g, or t
  modified_base (412)..(412): a, c, t, g, unknown or other
  misc_feature (412)..(412): n is a, c, g, or t
  modified_base (471)..(471): a, c, t, g, unknown or other
  misc_feature (471)..(471): n is a, c, g, or t
tcagtgtactactccacgaccggtgctcgatttagatagatagacagggggagctctgggagaggagcccagcactagaagtcggcggtgtttccattcggtgatcagcactgaacacagaggactcaccatggagtttgggctgcgctgggttttcctcgttgcttcttttaagnggtgtccagtgtcaggtgcaactggtggagtcgtggggggagcgtggtccatccgtgggaatccctgacnctctctgcgtgcctctgggttcgtcttcaggaattagnggcatcgctacgtcggggtcccgcgaggcctccgaggcgaagggggctgggaggttgggtggtcggttattcatagtgagtaggaaataagaaagctatgactaagacctcggtaggaacgggccacncaaccatcctaccagagaactaacttaaccaaaacgacgtactaatcacgaccacctanaacacgtaccgagacgaccgtaggacgaacctacggcttaagttgtttactgttacgaacgtaactccgtacgttaacttagtcgttactttcgtttagtacgttacggttacctactttaacg

SEQ ID NO: 11700 - DNA, 773 bp, Homo sapiens
  misc_feature: GYAE6OF02HR1NE.16.5.A05.1.454.CMB.1.raw
  modified_base (192)..(192): a, c, t, g, unknown or other
  misc_feature (192)..(192): n is a, c, g, or t
  modified_base (223)..(223): a, c, t, g, unknown or other
  misc_feature (223)..(223): n is a, c, g, or t
  modified_base (261)..(261): a, c, t, g, unknown or other
  misc_feature (261)..(261): n is a, c, g, or t
  modified_base (316)..(316): a, c, t, g, unknown or other
  misc_feature (316)..(316): n is a, c, g, or t
tcagtgtactactccacgaccggtgctcgatttagatagatagacaggggagctctgggagaggagcccagcactagaagtcggcggtgtttccattcggtgatcagcactgaacacagaggacctcaccatgggtagtttggggctggcgccgttggggtttttcctcggttgcttctttttaaggaggtntccagtgtcaggtgcaacgtggtggagtcgngggggagcggtggtccatccgtagggactccctgaccnctctccgtgccgtacgtcctcggtcgggttctcttacgaggtaattaggtggtcngtcgctcgtcgggcccgcgacggcctaccgaggccggaggggcgtggggacggttggggtagggtcgtttacgttagattagtagtagtaaggtaaaagtaagaaagtactagtcacgacgttaccgtacggtacgggaccggaccgtacctacctacccgtacttacccgacgaaggtaaaccgtaaacctaaaccgttaaaccctaaaaccggtccgttaccttacttaccgacgtaccgaaccgttaccaacgcgttaccgacgtaccgtaccgtacgggtaacgaccggtaccggttacgtttacgttttacgtttaaccgggtacgttaacgggtaaccgttaacggtttaccccgttaacgttaacccggtttagtttacggtttacttttaccggttttaaccgttaaccggggttttacggtttaccccgtttaaacttttaacccggg

SEQ ID NO: 11701 - DNA, 675 bp, Homo sapiens
  misc_feature: GYAE6OF02FRJCZ.16.5.A05.1.454.CMB.1.raw
  modified_base (279)..(279): a, c, t, g, unknown or other
  misc_feature (279)..(279): n is a, c, g, or t
tcagtgtactactccacgaccggtgctcgatttagatagatagacaggggagctctgggagaggagcccagcactagaagtcggcggtgtttccattcggtgatcagcactgaacacagaggactcaccatggagtttgggctgcgctgggttttcctgttgcttcttttaagaggtgtccagtgtcaggtgcagtggtggagtcgtgggggagtcgtggtccatccgtagggacgtccctgacactctctgcgtagcctcgtgggttctctgagtatntggcatgctagtcgggtccgccaggcctcggaaggcgaacggggctagggaggttggggtggtacgtttattcgatagtgaagtaggaaaataaggaaaactctagtcgacgagtccgttaccggaggaccggggtcctaccgtaccgaactacgttcctaccgaaggtaaccgtaactaacccgtaaaccgtaaaaacccgtacggttaacctaacgttaccctacgtaccctaccgtaactaacgacgtaccgtagacgtaccggagacggaccgtacgtacgttagttacgtttacgtacggtaccggtaaggtaacccttaccggtacgttaactttaaggttaccgttaggttttactttcggttaccttacggttaccttacttaaccgg

SEQ ID NO: 11702 - DNA, 721 bp, Homo sapiens
  misc_feature: GYAE6OF02JYQ1M.16.5.A05.1.454.CMB.1.raw
  modified_base (307)..(307): a, c, t, g, unknown or other
  misc_feature (307)..(307): n is a, c, g, or t
tcagtgtactactccacgaccggtgctcgatttagatagatagacaggggagctctgggagaggagcccagcactagaagtcggcggtgtttccattcggtgatcagcactgaacacagaggactcacatgggagtttgggctgcgcgttgggttttcctcgttgcttacgttttaagaggttgtccaggtgtcgaggtgactacgtggtcggaggtcggtgggggacgcgtggtccagtccgtgggaactccctagacactctccgtgcgtacgcctgtcgggttcctcgttcgaaggtaattagnggatactggcgtacggtcgggtacccgacgacggcctaccggaagggtacggtaacggggtcgtaggggtagggttgggggtaccgggtacgttttaagttcgaagttacgtaggtaaagtaaggtaaaagtaaacggaaacgtaactgtaggaacctacggtaccggtacgggtaaggaccgggcctaactaccgaacctacgtccgaaccgaagaaccgtaaacttaaaccaaaccgaaacgtcgtactaacgtactacgaacaacgtacgaacctgaccgtagaccgtaacgacggacgaccgtcgtagttacggttagtttacgacgttacgtaaccgtaacgttcccgtagttaacgttagttacttaacggtttacgttccgttaacggtctttacctacgtttaacg

SEQ ID NO: 11703 - DNA, 830 bp, Homo sapiens
  misc_feature: GYAE6OF02HDGV9.16.5.A05.1.454.CMB.1.raw
  modified_base (157)..(157): a, c, t, g, unknown or other
  misc_feature (157)..(157): n is a, c, g, or t
  modified_base (173)..(173): a, c, t, g, unknown or other
  misc_feature (173)..(173): n is a, c, g, or t
  modified_base (191)..(191): a, c, t, g, unknown or other
  misc_feature (191)..(191): n is a, c, g, or t
tcagtgtactactccacgaccggtgctcgatttagatagatagacaggggagctctgggagaggagcccagcactagaagtcggcggtgtttccattcggtgatcagcatgaacacagaggactcaccatggagtttgggctgcgctgggttttccngttgcttactttaagnggtgtccagtgtcaggtncaacgtggtggagtcgtggggggacgtcgttcggtccaagttcccgtaggggtaaaccttcccctaggaacctaccttcctcccggtaagtccggttacggtcccgtttcggttcgggggtttccgttacttaccggtaaaggggtaaacttttacggtacggtaccttacggtcgacccgttaaccggggttccgggggtaaccccgcccgtaaggccccgttaccgaacggggtacgggaacgggggtcctaggggtaccgggttggggtacgggttacggttttaactttcgaacgttttaggaccggttaaggtaaacggtaaaaattaaacggggtaaataacgtagttacggaacgtaacggtaccgttaaccggagggtaaaccggccgtacgtaccgtaaccctctaccgaaccgagtacgtaaacgtaaaccgttaaacccgaaaaccgtccggttacttacgtcgtacgacctaaccgtacgaccgtacgtacgtaacgccgtaacctagggaccgtaacgtcgtaacgttcgtttaggtttacacggttacgttaaccgtaaccgttacgtacgtatttacgtaacgttccgtttacgttacgtaggttccgttactaccgttaacgg

SEQ ID NO: 11704 - DNA, 856 bp, Homo sapiens
  misc_feature: GYAE6OF02IPEJ3.16.5.A05.1.454.CMB.1.raw
tcagtgtactactccacgaccggtgctcgatttagatagatagacaggggagctctgggagaggagcccagcactagaagtcggcggtgttccagttcggtgatcagcactagaacacagagactcacagtggtagttggctgcgtcgttcggttttcctcgttgtctttacgtttttttaaggaggttcgtaccgtagttcgtcgtaggtcgacgtaacggttggtaggtacggttcgggtagggggtacggtcggttacggtccgtacgttccggtacgggtaccgttcccgtacgacctccgttcctccgtcgtaccgtaccgtccgttcggttacggtttccgttccgttacgtaaggttagttacgtacgtcgtagtacgtccgtacggttccgggtcccggaccggtaccggtaccgtaccggaacgggtaccgggtaacggggtcggtaggggtcgggttcggggttacggtttacggtttacgtttacgtaagtagtagtaagtaaagtaaagtaagaatacgtagtacgacgtacgtaccgtacggtacggaccggacctacgtacctactacgtccgaacgaagaaccgtaacctaaaccgtaaacccgaaaccggtacgttactaacgttaccgtaccgtacccgaaccgtaacgacgtaccgtaccgtacgtaaccgtaccggagggaaccgtaaccgttacggttacgtttagtttaccgtttacggtacgttaccgttaaacccgttaaccggttacccgttaacggtttacgttacgtttaaccggttttcgttaccggttttaccggttaccggttccgtttaaccgtttaccgttacgg

SEQ ID NO: 11705 - DNA, 829 bp, Homo sapiens
  misc_feature: GYAE6OF02IEA39.16.5.A05.1.454.CMB.1.raw
  modified_base (158)..(158): a, c, t, g, unknown or other
  misc_feature (158)..(158): n is a, c, g, or t
  modified_base (177)..(177): a, c, t, g, unknown or other
  misc_feature (177)..(177): n is a, c, g, or t
  modified_base (199)..(199): a, c, t, g, unknown or other
  misc_feature (199)..(199): n is a, c, g, or t
  modified_base (345)..(345): a, c, t, g, unknown or other
  misc_feature (345)..(345): n is a, c, g, or t
  modified_base (705)..(705): a, c, t, g, unknown or other
  misc_feature (705)..(705): n is a, c, g, or t
tcagtgtactactccacgaccggtgctcgatttagatagatagacaggggagctctgggagaggagcccagcactagaagtcggcggtgtttccattcggtgatcagcactgaacacagaggactcacagtggagtttggctgcgcttgggttttccngttgtcttacgttttaagnggttcgtccagttgtcgaggtnacaacgtgggtggacgtcggtggggggacgtgggttcggtaccacgttccggtaggggtaaccttcccgtaggaacctccttcgtcccgtggtaccgtacgtccctttggttcggggttcctaatttcggaaaggttatttacggnggactagtcgtaacggtccggttcggggacccccgtaccgtagggcccccttaagggaacggggacgggtaacggggtcggttaaggggtcgggggtttaggggggtcggttttacggttttaaactttaacgaacgttaacggttaggaacggtttaaaaagggaaaataaaggtaaaagtacgttaggtaacgaccgaaggtaaccccgttacggggtaaggaaacccgggtccctaaacctaccgtactaacccgttaccgttaacaacgtaacgaaaccttaaaccgtaaacccgtaaaacgtcgtttacacgttcgacgacctacgtacgaacctacgtccgtaagaccgtaacncgggaaacgcgttaccgtatttacgttagttttacgacgttaaccggacgttaacctacccggttattaacgttaacgtcgtaacgttttctaccgtacggttacgttactaacgtttaaccgg

SEQ ID NO: 11706 - DNA, 931 bp, Homo sapiens
  misc_feature: GYAE6OF02FS3W7.16.5.A05.1.454.CMB.1.raw
tcagtgtactactccacgaccggtgctcgatttagatagatagacaggggagctctgggagaggagcccagcactagaagtcggcggtgtttccagttcggtgatcagcactgaacacagaggactcaccatggagtttgggctgcgcgttgggttttcctcggttgccttctttttaaaggagggttcgtccagtcgttacgagggtgacaacgttgggtggaggttcgtggggggagtcggttacggtccctatccgttaggggaactcccctagacctacgttcctccgttggccgttacggccctttcgttcgggggtttccttcgtttaccgaaggtaatttacgtgggacctattcggacctaaccggttcggggtaccccgacccggtaaggtccccttaccggaacgggtaccgggaaacggggggtcctttaggggggtaacgggtttcggggggttacgggttacccgggtttttaaattttccggaaacgttttaacggttacggaaacggttttacggggaaaaaaagttaaacggggaaaaaccggtttacgtttaaaggtcccggtaaacgtaaaccgggttaccccgtttaaccgggggtaagggaaaaacccggggttcctaaacccgtaccgtaacccgtaacgttacccgtaaccgtaacggtaaccggtaaaccttaaaacgtttaaacccgaaaaaccgtaccggttaaccttaacgtacgtacgtacccgtaacccgtacggaaaccgtaccgtacccgtacggtaaccgtacccgtacggaacgggaaccgtaccggttacgttacgtttacgttttacgttacggtacggtaaccgtaacttaccgtaccgttacttacgttagttacgtttacgtttacgtaccgttacggttaccgttacgttacg

SEQ ID NO: 11707 - DNA, 311 bp, Homo sapiens
  misc_feature: GYAE6OF02FMTVL.16.5.A05.1.454.CMB.1.raw
  modified_base (132)..(132): a, c, t, g, unknown or other
  misc_feature (132)..(132): n is a, c, g, or t
  modified_base (147)..(147): a, c, t, g, unknown or other
  misc_feature (147)..(147): n is a, c, g, or t
  modified_base (276)..(311): a, c, t, g, unknown or other
  misc_feature (276)..(311): n is a, c, g, or t
tcagtgtactactccacgaccggtgctcgatttagatagatagacagggggagctctgggagaggagcccagcactagaagtcggcggtgtttccattcggtgatcagcactgaacacagaggactcaccanggagtttggctgcgnttgggtttcctcgttgcttcttttaagaggtgtccctagtgtcaggtgacaacgtgggtgggagtcggtggggggacggtcggttcgggtccagttcccgtagggggtaactcccccgtggacctaccnnnnnnnnnnnnnnnnnnnnnnnnnnnnnnnnnnnn

SEQ ID NO: 11708 - DNA, 151 bp, Homo sapiens
  misc_feature: GYAE6OF01A8YJV.46.83.H06.1.454.CMB.1.raw
  modified_base (151)..(151): a, c, t, g, unknown or other
  misc_feature (151)..(151): n is a, c, g, or t
tcagactagcagtacacgaccggtgctcgatttagatcacgtgcgtccgcgggacacgactggagattaaacgaactgtggctgcaccatctgtcttcatcttcccgccatctgaagtactctatctgagcgggctggcaaggcgcatagn

SEQ ID NO: 11709 - DNA, 204 bp, Homo sapiens
  misc_feature: GYAE6OF01AF7OG.46.83.H06.1.454.CMB.1.raw
  modified_base (151)..(204): a, c, t, g, unknown or other
  misc_feature (151)..(204): n is a, c, g, or t
tcagactagcagtacacgaccggtgctcgatttagatcacgtgcgtcgcgggacacgactggagatttaaacgaactgtggctgcaccatctgtcttcatcttacccgcatctgaagtactctatctgagcgggctggcaaggcgcatagnnnnnnnnnnnnnnnnnnnnnnnnnnnnnnnnnnnnnnnnnnnnnnnnnnnnnn

SEQ ID NO: 11710 - DNA, 149 bp, Homo sapiens
  misc_feature: GYAE6OF02H67ID.46.83.H06.1.454.CMB.1.raw
  modified_base (149)..(149): a, c, t, g, unknown or other
  misc_feature (149)..(149): n is a, c, g, or t
tcagactagcagtacacgaccggtgctcgatttagatcacgtgcgtcgtgggacacgactggagattaaacgaactgtggctgcaccatctgtcttcatcttcccgcatctgaagtactctatctgagcgggctggcaaggcgcatagn

SEQ ID NO: 11711 - DNA, 172 bp, Homo sapiens
  misc_feature: GYAE6OF02GK0DU.46.83.H06.1.454.CMB.1.raw
  modified_base (149)..(172): a, c, t, g, unknown or other
  misc_feature (149)..(172): n is a, c, g, or t
tcagactagcagtacacgaccggtgctcgatttagatcacgtgcgtcgcgggacacgactggagattaaacgaactgtggctgcaccatctgtcttcatcttcccgccatctgaagtctctatctgagcgggctggcaaggcgcatagnnnnnnnnnnnnnnnnnnnnnnnn

SEQ ID NO: 11712 - DNA, 152 bp, Homo sapiens
  misc_feature: GYAE6OF02IHRIH.46.83.H06.1.454.CMB.1.raw
  modified_base (149)..(152): a, c, t, g, unknown or other
  misc_feature (149)..(152): n is a, c, g, or t
tcagactagcagtacacgaccggtgctcgatttagatcacgtgcgtcgcgggacacgactggagattaaacgaactgtggctgcaccatctgtcttcatcttcccgcatctgaagtactctatctgagcgggctggcaaggcgcatagnnnn

SEQ ID NO: 11713 - DNA, 163 bp, Homo sapiens
  misc_feature: GYAE6OF02IM2AN.46.83.H06.1.454.CMB.1.raw
  modified_base (148)..(148): a, c, t, g, unknown or other
  misc_feature (148)..(148): n is a, c, g, or t
  modified_base (153)..(163): a, c, t, g, unknown or other
  misc_feature (153)..(163): n is a, c, g, or t
tcagactagcagtacacgaccggtgctcgatttagatcacgtgcgtccgcgggacacgactggagattaaacgaactgtggctgcaccatctgtcttcatcttcccgcatctgaagtactctatctgagcgggctggacgaaggccgnatagnnnnnnnnnnn

SEQ ID NO: 11714 - DNA, 316 bp, Homo sapiens
  misc_feature: GYAE6OF01A0AMY.52.2.A02.1.454.CMB.1.raw
  modified_base (312)..(316): a, c, t, g, unknown or other
  misc_feature (312)..(316): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttccgcatctgatatacgatcgctgagcgggctggcaaggcgcatagnnnnn

SEQ ID NO: 11715 - DNA, 319 bp, Homo sapiens
  misc_feature: GYAE6OF01D59AR.52.2.A02.1.454.CMB.1.raw
  modified_base (312)..(319): a, c, t, g, unknown or other
  misc_feature (312)..(319): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggaggaccaaggtgagatcagacgaactgtggctgcaccatctgtcttcatcttcccgccatctgatatacgatcgctgagcgggctggcaaggcgcatagnnnnnnnn

SEQ ID NO: 11716 - DNA, 480 bp, Homo sapiens
  misc_feature: GYAE6OF01DBX5P.52.2.A02.1.454.CMB.1.raw
  modified_base (428)..(428): a, c, t, g, unknown or other
  misc_feature (428)..(428): n is a, c, g, or t
  modified_base (457)..(457): a, c, t, g, unknown or other
  misc_feature (457)..(457): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaaccagggaaagcccctaaaactcctgatcctcgatgcatccaatttggaaacagggtccatcaaaggttcagtggaagtggctctgggacagattttacttcaccatcgcagactgcagcctgaagatattgcaaacatattaatgtcaaacagtatgataaatctcccgntcactttcggcggaggaccaaggtggagntcagacgaaactgtggctgcacc

SEQ ID NO: 11717 - DNA, 477 bp, Homo sapiens
  misc_feature: GYAE6OF01BUPLC.52.2.A02.1.454.CMB.1.raw
  modified_base (383)..(383): a, c, t, g, unknown or other
  misc_feature (383)..(383): n is a, c, g, or t
  modified_base (457)..(457): a, c, t, g, unknown or other
  misc_feature (457)..(457): n is a, c, g, or t
tcagcgcagtacgacacgaccggtgctcgatttagactcatctacaggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacagggtccatcaaggttcagtggaagtggctctgggacagattttactttcaccatcgccagactgcagcctgaagntattgcaacatattactgtacaacagtatgtataatctcccgctcacgtttcggcggaggaccgaaggtggagntcagacgaactgtgctgcac

SEQ ID NO: 11718 - DNA, 472 bp, Homo sapiens
  misc_feature: GYAE6OF01BKC3K.52.2.A02.1.454.CMB.1.raw
  modified_base (385)..(385): a, c, t, g, unknown or other
  misc_feature (385)..(385): n is a, c, g, or t
  modified_base (453)..(453): a, c, t, g, unknown or other
  misc_feature (453)..(453): n is a, c, g, or t
tcagcgcagtacgacacgaccggtgctcgatttagactcatctacagggggagtcagtcccaaccaggacacagcatggtcatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacagggtccatcaaggttcagtggaagtggctctgggacagtattttactttcaccatcgccagactgcagcctgaagntattgcaacatattactgtcaacagtatgataatctccgctcactttcggcgaggaccaagggtgagntcagacgactgtgctgcac

SEQ ID NO: 11719 - DNA, 318 bp, Homo sapiens
  misc_feature: GYAE6OF01ENWXH.52.2.A02.1.454.CMB.1.raw
  modified_base (312)..(318): a, c, t, g, unknown or other
  misc_feature (312)..(318): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgcatctgatatacgatcgctgagcggctggcaaggcgcatagnnnnnnn

SEQ ID NO: 11720 - DNA, 478 bp, Homo sapiens
  misc_feature: GYAE6OF01A334M.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacagggtccatcaaggttcagtggaagtggctctgggacagtattttactttcacatcgcagactgcagcctgaagatattgcaacatattactgtacaacagtatgataatctcccgctcactttcggcgtagggaccagggtgagatcagacgtaactgtagctgcaccg

SEQ ID NO: 11721 - DNA, 483 bp, Homo sapiens
  misc_feature: GYAE6OF01AW94J.52.2.A02.1.454.CMB.1.raw
  modified_base (461)..(461): a, c, t, g, unknown or other
  misc_feature (461)..(461): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaagcccctaaaactcctgatcctcgatgcatccaatttggaaacaggggtcccatcaaggttcagtggaagtggctctgggacagtattttactttcacatcgccagactgcagcctgaagatattgcaacatattactgtacaacagtatagataatctcccgctcgtacttcggcggagggaccaaggtggagancagacgaactgtagctgctacc

SEQ ID NO: 11722 - DNA, 523 bp, Homo sapiens
  misc_feature: GYAE6OF01AJLGI.52.2.A02.1.454.CMB.1.raw
  modified_base (191)..(191): a, c, t, g, unknown or other
  misc_feature (191)..(191): n is a, c, g, or t
  modified_base (388)..(388): a, c, t, g, unknown or other
  misc_feature (388)..(388): n is a, c, g, or t
  modified_base (404)..(404): a, c, t, g, unknown or other
  misc_feature (404)..(404): n is a, c, g, or t
tcagcgcagtacgacacgaccggtgctcgatttagactcatctacagggggaggtcagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacttgccgggcgagtcaggacattaacatgtatctgaattggtatcagcagaaccagggaagcccctaaactcctgatcctcgatgcatccaatttggaacagggtccatacaagttcagtggaagtcggctcgtgggactagtattttactcaaccatccgcagactgcaagcctagaagtntagttgactaacattnttaactgtacaactagtatagattaactccttaccgacttcgtaactttcgggccgaagggtccctaaagggttcgaggtactcgaagaccgtaacttgggtacggcttgccctaaccg

SEQ ID NO: 11723 - DNA, 538 bp, Homo sapiens
  misc_feature: GYAE6OF01C4520.52.2.A02.1.454.CMB.1.raw
  modified_base (312)..(312): a, c, t, g, unknown or other
  misc_feature (312)..(312): n is a, c, g, or t
  modified_base (342)..(342): a, c, t, g, unknown or other
  misc_feature (342)..(342): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagacaagaaaccagggaaacgcccctaaatcctgactcctcgatgcatccaatttggaacngggtccatcaaggttcagtgaagtgctcgnggacagtattttacttcacatcgcagactgcagtctagaagatattgactaactattattactagtacaaacgtagttaactgtaacttaactccttaccccgcttaccgttaccgtttaccggggacgggtaacgggaacccgtaagggtggacgtacgtacgaaggaccgtaacgttggtcgtctgcctaaccg

SEQ ID NO: 11724 - DNA, 768 bp, Homo sapiens
  misc_feature: GYAE6OF01EFNH0.52.2.A02.1.454.CMB.1.raw
  modified_base (237)..(237): a, c, t, g, unknown or other
  misc_feature (237)..(237): n is a, c, g, or t
tcagcgcagtacgacacgaccggtgctcgatttagactcatctacagggggagtcaggtcccaaccaggacacagcatggacatgagggtccctgctcagctccgtcggggctcctgctgcctcgtggcctctcaggtcgccagatcgtatcatccagatcgacccagtcctcatccctccctgtcctgctactcctagtacggagacagtaatccgaaccatcacgttcgccgggnagtcaggacctagttaacatgtatctagtaattggtatcagacagaaaccgaggaaacaccctaaacgtcctacgactccgtacgactcgactactacctaagtttacggaaacctacgggttacccaagttacgtaaacgggttcgaaggtacgggaagttcggacttacggtacggggaacttaaggttaaccttttttaaccgtttaccgaaccgttacgttcccggtaacccgtaaggtacctttacggacccgtaacgtaccccgttaaggtaaacgtactttaacgttacggaaccgtaaacctaagttttaacccgtttaacgtacgtttaaccgtaaaaccgttaggtttaactaaggttaaactttaaacgttccccgttaaccctacgtttaacctaacggtttacccggggaacggtaaccggggtaacccgttaaagggttacgggaaccggtacgtaacccggaacgtaaacgggttaacgttacgggaccgggttaactaccgggtaccctaaccgg

SEQ ID NO: 11725 - DNA, 319 bp, Homo sapiens
  misc_feature: GYAE6OF01C09LT.52.2.A02.1.454.CMB.1.raw
  modified_base (312)..(319): a, c, t, g, unknown or other
  misc_feature (312)..(319): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggatggaccaaggtggagatcagacgaactgtggctgcaccatctgtcttcatcttcccgcatctgatatacgatcgctgagcggctggcaaggcgcatagnnnnnnnn

SEQ ID NO: 11726 - DNA, 554 bp, Homo sapiens
  misc_feature: GYAE6OF01CSFBA.52.2.A02.1.454.CMB.1.raw
  modified_base (461)..(461): a, c, t, g, unknown or other
  misc_feature (461)..(461): n is a, c, g, or t
tcagcgcagtacgacacgaccggtgctcgatttagactcatctacagggggtgagtcagtcccaaccaggacacagcatggacatggagggtccctgctcagctccgtgggctcctgctgctctggctctcaggtgccagatgtatcatccagatgacccagtctccatcctccctgtctgcatctataggagacagaatcaccatcacttgccgggcgagtcaggacattaacatgtatctgaattggtatcagacaaaaaccagggacacgaccctaaactcctgactcctcgatgactatccaacgtttaggaaactacgggggtcccaataccgtaaaggttcaggtaggtaaagtggtactcgtaggggactaggttacttttactttcaaccattcaagtcaggtctgcagcctagaagatagtgacaatattattacgtgtaacaacgtaagtntagtataacgtctcccgtctactaccggtttcggggaccgggggacctaagggtggagactagaaacgtcgaaactggtacggctggtaaccc

SEQ ID NO: 11727 - DNA, 503 bp, Homo sapiens
  misc_feature: GYAE6OF01BEJL6.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgacccctaaactcctgatcctcgatgcatccaatttggaaacagggtccatcaaggttcagtggaagtggctctgggacagtatttacttcaccatcgccagactgcagcctagaagatattgacaacattattactgtacaactagtatagtaataactctcccgctcacttcggacggacgggtaccgaaggtggagtactacgaagaacgtaactggtaggctggctaaccg

SEQ ID NO: 11728 - DNA, 504 bp, Homo sapiens
  misc_feature: GYAE6OF01CCX04.52.2.A02.1.454.CMB.1.raw
  modified_base (216)..(216): a, c, t, g, unknown or other
  misc_feature (216)..(216): n is a, c, g, or t
  modified_base (435)..(435): a, c, t, g, unknown or other
  misc_feature (435)..(435): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattaacatgtatctgaattggtatcagcagaaaccagggaaagcccctaaactcctgactcctcgatgcatccaattggaaacagggtccatcaaggttcagtggaagtggctgtgggacagtattttacttcacatcgccagactgcagcctagaagatattgactaacattattactgtacaaactagtatagtataactctacccgntctacgtttcggcggtagggaccgaagggtaggagtactacgaagacgtaactggtggcttgcctaacc

SEQ ID NO: 11729 - DNA, 708 bp, Homo sapiens
  misc_feature: GYAE6OF01ER65Z.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcaagaaaccgagggaaacgcccctaaactcctagactcctacgatcgctactacctaaagttttagggaaaaccgtacgggggttaccccaagttacgtaaagggtttccgaaggttagggtaaaggttcgggccgttacgtaggggtacctaaggttactttttaccgtttcaacctacgttcccggtacccaaggtaccttcggacctaacggcccttagggaaagtactttaagtttacggaacctaaactaatttaacttttaacctagttaaccaaacgttaaggttaacttaggtaaactttaaacttcccttacccccggtacttacccgtaccggttttccggggaccgggtaacgggggtaacccgtaaagggggtgggaacggtacgttaccgaaacgggtaaccggtaaacgttcgggtagggtaccgttaggcccgtaaacccg

SEQ ID NO: 11730 - DNA, 540 bp, Homo sapiens
  misc_feature: GYAE6OF01AB6Q0.52.2.A02.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (306)..(306): a, c, t, g, unknown or other
  misc_feature (306)..(306): n is a, c, g, or t
  modified_base (397)..(397): a, c, t, g, unknown or other
  misc_feature (397)..(397): n is a, c, g, or t
  modified_base (413)..(413): a, c, t, g, unknown or other
  misc_feature (413)..(413): n is a, c, g, or t
tcagcgcagtacgacacgaccggtgctcgatttagactcatctacagggggagtcagtcccaaccaggacacagcatggacatgagggtccctgctcagctcctgggctcctgctgctctggctctcaggtgccagatgtatcatccagatgacccagtctccatcctccctgtctgcatctatagganacagaatcaccatcacttgccggnagtcaggacattaacatgtatctgaattggtatcagcagaaaccagggaaagccctaaactcctgatcctcgatcgcatccaatttggaaacngggtccatcaaggtcagtggaagtggctgtgggactaggtattttacttcacctattcgaccagactgcaaggcctgaagatattgacaanatattactgtaccaanacgtatgtaactaacttcctacccgtcttaccgtaccgttttcgggaccgggtaacgggacccgtaaaggggtcggaaggtacgttacgaaggtaccgtaacgttggtacggccttagcgtaacccg

SEQ ID NO: 11731 - DNA, 574 bp, Homo sapiens
  misc_feature: GYAE6OF01C6EIF.52.2.A02.1.454.CMB.1.raw
  modified_base (216)..(216): a, c, t, g, unknown or other
  misc_feature (216)..(216): n is a, c, g, or t
  modified_base (314)..(314): a, c, t, g, unknown or other
  misc_feature (314)..(314): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggngagtcaggacattaacatgtatctgaattggtatcagcagaaaccagggaaacgcccctaaactcctgactcctcgatcgcataccaatttggaaacncggggtccatcaaggttcagtggagtggctctgggactagtattttacttcacctatccgcagactgacagcctagaatatattcgactaactatttaatttactacgtacaaactaacgttaatagtaattaaacttcccgttaccccgtcgttaccttaccggttttccggggacgggacggggtaacccgtaaggggttggaacggtataccggaaggaaccggtaacgttgggtacgggccttaggccctaacccg

SEQ ID NO: 11732 - DNA, 515 bp, Homo sapiens
  misc_feature: GYAE6OF01AK7PL.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaactcctgatcctcgatgcatccaatttggaaacagggtccatcaaggttcagtgaagtggctcgtgggacagtattttacttcactatcgccagctgcagcctagaacgatacttagcaaactataattactagtacaactagtatagtaatactctacccgcttcacgtttcggcggtaagggacccgtaagggtcgagtactacgaaggtacgtaaacgtggtaggacttgctaccg

SEQ ID NO: 11733 - DNA, 893 bp, Homo sapiens
  misc_feature: GYAE6OF01DAEZF.52.2.A02.1.454.CMB.1.raw
  modified_base (238)..(238): a, c, t, g, unknown or other
  misc_feature (238)..(238): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtanctgaattggtatcagcagaaccagggaaacgacccctaaactccgtgactcctcggatgactactaccaattttacgggaaaaccgtacgggggtacccctagtaccgtaaacgggtttaccgaaggttacgggaaaggttcggggtacctttaccgggttgggggtaaacctaaggtttaactttttttaacccgttttacctaaccccgtaacgtttaccccggaccccgtaaacggtacccgttaggaccccgtaacggtaccccgttaaggtaaaccggttaatttaacgttttacgggaaccctaaaaccgttaacgtttttaaacttttaacccgttttaacgggtttaaccctaaaacccgttaacgggttttaaaagtttaacggggttaaaccgttttaaacctttacccccgtttaacccccccgggttacccgttttaaccccgttaaaccccgggtttttttaccccgggggaaacccggggggttttaaaccgggggaaaccccggggttaaaacggggggttaacggggttaaaccgggtaaaacgtttaaccccgggtaaagggtaaaccccgggttaaaaccgggtttaccgggggtttaccgggtacccggttaccgggaccccttaaaacccccggg

SEQ ID NO: 11734 - DNA, 599 bp, Homo sapiens
  misc_feature: GYAE6OF01A5AHK.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagacagaaaccagggaaagacccctaaactcctgactcctagatgcatccaatttggaaacaggggtccatcgaagttcagtggaagtggactctgggactagtattttacgtttcacctagtcgaccctaggacttcggcagaccctagaagtatattgactaacattacttactgtacaaactagttaataggtaacttaacgttcttaccccgacgttaccgtacgttttaccggggaccgggtaaacggggtaaccccgtaaagggggttacggaacgggtacttacccgaaacgggtaaccggtaaaccggttggttaaccgggcgttacggcctaacccccgg

SEQ ID NO: 11735 - DNA, 500 bp, Homo sapiens
  misc_feature: GYAE6OF01DN7JP.52.2.A02.1.454.CMB.1.raw
  modified_base (310)..(310): a, c, t, g, unknown or other
  misc_feature (310)..(310): n is a, c, g, or t
  modified_base (342)..(342): a, c, t, g, unknown or other
  misc_feature (342)..(342): n is a, c, g, or t
  modified_base (474)..(474): a, c, t, g, unknown or other
  misc_feature (474)..(474): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggcattaacatgtatctgaattggtatcagcagaaaccagggaaagcccctaaaactcctagatcctcgatgcatccaatttggaaacngggtcccatcaaggttcagtggaagtggctcngggacagtattttactttcaccatcgccagactgcagcctagaacgatattgacaacattaattactgtacaaactagtatgattaaactctcccgtctctacgtttcggcggagggacctaagggtgagancgagacgtaactggtggctgctaacc

SEQ ID NO: 11736 - DNA, 519 bp, Homo sapiens
  misc_feature: GYAE6OF01CBFAB.52.2.A02.1.454.CMB.1.raw
  modified_base (449)..(449): a, c, t, g, unknown or other
  misc_feature (449)..(449): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggcagtcaggacattaacatgtatctgaattggtatcagcagaaaccagggaaacgacccctaaactcctagactcctcgatgcatccaatttggaaacagggtcccaagtcaaggttcaggtaggaagtggctcgtgggactagtacttttacttcacctatcgcagactgcagcctagaagatattgactaactattacttactagtacaaactagtatgtaattaactctcccnctcgtacgtttcggcggtacggaccgaagggtgagtactacgaagacgtaactggtagctggcctaaccg

SEQ ID NO: 11737 - DNA, 811 bp, Homo sapiens
  misc_feature: GYAE6OF01EC7BF.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccgggcagtcaggacattaacatgtatctgaattggtatcagacaagaaaaccgagggaaaacgacccccgtaaaacttcctcggaacttccctacggaactcgacctaattaccctaaagttttaacgggaaaaaccgtacggggggttaccccctaagttaccgtaaaaggggtttccgaaagggttaggggtaaacggttcggggtacccgtttaccggttaacgggggggtaaaccttaacggggttaaacttttttttttaaacccttttaacccgtaaaccccgttaacgtttccccgggtaacccctaacgggtaaccctttacggggtaccccaacgggtacccttaagggtaaaacggtaatttaacgtttacggacctaaaaccgtaactttaaacgtttttaacgtacggttaaccaaaaccgttaaggttaacttaggtaaactttaaaccttccccgttccccgtactttccgtaacccgttttccggggaccggggtaaacggggtacccgtaaaggggttagggacggtaacgttaccgaagggtaaaccgtaaacgttgggttacggtcttcgggaccctaacccg

SEQ ID NO: 11738 - DNA, 576 bp, Homo sapiens
  misc_feature: GYAE6OF01AWYCM.52.2.A02.1.454.CMB.1.raw
  modified_base (216)..(216): a, c, t, g, unknown or other
  misc_feature (216)..(216): n is a, c, g, or t
  modified_base (506)..(506): a, c, t, g, unknown or other
  misc_feature (506)..(506): n is a, c, g, or t
  modified_base (545)..(545): a, c, t, g, unknown or other
  misc_feature (545)..(545): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattaacatgtatctgaattggtatcagcagaaaccagggaaaacgcccctaaaactccctagactcctacggatcgactaactaccgtaagtttacgggaaacgtacggggtacccaagtacctaaagggttcaaggtaggaaggtcggtctcgtagggaactaggttattttacctttcaacctagtccgaccagtacgtgacacgtcctagaagtattagttgactaacgtattactttactagtacaaactagttactagtaattactccgtaccctntacctacgtttcggaccgggtaggaaccgaggtacgganactcgaagtacgtacgtggcgctggctaacg

SEQ ID NO: 11739 - DNA, 522 bp, Homo sapiens
  misc_feature: GYAE6OF01D7IM7.52.2.A02.1.454.CMB.1.raw
  modified_base (313)..(313): a, c, t, g, unknown or other
  misc_feature (313)..(313): n is a, c, g, or t
  modified_base (343)..(343): a, c, t, g, unknown or other
  misc_feature (343)..(343): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccgggcagtcaggacattaacatgtatctgaattggtatcagcagaaaccagggaaacgcccctaaactcctagactcctcgatgcataccaatttaggaaacngggtaccatcaaggttcagtgaagtgctcngggactagtattttacttcactatcgaccagtactgcagcctagaagtatagttgactaactattattactgtacaactagtatagtataacttcctacccgcttcgtacgtttcgggacgggtaacggaccgtaagggtacggagatacaaggacgtaacgtgtggactggcctaacg

SEQ ID NO: 11740 - DNA, 684 bp, Homo sapiens
  misc_feature: GYAE6OF01CQCH2.52.2.A02.1.454.CMB.1.raw
  modified_base (163)..(163): a, c, t, g, unknown or other
  misc_feature (163)..(163): n is a, c, g, or t
  modified_base (206)..(206): a, c, t, g, unknown or other
  misc_feature (206)..(206): n is a, c, g, or t
  modified_base (227)..(227): a, c, t, g, unknown or other
  misc_feature (227)..(227): n is a, c, g, or t
  modified_base (248)..(248): a, c, t, g, unknown or other
  misc_feature (248)..(248): n is a, c, g, or t
  modified_base (270)..(270): a, c, t, g, unknown or other
  misc_feature (270)..(270): n is a, c, g, or t
  modified_base (557)..(557): a, c, t, g, unknown or other
  misc_feature (557)..(557): n is a, c, g, or t
  modified_base (672)..(672): a, c, t, g, unknown or other
  misc_feature (672)..(672): n is a, c, g, or t
tcagcgcagtacgacacgaccggtgctcgatttagactcatctacaggggggagtcagtcccaaccaggacacagcatggacatgagggtccctgctcagctcctggggctcctgctgctctggcctctcgaggtcgccagatgtatcactccagatcgaccntcctccactccctccctgtctgctatctagaggagacaagacncacctatctacgtcggccggngtagacgaggactaattaacngtatatgtaagtaagtttgganacgagacgaaaacggaaaccggaacgggtaaaaccctaccccttaaactcccgtagtaaccttcccgtagtactcgaactacgttaaccgttaaggttaacgggaaaccgtccgggttaccaagttaacgtaagggttcaagggtacggaagtcggtactacggtagggaacttagtttacttttaccacaactcgtaccgacgtacgtactcgaccgtagtaccgtaaagtaattacttctacgaacctaaagttactttactagtaaccgaactaagtagtttanacgttaactaccttcccgtccgtaacttccgggttaccggtcggggaaaccgggtaacggaacggtagggtaggaactacgtaacggaaccggtaacgtacggtggacggtaccngttaccctaacg

SEQ ID NO: 11741 - DNA, 834 bp, Homo sapiens
  misc_feature: GYAE6OF01CA8AT.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcaggacattaacatgtatctgaattggtatcagcagaaaccgagggaaacgcccctaaactcctagactccctcgatcgctactacctaaagtttacgggaaaaccgtacggggtacccctaagttaccgtaaacgggtttaccgaaggttacggggtaaaggttcgggtaccgttccggtacgggggtaaaccgttaacggtttaactttttttaacccgtttttacccgtaaccccgtaacgtttccccggtacccccgtaacggtaacccgttacgggacccgtaaacgggtaccccgttaagggtaaaacggtaattttaaacgtttacggaaacccttaaaacgtaacttttaaacgttttaaccgttacggtttaaccctaaaacgttaagggtttaacttaacggttaaactttaaaccttaccccgttacccccggtaccgtttacccgttaacccggttttacccgggggtaacccggggtaaccgggggaaccccgtaaaggggggttacgggaacggttaacgttaacccgggaaacgggttaaacccggtaaaccggtttcgggttaaccgggtccgtttaccggaccccgttaaacccgg

SEQ ID NO: 11742 - DNA, 318 bp, Homo sapiens
  misc_feature: GYAE6OF01AQYB0.52.2.A02.1.454.CMB.1.raw
  modified_base (199)..(199): a, c, t, g, unknown or other
  misc_feature (199)..(199): n is a, c, g, or t
  modified_base (307)..(307): a, c, t, g, unknown or other
  misc_feature (307)..(307): n is a, c, g, or t
  modified_base (314)..(318): a, c, t, g, unknown or other
  misc_feature (314)..(318): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgntcactttcggcggagggaccaaggtggagatcagacgaactgtggctgcaccatctgtcttcatcttcccgcatctgatatacgatcgctgagcgggctggcaaggcncagtagnnnnn

SEQ ID NO: 11743 - DNA, 509 bp, Homo sapiens
  misc_feature: GYAE6OF01CS4V5.52.2.A02.1.454.CMB.1.raw
  modified_base (347)..(347): a, c, t, g, unknown or other
  misc_feature (347)..(347): n is a, c, g, or t
  modified_base (449)..(449): a, c, t, g, unknown or other
  misc_feature (449)..(449): n is a, c, g, or t
  modified_base (482)..(482): a, c, t, g, unknown or other
  misc_feature (482)..(482): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaacgacccctaaactcctagactcctcgatgcatcctaatttggaaacagggtccagtcaagttcgagtggaagtggctcgnggactagtattttacttcactactcgccagactgacagcctagaagtatattagactaacattacttactagtacaactagtatagattaactcctacccgntactacgttcggacggtaggaccagggtgaagntacgagacgtaacgtgaggctgctacg

SEQ ID NO: 11744 - DNA, 317 bp, Homo sapiens
  misc_feature: GYAE6OF01C2W47.52.2.A02.1.454.CMB.1.raw
  modified_base (313)..(317): a, c, t, g, unknown or other
  misc_feature (313)..(317): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctccgctcactttcggcggagggaccaaggtggagatcagacgaactgtggctgcaccatctgtcttcatcttcccgccatctgatatacgatcgctgagcgggctggcaaggcgcatagnnnnn

SEQ ID NO: 11745 - DNA, 763 bp, Homo sapiens
  misc_feature: GYAE6OF01ACTD3.52.2.A02.1.454.CMB.1.raw
  modified_base (215)..(215): a, c, t, g, unknown or other
  misc_feature (215)..(215): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcactggccggnagtcaggacattaacatgtatctagaattggtatcagcaagaaaccagggaacgcccctaaatcctagactcctacgatcgactacttaccgtaaagttttacgggaaaaccgtacggggttaccccaagttaccggtaaacgggtttacgaagggttaggggaaacggttcgggtaccttacgggttacggggtaacctttaacggttaactttttttaacccgtttaccaacccgtacgttacccggacccgtaaggtaacccgttcggacccgtaaccggtacccgttaaacggtaaacgttacgttttaacgtttaccggaaaccttaaaaccttaacgttttaacgttttaaccgttacggttaaacctaaaccgttaaggttaacgttaacggtaactttaaaccgtcccgttaccccggtacttacccggttaaccggtttccggggaccggggtaaccgggtaaccggtaaaggggtcgggtaaagtacgttaccgaaacgggttacgtaacgttgggtaccggcgttccgcctaacccg

SEQ ID NO: 11746 - DNA, 794 bp, Homo sapiens
  misc_feature: GYAE6OF01BPYAW.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccactccctccctgtctgctatctaagtaggaagacaagtaactccacctataccgtacgttcggccgggacgtacgtacgaaggaactaacttaaacagttacggtaattcgtaggtaaacgtttgggtaacttcgaagaccgaaacggaaaacccggaacgggggtaaaacccgtacccccttaaaaaccgttcccgtaacgtaccttaccccgtacggtaagttccgacctaacgttaaccgttaaaggtttaacgggaaaaccggtacggggtaccctaagtaaccggtaaaggttcgaaggttagggacgtcggtcgtacggtaggggactaaggtttactttttaccgttaccgaaccttacgtaccgacccgtaagtacttacggaccgtaacgtacgtaaggaaacgttaagttactttaacggaaccctaaagttaactttaacgtttaaccgacggttaaacccaaagttaacggttaatacgtaactttaaccgttcccgtaccccgtattacccggtaccgggtttaccggggaccgggaacggggtaaccgtaaggggtccggtaagtaccgtacgaaccgggtaacgtacggttcggtacgcgtacgacccgtaacg

SEQ ID NO: 11747 - DNA, 559 bp, Homo sapiens
  misc_feature: GYAE6OF01A6LR8.52.2.A02.1.454.CMB.1.raw
  modified_base (216)..(216): a, c, t, g, unknown or other
  misc_feature (216)..(216): n is a, c, g, or t
  modified_base (265)..(265): a, c, t, g, unknown or other
  misc_feature (265)..(265): n is a, c, g, or t
  modified_base (431)..(431): a, c, t, g, unknown or other
  misc_feature (431)..(431): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggnagtcgagacattagcatgtatctgtaattggtatacagacaaaaaccgngggacacgacccctaaactcctgactcctacgatgctactcctaactttaggaaacgtacggggtacccataccgaaggttcaggtggaagtggctgtaggactagtatttacttcactatacgagcagctgacagctagaagtacattcgacaactataattacngtacaacgtagtatgtattacgtcctccgcttacgtacccggtttaggggaccgggggtacccaagggttacggaacggtaactaccggaaacggtacgaacggttggtacggtcgtcggtaaccccg

SEQ ID NO: 11748 - DNA, 498 bp, Homo sapiens
  misc_feature: GYAE6OF01BSC63.52.2.A02.1.454.CMB.1.raw
  modified_base (211)..(211): a, c, t, g, unknown or other
  misc_feature (211)..(211): n is a, c, g, or t
  modified_base (309)..(309): a, c, t, g, unknown or other
  misc_feature (309)..(309): n is a, c, g, or t
  modified_base (339)..(339): a, c, t, g, unknown or other
  misc_feature (339)..(339): n is a, c, g, or t
  modified_base (485)..(485): a, c, t, g, unknown or other
  misc_feature (485)..(485): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcacatcactgccggnagtcaggacattaacatgtatctgaattggtatcagcaagaaaccagggaaacgccctaaaactcctagatcctcgatgcatcctaatttcggaaacngggtcccaatcaaaggttcagtggaagtgntcgtggacagtatttacttcaccatcgcagactgcagctgaagatatgactaacatagttactgtacaactagtatagtataactctaccgctacacgtttcggcggtaaggaccgaagggtcggagatccaaggacgtaacctgnggctggctaaccg

SEQ ID NO: 11749 - DNA, 681 bp, Homo sapiens
  misc_feature: GYAE6OF01AUFA4.52.2.A02.1.454.CMB.1.raw
  modified_base (191)..(191): a, c, t, g, unknown or other
  misc_feature (191)..(191): n is a, c, g, or t
  modified_base (278)..(278): a, c, t, g, unknown or other
  misc_feature (278)..(278): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctatagganacagaactcaccatcacgttcggccgggcgagtcaggacattaacatgtatctagaattggtatcagacaagaaaccgagggaaacncccctaaactcctagactcctacgactcgacaacttacctaagtttacgggaaacgtacggggtacccaagttacgtaaaggtttcgaaggttagggaacggtcggtacgttacggtacggggaacttaacggtttactttttaccttaccgaacctacgttcccggacctaacggtaaccttcggaccgtaacggtccgtaaggtaaagtacttacgttacgaacctaaactatttaacgtttactacgtaactaacgtaagttatagtaacttaacgtcccttacccgtacttaccgtacggtttaccgggaccggggtaacgggtaacccggtaagggtaggacgtaacgtaccggaacggtaaccgtaacggttcggtaggtccttggaccctaacccg

SEQ ID NO: 11750 - DNA, 320 bp, Homo sapiens
  misc_feature: GYAE6OF01BXFOA.52.2.A02.1.454.CMB.1.raw
  modified_base (313)..(320): a, c, t, g, unknown or other
  misc_feature (313)..(320): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtgagatcagacgaactgtggctgcaccatctgtcttcatcttcccgccatctgatatacgatcgctgagcgggctggcaaggcgcatagnnnnnnnn

SEQ ID NO: 11751 - DNA, 509 bp, Homo sapiens
  misc_feature: GYAE6OF01BRD9Q.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaactcctgactcctcgatgcatcctaatttaggaacagggtccatcaaggttcagtggaagtggctcgtgggactagtattttacttcacctatcgcagtactgcagcctagaagtatagttgactaactattacttactgtacaatagtatagtattaactcctcccgctccgtacgttcggacggacggaccgtaggtgagatcgaagacgtaacgtgacggctgctaccg

SEQ ID NO: 11752 - DNA, 729 bp, Homo sapiens
  misc_feature: GYAE6OF01DQBL5.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcgaggtgccagatgtatcatccagatcgacccagtctccactccctcctgtctgcatctagtaggagacagaactcacatcacgttcggccgggcgagtacgacggactaattaacatagtatctagtaattggtatcagacaaacgaaaccgaagggaaaccgtacccctaaactccgtagtactaccgtcgtagtcgactacttactaagttacggaaacgtacgggtacccagtacgtaacggttacgaaggtagggtaacgtcggtaccgttacggtaggggtaaccttaaggttttaacttttttaacccgtttaacctaacccgtacgttacccggacccgtaagtaccgttacgaccgtacggtaccgttaagtaacggttaattacgtttacgaaacctaaactaattttaacgttaacttacggttaacctaaacgtaagttaagttaagtaacctttaaacttccccgttaccccgtaccgttacccgttaaccggttttaccgggacgggggtaacggaacccggtaaggggtacggtaggtaactacgaaacggacgtaacgtagggttcggacttcggacctaacccg

SEQ ID NO: 11753 - DNA, 496 bp, Homo sapiens
  misc_feature: GYAE6OF01AKVKF.52.2.A02.1.454.CMB.1.raw
  modified_base (430)..(430): a, c, t, g, unknown or other
  misc_feature (430)..(430): n is a, c, g, or t
  modified_base (467)..(467): a, c, t, g, unknown or other
  misc_feature (467)..(467): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacagggtcccatcaaggttcagtggaagtggctctggactagtatttactttcaccatcgcagactgcagcctgaagatattgacaacatattactgtacaacagtatagtataatctacccgntacacgtttcggacggtagggaccgtaaggtggagtntacgagacgtaactggtagctgctaaccg

SEQ ID NO: 11754 - DNA, 586 bp, Homo sapiens
  misc_feature: GYAE6OF01BV2Z0.52.2.A02.1.454.CMB.1.raw
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtcctccatccctccctgtctgcatctataggagacagaatcaccatcacttggccgggngagtcaggacattaacatgtatctagaattggtatcagcaagaaaccgagggaaacncccctaaactcctacgactcctcgatgcatacctaagttacggaaacgcgggtaccatacaaggttcaggtggagtgctgtagggactagttactttacttcacgtatccgacagtctgcagtcctagtaagtatattgactaactattaacgttactagtaacaactaggttaatacgtaattaacgtcccttacccgcttacctaccggtttacgggacgggtaacggggtaaccgtaagggttggaaacgacgttaccggaaacgtaaccggtaacggtcggttaggccgtaacgtacccgtaaccg

SEQ ID NO: 11755 - DNA, 725 bp, Homo sapiens
  misc_feature: GYAE6OF01DSNXT.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcacatcacttgccggcgagtcaggacattaacatgtatctgaattggtatcagacaagaaaccagggaaacgacccctaaactcctagactcctcgatcgacatacctaaagtttacgggaaaacgtacggggtacccaagtaccgtaaagggttcgaggttagggaaacgttgggcttcgtaggggaacctaaggttactttttaaccgtttacctaacctacgttcccgacctaacggtacttacggcctaggtacccgttagaaacggtattaatttacggacctaaactaatttaacgtttacttaacggttaacctaaaaccgtaaggttaaacgttaggtaaactttaaactttccccgttaccccgtcctttaccgtaacccggtttttcccggggacccgggggtaaacggggtaaccccggtaaaagggggttagggtaacggtaaagttacccggaaagggaaaccccggtaaacgttacggggttacgggtaccttacgggacccttaaaccccg

SEQ ID NO: 11756 - DNA, 532 bp, Homo sapiens
  misc_feature: GYAE6OF01C9F6C.52.2.A02.1.454.CMB.1.raw
  modified_base (280)..(280): a, c, t, g, unknown or other
  misc_feature (280)..(280): n is a, c, g, or t
  modified_base (311)..(311): a, c, t, g, unknown or other
  misc_feature (311)..(311): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagacaaaaaccagggacagcccctaaaacncctgatcctcgatgcatccacttaggaaacngggtcccatcaaggttcagtggaagtggctctgggactagatttttacgttcaccatcagtcaggctgcagcctgaagatagttgacaactatattactgtacaactagtaatgatacgttacctcccgtctcctacgtttccgggacggggggaccctaaaggggtaggaagacgttaccgaaaggtaccgtaaacgttggtagggcttggcctaacccg

SEQ ID NO: 11757 - DNA, 555 bp, Homo sapiens
  misc_feature: GYAE6OF01CFIKT.52.2.A02.1.454.CMB.1.raw
  modified_base (401)..(401): a, c, t, g, unknown or other
  misc_feature (401)..(401): n is a, c, g, or t
  modified_base (427)..(427): a, c, t, g, unknown or other
  misc_feature (427)..(427): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaactcctagactcctcgatgcatccaatttaggaaacgcggggtacccatacgaaggttcaggtggaagtggctcgtgggactagtacttttacttcacctatcgaccagactgcagcctagaanatatgactaatatattactgtacaanagtatagtaattaactcctaccgtcttactaccgtttcgggaccgggtacggggaaccgtaagggtaggaacggacttacgaaggtaaccggtaacgttagggtcgggtaccttaggccctaaacccg

SEQ ID NO: 11758 - DNA, 594 bp, Homo sapiens
  misc_feature: GYAE6OF01BWU5A.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcacatcacttgccgggcagtcaggacattaacatgtatctgaattgtatcagcagaacaggaacgaccctaaactcctgatcctacgatcgcatccaatttaggaaacctggggtacccatacgaaggttcagtacggaagtggctacgtgggactaggttacttttacttacaccgtatccgctagactgacagacctagaacgatacttgactaactatattactagttaacaacgtagttactagtaattaaacttcctaccccgtacttacccgttacgtttaccgggaccggggtaaacggggtaaccgaaacggggttaggaaacgtcggtaacgtaaccgggtaacgttaaacgggtcggttacgggtccgttacggaccgttaaacccg

SEQ ID NO: 11759 - DNA, 686 bp, Homo sapiens
  misc_feature: GYAE6OF01CGFCG.52.2.A02.1.454.CMB.1.raw
  modified_base (193)..(193): a, c, t, g, unknown or other
  misc_feature (193)..(193): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccactcctccctgtctgcatctagagganacagaatcaccatcacttcggccgggacagtcaggactattaacatgtatctagtaattggtatcagacaacggaaaaccgaaggggtaaaaccaccccttaaaacgtcctacgtacttacccgtcgaatcgactaactaccgtaaagtttacggaaaccgacggggtacccaagttacgaacggttacgaaggtaggtaaggtcggcgttacgtaggggaaccttaggtttaacttttaccttacacctacgtcccggaccagtacgtcgaccgagtccgtaagtaaagtattactacgaactaaacttagttaactttagtacgtaacctaagtaagttataacgtaactaacgttccccgtacccgtacttaccgtaccggtttacggggaccggtaacggggaacccgaacggggttgggaactaccggttacgaaccgggtaacgttaaaccggttgggaccggtaccttacgggacccttaacccgg

SEQ ID NO: 11760 - DNA, 523 bp, Homo sapiens
  misc_feature: GYAE6OF01DE0E2.52.2.A02.1.454.CMB.1.raw
  modified_base (265)..(265): a, c, t, g, unknown or other
  misc_feature (265)..(265): n is a, c, g, or t
  modified_base (406)..(406): a, c, t, g, unknown or other
  misc_feature (406)..(406): n is a, c, g, or t
  modified_base (437)..(437): a, c, t, g, unknown or other
  misc_feature (437)..(437): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgcggcagtcaggacattaacatgtatctgaattggtatcagcagaaacagggaaanccctaaactcctgatcctcgatgacatccaaatttggaaacaggggtcccatcaaaggttcagtggaagtggctcgtgggacagtattttacttcacatcgcagactgcagcctagaagatattgacaaacatattaagtnactaacagtatagtaataaacttctacccgnttctacgtttcgggaccggtaggggaacccgaaagggttggaacgtaatccgaagaacgaaaccgttggtaggcttggacctaacc

SEQ ID NO: 11761 - DNA, 582 bp, Homo sapiens
  misc_feature: GYAE6OF01A67ZJ.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtaatcagcaagaaaccagggaaacgcccctaaaactcctagactcctcgatgactatacctaagtttacggaaaccgacgggtacccatccgaaaggttcaaggttaggaagtggtctacgtagggactagtattttactttcacatcgacagactcgacagcctagaagtatagttagctaaacattatttaactcgtaactaactaattactagtaataacgttccttacccgactacctacggtttaccggacggtaacggggtaaccgtaagggttacggaacggtacgtaccgaaggaacgtaacgtaggtaggtccgttgacccgtaccg

SEQ ID NO: 11762 - DNA, 477 bp, Homo sapiens
  misc_feature: GYAE6OF01ECFSS.52.2.A02.1.454.CMB.1.raw
  modified_base (399)..(399): a, c, t, g, unknown or other
  misc_feature (399)..(399): n is a, c, g, or t
  modified_base (426)..(426): a, c, t, g, unknown or other
  misc_feature (426)..(426): n is a, c, g, or t
  modified_base (467)..(467): a, c, t, g, unknown or other
  misc_feature (467)..(467): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccgggcagtcaggacattaacatgtatctgaattggtatcagcagaaaccaggaagcccctaaatcctgatcctcgatgcatccaatttggaacacgggtccatcaaggttcagtggaagtggctctgggacagtatttacttcaccatcgcagactgcagcctagaagtatattgactaactatattacngtacaactagtatagataactctccgntacacgtttcggcggaggccaaggtgagatcagacgactgngctgctaacg

SEQ ID NO: 11763 - DNA, 561 bp, Homo sapiens
  misc_feature: GYAE6OF01EGKN0.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaactcctgactccctcgatgcataccaatttggaaacacgggtcccatcgaaggttcagtggaagtggctcgtgggactagtattttacttcacctactcgaccagactgctagcctagaagtatagttgacaactaatatttactagtacaactagtatgtaattaacgtctacccgtcttacgtaccgttttcgggaccgggtagggtacccgtaaagggttgggaagtagttaccgaaacggtaaccggtaaccgtgggttacgggtctcgccgtaaacccg

SEQ ID NO: 11764 - DNA, 645 bp, Homo sapiens
  misc_feature: GYAE6OF01A8YUH.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgccgggcagtcaggacattaacatgtatctgaattggtatcagcaagaaaccaggggaaactccccctaaactcctagtaactcctacgactgcctaatacccgtaaagtttacgggaaaacgtacggggttaccccaagtacgtaaacggtttcgaacggttagggtaaacgtcgggactacggttacgggggaacctaggtttaactttttacctttaccgaacccgtaacgttccgacccgtaaggtaaccttcggacacggtaccgttagaaacggttacttaattcggaacctaaactagttaactttaacgtcgtaacaacgtagttaatgtaacttaactctacccgctactcgtttcgggaccggacggaccgtaaggtgggaactaacgccgtaaggaccgttaacgtgtacggcaccgtccgaacg

SEQ ID NO: 11765 - DNA, 641 bp, Homo sapiens
  misc_feature: GYAE6OF01DQXO2.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaatttggtatcagacaagaaacccgagggaaacgcccctaaaactccctagactcctcgattcgacactacctaagtttagggaaactacggggtcccaagttaccgaagggttccaggttaggaaggtggcttcgtaggggactaggttacttttttacttaccgacctactaccgaccgaagtaccttgaccgacgacccttagaacgtattagtttacgactaaactatttaattacttagtacaaacgtagtaactagtaacttaacgttcccgtacccgtacgttaccgttaccggttttaccgggaccggggttaacgggaacccggtaaaggggttaggggacgtaacgaacggtacgaaacggttcgtagggtaccgtcggtcgacctaacgg

SEQ ID NO: 11766 - DNA, 330 bp, Homo sapiens
  misc_feature: GYAE6OF01EMQGJ.52.2.A02.1.454.CMB.1.raw
  modified_base (301)..(301): a, c, t, g, unknown or other
  misc_feature (301)..(301): n is a, c, g, or t
  modified_base (318)..(330): a, c, t, g, unknown or other
  misc_feature (318)..(330): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaaggtggagatcagacgaactgtggctgcaccatctgtcttcatcttcccgccatctgatatacgatcgctgacgcgggcngggcaaaggcgcatagnnnnnnnnnnnnn

SEQ ID NO: 11767 - DNA, 556 bp, Homo sapiens
  misc_feature: GYAE6OF01B03YR.52.2.A02.1.454.CMB.1.raw
  modified_base (271)..(271): a, c, t, g, unknown or other
  misc_feature (271)..(271): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcaggacattaacatgtatctgaattggtatcagcagaaaccagggaaacncccctaaactcctgactcctgatgcatcctaatttacggaaaacctggggtacccagtactaaaggttcaggtggaagtggctgtgggacagtattttacttcacctatcgccagactgcagcctagaagtattattagactaaactattaacttactcgtacaactagtatagaattactcctcccgcttaccgtacgtttccgggacgggtaacgggtaccgtaagggtggaagtctaccgtaagaaccggttaacgttgggtacggcttcggaccctaaccg

SEQ ID NO: 11768 - DNA, 318 bp, Homo sapiens
  misc_feature: GYAE6OF01BP2SO.52.2.A02.1.454.CMB.1.raw
  modified_base (315)..(318): a, c, t, g, unknown or other
  misc_feature (315)..(318): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatccttcccgccatctgatatacgatcgctgagcgggctggcaaggcgcatagnnnn

SEQ ID NO: 11769 - DNA, 604 bp, Homo sapiens
  misc_feature: GYAE6OF01B1FRX.52.2.A02.1.454.CMB.1.raw
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggngagtcaggacattaacatgtatctagaattggatcagacaagaaaccgagggaaacgcccctaaactcctagactcctacgatcgactactacctaaagtttacggaaaacgtcggggtacccagtacgtaaaggttcaaggtgggaagtggctcgtaggggactaggttaactttttaccgttctaacctacgttcccgacctaagtccgtacgaccgagtcccgtaggaagtattatacgactaaactatttactaactgtaacaactaagtactagtaacttaactcctacccgcttacgtaccggtttcgggaccggtaacgggaccgtaagggtggaaggacgttacgaaggtaaccgtaacgtgtacggctaggcctaaccg

SEQ ID NO: 11770 - DNA, 571 bp, Homo sapiens
  misc_feature: GYAE6OF01A3NG6.52.2.A02.1.454.CMB.1.raw
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattaacatgtatctgaattggtatcagcagaaaccagggaaacgcccctaaactcctgactcctacgatgcatcctaatttaggaacgagggtccatcgaagttcagtggaagtggctcgtggactagtatttacttacacctatcgacagactgacagtccgtagaagtatagttcgacaactattacttactacgtacaaacgtagtactagtaattaactccgttacccgtacctaccgtaccgttttacgggaccgggtaacgggaaccggtaaagggttgggaacggtacgttacgaacggaacggtaaaccgttgggtaccggcgtcggaccctaacccg

SEQ ID NO: 11771 - DNA, 585 bp, Homo sapiens
  misc_feature: GYAE6OF01EM4XL.52.2.A02.1.454.CMB.1.raw
  modified_base (436)..(436): a, c, t, g, unknown or other
  misc_feature (436)..(436): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcaagaaaccagggaaacgacccctaaactcctgactcctcgatcgcactcctaatttacggaaacgtacggggtaccaataccgtaagggttcaggtggtaaggtcggctcgtgggactaggtactttttacttccacctatccgccacgactcgacacgcctagaaatatattgactaactnttaacttactgttacaactagttatagtaattaacttccctaccgaccttacctaccgtttaccgggacggggtaacgggaaccgtaagggttaggaaggtactccgaaaggaccgtaaacggttcgggtaggccgtaggccctaaccg

SEQ ID NO: 11772 - DNA, 695 bp, Homo sapiens
  misc_feature: GYAE6OF01CH13N.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctagaatttggtatcagacaagaaaccgagggaaacgccccttaaaactcctagactccctagatcgactactaccgtaaagttttacgggaaaacgtacggggttaccccaagttaccgtaaagggtttcaaagggttgggaaagttcgggctcggtgggaactaggttactttttaccttacaccgtactccgacctaacgtacgttcggacgtaacgtcccgtaagtaaaggtacttaacgtttaggaacctaaacgtaattttaacttaacgttacgttaaccaaaccgttaaggttaacttaacggtaactttaaacgttccccgtacccgtaccgttaccgttaccggttttaccggggaccgggtaaacgggtaacccggtaaggggttacggaacggtacgtacgaaacggtaacggtaacgttgggacggtccgtaggccctaacccg

SEQ ID NO: 11773 - DNA, 798 bp, Homo sapiens
  misc_feature: GYAE6OF01BOSPC.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgccgggcgagtcaggacattaacatgtatctgaattggtatcagcaagaaaccagggaaacgcccctaaactcctagacttcctcgatcgactataccctaaattttacgggaaaacgtacggggtaccccaagttaccgaaagggtttccgaaggttaggggaaaggttcggggtaccgttacgttacgggggaacctaacgggtttaactttttttaaccgttttaccaacccgtaacgtttcccgggtacccctaagggtaaccctttacgggacccgtaacggtaccccgttaagggtaaaacggtaacgtttaacgtttacgggaaccctaaaaaccgtaacttttaaacgttttaacccttacgggttaacctaaaaaccgtagggtttaaactaggttaaaccttaaactttcccgttaccccccggtactttacccgttaaccggttttccggggaaccggggtaaacgggggtaaaccccgtaaagggggttacgggaaacggtaaacgtccggtaaaacggaaccgggttaaaccggtttacgggtaccggggtccgtaaccgggtcctaaaccccgg

SEQ ID NO: 11774 - DNA, 536 bp, Homo sapiens
  misc_feature: GYAE6OF01A1NGM.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaagcccctaaactcctagactcctcgatgcatccaatttaggaaacaggggtccatcaaggttcagtggaagtggctcgtgggactaggtattttacttcacctatcgccagactgcagcctagaagtatattgactaacattacttactgtacaacgtagtatagtaattaactcctacccgacttccgtaccgtttcgggaccgggtacgggtaaccgaagggtggaggtacgtacgaaggacgtaacgtcggtaggctgccgtaaccg

SEQ ID NO: 11775 - DNA, 728 bp, Homo sapiens
  misc_feature: GYAE6OF01AEWDQ.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcaggacattaacatgtatctagtaattggtatcagacaagaaaccgagggaaacgtacccctaaactcctagactcctacgactcgacacttaccgtaaagtttacgggaaaccgtacggggtacccaacgttaccgtaaacgggtttacgaaggttaggggtaaacggtcgggtccgttacggtacggggtaaacgttaacggtttaacttttttaaccgtttaccgtacccgtaacgttacccggtacccgtaacgtaccgttcggaccgtaccggtaccgttaggtaaacgtatttaacgttacgaacctaaacttaacgtttaactttacgttacgtaacctaaacgtaggttaacgttaacgtaacttaaccgttcccttaccccggtaccttaccgttaccggtttccgggaacggggtaccggtaaccggtagggtagggacgtacgtaccggaaacggtaccgtaacggttcgggtacggccgttacggcgtaacccg

SEQ ID NO: 11776 - DNA, 790 bp, Homo sapiens
  misc_feature: GYAE6OF01B0LGG.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcaagaaaccgagggaaacgcccctaaactcctagaactcctacgatcgctacttaccgtaaagttttacgggaaaaccgtacgggggtacccctaagttaccggtaaaacgggttttaccgaagggttaggggtaaaacgggtttcggggtacccgtttacgggttacggggggtaaaccttaaacgggttttaactttttttttaaacccgttttaccctaaaccccgttaacgtttaccccggtaaccccgtaagggtaaccccgtttacgggacccgtaacggtaccccggttaaggtaaaacggttactttaaacgtttcggaaacctaaaccgttaatttaacgttttaaccgttacggttaactaaaccgtaagttaactacgtaactttaaacttcccgtaccccgtacttacccgttaaccggttttaccgggaccggggtaacgggtaacccgtaacggggttagggaacggtacgtaccgaaaggtaaccggtaacgttggttacgggcttacggcccttaacccgg

SEQ ID NO: 11777 - DNA, 791 bp, Homo sapiens
  misc_feature: GYAE6OF01AXOHU.52.2.A02.1.454.CMB.1.raw
  modified_base (246)..(246): a, c, t, g, unknown or other
  misc_feature (246)..(246): n is a, c, g, or t
tcagcgcagtacgacacgaccggtgctcgatttagactcatctacgagggggggagtcagtcccaaccaggacacagcatggacatgagggtccctgctcagctccgtggggctcctgctgctctggctctcaggtgccagatgtatcatccagatcgacccagtcctccactccctccctgtctgcatctagtaggagacagaactcaccatcacgttcggccgggcgagtcgaggactataacntgtatctagtaagttggtatcgagacgaaaggaaacccgaaggggaaacctaccccctaaacgtccgtagtacctcccgtagatcgacctacttaacctaaggtttaacgggaaaccgtaccggggtaccctaagtaacggtaacggtttcgaagggttagggaacggttcggaccgttacggtacggggtaaccttaaggttttaacctttttaccgttacccaacccgttacggtacccgtaacccgtaacgggtcccttacggacccgtaccggtacccgttaagggtaaacgttagttacgtttaaccgaaccctttaaaacgttaatttaacccgttttaacgtaacgttaaaccgtaaaccgttaaggtttaacgtaacgtaaacctttaaccgttccccctaccggttaccttacccgggttaacgggttacccggggaacggggtaaccgggtaaccgggtaagggtacggtaaacgtcgtaaccgggaacggtaccggttaaacggtcgggttacggcctaaccggccttaaaccg

SEQ ID NO: 11778 - DNA, 757 bp, Homo sapiens
  misc_feature: GYAE6OF01CA0BV.52.2.A02.1.454.CMB.1.raw
  modified_base (218)..(218): a, c, t, g, unknown or other
  misc_feature (218)..(218): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccactcctccctgtctgcatctagtaggagacagaatcaccatcactggccgggngacgtcaggacaattaacatgtatctagtaattggatcagacaagaaaccgaagggaaaccgacccctaaactcctagactccgagtatcgactactactaagttacgggaaaacgtcgggaccctagttaccgtaaggttcgaaggttagggtaagtcggtacgtacggtacgggtaaaccttaagttttaacgtttttaccttaacccgtaaccgttaaccgtacccggtaacccgtaaggtaaccgtacggtaccgtaaccgtacccgtaaggtaaaacgttacgtttaagttaccgtaaactaaacttaacgttttaacgttaacgttaacgtaacctaaaacgttagttaaacgtaattaacttaaaccttccccgttaccccgttacttaacccgttaaaccgggtttccgggggaaaaccggggtaacggtaaaccccgggtaaagggttacgggaaacgttaaacgtacccgtaaaaggaacccgggttaaacttcggggtaccggtaccttaaccggcccttaaacccgg

SEQ ID NO: 11779 - DNA, 695 bp, Homo sapiens
  misc_feature: GYAE6OF01DSZHE.52.2.A02.1.454.CMB.1.raw
  modified_base (191)..(191): a, c, t, g, unknown or other
  misc_feature (191)..(191): n is a, c, g, or t
  modified_base (215)..(215): a, c, t, g, unknown or other
  misc_feature (215)..(215): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacttgccggnagtcaggacattaacatgtatctagaatttggtatcagacgaagaaaccgagggaaaacgtcccctaaaactcctacgactcccgtacgatcgacctataccttaaagtttacggaaacgtagggtacccaagtacgaaagggtttcaaggttaggaaggtcggtactacgtagggacttaaggtttactttttaaccgttacgacctacgttcccgaccgtaacggtaccttcgggaccctagtacccgttaggaaacgtacgtttaagttacggaacctaaacgttaacgttttaactttaacccgtacggttaacctaaacgttaacggtttaatacggttaaacttaaacctttcccgttaccccgtacttaccgtaaccggttttcccggggaaccgggaacggggtaacccgttaaggggtacggtaagtaccgtacgaaacgtacgtaaacgttggacggtacctgacctacg

SEQ ID NO: 11780 - DNA, 539 bp, Homo sapiens
  misc_feature: GYAE6OF01DXEVG.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaaggacattaacatgtatctagtaattggtatcagcaagaaaccgagggaaacgcccctagaactctgatctagtgttcatcctatttgctgacggtgggtcccaagtcgaaggttcaggtgcgagtggatcggtaggacagtattcactctacacatacactagtctgcgaggctagtaggttatttcgacttaactttacttctagtacaacgtagtacgttactacgttccctcgtaccgtttcggcccgtagggacctagttagtacggacttaacgtacgtaaaaccggtacttaggtacggctgcctaaccg

SEQ ID NO: 11781 - DNA, 548 bp, Homo sapiens
  misc_feature: GYAE6OF01BAXRZ.52.2.A02.1.454.CMB.1.raw
  modified_base (269)..(269): a, c, t, g, unknown or other
  misc_feature (269)..(269): n is a, c, g, or t
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagcgcagtacgacacgaccggtgctcgatttagactcatctacaggggggagtcagtcccaaccaggacacagcatggacatgagggtccccgctcagctcctggggctcctgctactctggctccgaggtgccagatgtgtcatccagatgacccagtctccatcctccctgtccgcatctgtaggagacagagtcatcatcacttgccggcaagtcagagcattagaacgttatttaaattggtatcaacagaaaccagggaaancccctgaactcctgatctatggttcatccactttgctgagtcgggtccagtcaaggttcagtggcagtggntcgtggganagattcactctcaccatcacagtctgcaggctagaggtattttcgactaacgtttacttcgtacgtacaacgagtacgttaactaccgttccctacttaccgtttccggacccgtagggtacctacgttacgtaggtactaagtacgaaacgtacttggtcggcttagccgtactacgttccttcgttccttctacccg

SEQ ID NO: 11782 - DNA, 857 bp, Homo sapiens
  misc_feature: GYAE6OF01AGULL.52.2.A02.1.454.CMB.1.raw
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattaacatgtatctgaattggtatcagcaagaaaccgagggaaacgcccctaaacgtcctagactcctcgatgctactacctaagtttacgggaaaacgtacgggggttacccaagttaccgtaaaacggggttttccgaaagggttaggggtaaaacgggttcggggtccgtttaccgggttacgggggtaaaccgttaaagggtttaacttttttttaacccgttttaccctaaaccccgtaaccgtttcccggaaccccgtaaggtaacccgtttacggaccccgtaaacgggtaccccgttaagggaaaacggttaactttaacgttttaacggaaccctaaaactaacttttaaacgttttaaccgttagggtttaaaccctaaaaccgttaagggttaaagttaggttaaacctttaaacccttcccgtttaccccccggtacctttaaccccgggtttaacccgggtttttcccgggggaaacccgggggttaaacccgggggtaacccggttaaaacggggggttacggggtaaacggttaaccgttaacccgggtaaagggtaaacccgggtaaaaccggtttggggtaaccgggtaccgttacggaccccggttaaacccgg

SEQ ID NO: 11783 - DNA, 555 bp, Homo sapiens
  misc_feature: GYAE6OF01EZLG9.52.2.A02.1.454.CMB.1.raw
  modified_base (217)..(217): a, c, t, g, unknown or other
  misc_feature (217)..(217): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttggccggngagtcaggacattaacatgtatctgaattggtatcagcagaaaccagggaaacacccctaaactcctagactcctcgatgcatacctaagtttagggaaaacgggtcccagtacgaaggttcagtaggaagtggctcgtaggactagtacttttacttcacctatcgaccagctgcagcctagaagatatagacaactatacttactatacaagtgtaatagtaacttaactccttaccccgtcttaccgtaccgttcgggaccgggacgggtaaccgtaggggtaggaagtacgtacggaacgaacgtacgtggtacgtaccgttcgaccgtctacg

SEQ ID NO: 11784 - DNA, 632 bp, Homo sapiens
  misc_feature: GYAE6OF01CI5XC.52.2.A02.1.454.CMB.1.raw
  modified_base (217)..(217): a, c, t, g, unknown or other
  misc_feature (217)..(217): n is a, c, g, or t
  modified_base (369)..(369): a, c, t, g, unknown or other
  misc_feature (369)..(369): n is a, c, g, or t
  modified_base (390)..(390): a, c, t, g, unknown or other
  misc_feature (390)..(390): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggnagtcaggacaattaacatgtatctagaattggtatcagacaagaaaccgaagggaaacgacccctaaaactcctagaactcctacgatcgacactacctaagtttacggaaacgtcgggtacctagtctaaaggttcaggtggaagtgctgnggatagttattttactcacgntcgcagctgcagctagaagtactattcgactaactattattactacgtactaaacgtagttaagtacgtaaattaccttacccgttacccctacgtttacccgtacggttttacccgggaccggggttaaacggggaaaccccgttaaaggggggtacgtaacggtaaaccgttacggtaaacccgggtaaacggttaacccggttacgggttaccgggtacctagggaccccttaaacccg

SEQ ID NO: 11785 - DNA, 563 bp, Homo sapiens
  misc_feature: GYAE6OF01CFFSH.52.2.A02.1.454.CMB.1.raw
  modified_base (215)..(215): a, c, t, g, unknown or other
  misc_feature (215)..(215): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggnagtcaggacattaacatgtatctagaattggtatcagctaagaaaccagggaaacgacccctaaactcctagactcctacgatgacatcctaaagtttaggaaacgtaggggtcccagtaccgaaggttcgaagtggaagtcggctacgtagggactagttattttaccttacacctatcgacctagtactgcagcctagaagtatattgaactaactattaacttactagtacaactagtactagtaattaagtcctaccgtctaccgtacgttcggggacgggggtaccaagggtcgaagtacgtacgaacgtacggtaacgtcggtacggctacgctaccgtacg

SEQ ID NO: 11786 - DNA, 736 bp, Homo sapiens
  misc_feature: GYAE6OF01AN04J.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcaagaaaccagggaaacgcccctaaactcctagactcctcgatgactataccctaaagtttacgggaaaacgacggggttcccaatacgtaaagggttcaaggttaggtaaaggtcggcttcggtaggggaaccttaggttaacttttttacctttaccgaaccctacgttacccggaccctaacggtaccgtttcgacccgtaacggtcccgttaaggtaaaacggttactttaagtttaccgaaccttaaaacctaagttttaacgtttaaccttacgggttaaccaaaacgttaagttacgtaagtaaactttaacccgttcccgttacccccgtacttacccggttaaccggttttacccgggggaccggggtaaacggggtaacccggtaaaggggttccggggaacgtaaccggttaccgaaaccgggtaaccggttaaaccggttgggtaccgggtaccttcggaccccttaaccgg

SEQ ID NO: 11787 - DNA, 644 bp, Homo sapiens
  misc_feature: GYAE6OF01BGZ6M.52.2.A02.1.454.CMB.1.raw
  modified_base (216)..(216): a, c, t, g, unknown or other
  misc_feature (216)..(216): n is a, c, g, or t
  modified_base (485)..(485): a, c, t, g, unknown or other
  misc_feature (485)..(485): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcacatcacgttcggccgggnagtcaggactattaacatgtatctagtattggtatcgagcaacggaaaccgagggaaacgtacccctaaactcctagactccgtagatcgactaactaccgtaaagtttacggaaaaccgtcgggtacccaagttaccgtaaacgggttacgaggttagggtaaacggttcgggtacctacggtaggggtaacctaaggtttactttttaaccttccaaccgtacgtccggacctaaggtaccttagaccacgtacctaggaaacgttntacgttagaacctaagtattactttactagttacaacgtattaacgtagtaacttaaccgttccctaccgtaccttacggttaccgtacgggaccgggtaacggaccgtaaggggtcgagtaccgagacgtaaccgtagtaggtacggtctgactaccg

SEQ ID NO: 11788 - DNA, 559 bp, Homo sapiens
  misc_feature: GYAE6OF01BUAE7.52.2.A02.1.454.CMB.1.raw
  modified_base (320)..(320): a, c, t, g, unknown or other
  misc_feature (320)..(320): n is a, c, g, or t
tcagcgcagtacgacacgaccggtgctcgatttagactcatctacaggggggaggtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctagaagttggtatcagcagaaaccagggaaacgcccctaaactcctagactccgtacgatcgcatcctaatttacggaacnggggtcccatcgaaggttcagtggaagtggctcgtgggactagtacttttacttcaacctatacgccagtacctgactagtcctagaacgattagtgacaatattattacctgtacaacgtagtataggtaatactccgtccgtacttccgtacgtttccgggacgggtaacggggtaccctaaggggttacgacgtactcgaacggtaaccgtaacgtggtcgggtcctgacctaccg

SEQ ID NO: 11789 - DNA, 670 bp, Homo sapiens
  misc_feature: GYAE6OF01DWUHJ.52.2.A02.1.454.CMB.1.raw
  modified_base (164)..(164): a, c, t, g, unknown or other
  misc_feature (164)..(164): n is a, c, g, or t
  modified_base (187)..(187): a, c, t, g, unknown or other
  misc_feature (187)..(187): n is a, c, g, or t
  modified_base (224)..(224): a, c, t, g, unknown or other
  misc_feature (224)..(224): n is a, c, g, or t
tcagcgcagtacgacacgaccggtgctcgatttagactcatctacaggggggagtcagtcccaaccaggacacagcatggacatgagggtccctgctcagctccgtgggctcctgctgctctggctctcaggtgccagatgtatcatccagatcgacccagtcnccatccctcctgtctgcatctanaggagacagaatcaacctatccacgttcggcccgggngagtaccgaggaacctaatttaacagttgtagtctagtaaagtttggtatacgagaacgaaacgaaaaccggaaggggaaaaccctaccccttaaactccgtagacgttcccgtagactgactaacgtacctaagtttacggaacgacgggtacagtacgtagtcaggtagagtgctgtacggtactagttactttacttacactactccgacagtactcgacgacgtacgtagtaagtattaagtacaaccttaaatagtttaaccgtagttacctaaacgtaacgttaagtaacgtaacgttaactaccttcccggttacccacggtttaccgtttaacccgggtacggggaccgggtaaaagggttacccggaaagggttcggaaagttaccaacgggtaaacgaacccgttaggacgggtagtacccgaggtacctaacggg

SEQ ID NO: 11790 - DNA, 689 bp, Homo sapiens
  misc_feature: GYAE6OF01EIWY6.52.2.A02.1.454.CMB.1.raw
  modified_base (271)..(271): a, c, t, g, unknown or other
  misc_feature (271)..(271): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcacatcacttgccgggcagtcaggacattaacatgtatctgaattggtatcagcaagaaaccgagggaaacnccccctaaactcctgactcctagatgaccattaccctaaagttttacgggaaaaccgtacggggtacccaagttaccgtaaaggggttcaagggttaggggaaaggttcgggtacgtacggtagggggacctaaggtttaacttttttaccttttaccaacccgtagtccggacccgtaaggtaccttacggacctacggtaccgtagaaagtacttaagttcgaaccgtaaactatttactttaacgtagtaaccaagtaggttaactagtaacttaactcccgttacccgtaccttaccgttaccggtttccgggaccggggtaaacgggtaacccggtaaaggggtagggtaacggtaactacggaacggaaccggttaaacgttcgggtacgggtccgttcggaccctaacccg

SEQ ID NO: 11791 - DNA, 540 bp, Homo sapiens
  misc_feature: GYAE6OF01CN4L7.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgccctaaactcctagactcctcgatgcatccaattggaacagggtccatacaaggttcagtggaagtggctcgtggactagtattttactcacctactacgacacgactgacgacgctagaagtatattagtactaactaactaattactacgtactaactagtagtagtaataactactaccctctcgtacgttcggtacggtacgggacggtacggtaggaggtacgacgttttttagaacgtaacgtacggtaggtcgtgcgtaaccg

SEQ ID NO: 11792 - DNA, 642 bp, Homo sapiens
  misc_feature: GYAE6OF01EM3GP.52.2.A02.1.454.CMB.1.raw
  modified_base (232)..(232): a, c, t, g, unknown or other
  misc_feature (232)..(232): n is a, c, g, or t
  modified_base (436)..(436): a, c, t, g, unknown or other
  misc_feature (436)..(436): n is a, c, g, or t
tcagcgcagtacgacacgaccggtgctcgatttagactcatctacagggggggagtcagtcccaaccaggacacagcatggacatgagggtccctgctcagctccgtggggctcctgctgctctggctctcaggtgccagatgtatcatccagatcgacccagtcctccactccctccctgtctgctatctaagtaggagacagaactccaaccatcgacgttcggccgggngagtacgaggacattaacattgtactctagtaagttggtatcagacaagaaaaccgagggaaacaccccgtaaatcctagactccgtgatgactagtactaagttacggaacgcgggtaccagtacgaaggttcgaaggtggaagtcggctcggtagggactaaggttacttttactaccaccgtagttccgacaagtaccgtntaccgaacggtaccgtagaaacgttattacgttacgaaccctaaatacttaatttaccgtgtaaacctaagtaagttaactaggtaactttactccccttacgtccgttacgtaccggttacggggaccggtaaacgggaccgtaagggtacgagtaccgtacgaacgggtaaaccgttacgtgggtaggcctacgacggttaacc

SEQ ID NO: 11793 - DNA, 759 bp, Homo sapiens
  misc_feature: GYAE6OF01BMQYZ.52.2.A02.1.454.CMB.1.raw
  modified_base (244)..(244): a, c, t, g, unknown or other
  misc_feature (244)..(244): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacgttggccgggcagtcaggacacttaacattgtactntagtaagttggtaatcgagcaaaggaaacccgaagggaaaaccgtacccctaaaactcctagaactccgtacgatcgacattaccgtaaagtttacgggaaaacgtacggggtaccaacgttacgtaaacgggttacgaggttaggtaaacgggttcggtaccgttacgggttacgggggtaacctttaaggtttaaccgtttttttaaacctttacccggaacccgtaaccgttacccggacccggtaacgttaccggtacgaccgtaacggtacccgtaggtaaaacgttagttaacgttacggtaacctaaacttaacgttaactttacgtacgtaactaaaccgtaagttacgttaagtactttaacgttcccgtcccgttacgttccgtaccggttttaccgggacgggttaaaccgggtacccgggtaaagggttacgggaacgtttaagacccggtaaacggaacggttaacccgtgggttacgggaccttccggaacccttaaccgg

SEQ ID NO: 11794 - DNA, 315 bp, Homo sapiens
  misc_feature: GYAE6OF01AY262.52.2.A02.1.454.CMB.1.raw
  modified_base (311)..(315): a, c, t, g, unknown or other
  misc_feature (311)..(315): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtctcatctcccgcatctgatatacgatcgctgagcgggctggcaaggcgcatagnnnnn

SEQ ID NO: 11795 - DNA, 598 bp, Homo sapiens
  misc_feature: GYAE6OF01BEQZW.52.2.A02.1.454.CMB.1.raw
  modified_base (218)..(218): a, c, t, g, unknown or other
  misc_feature (218)..(218): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacgttgccgggnagtcaggactataacatgtatctagtaattggtatcagcaagaaaccagggaaacgccctaaactcctgactcctcgatgccatacctaatttacggaaacgacggggtcccagtacgaaggttcaggtaggaagtcggctcgtgggacagttattttacttcacctatcgaccaggtactagcacgtcctagaatattatcgctaactattacttactcgttacaacttaagtatacgtaagttaacttccgtcccgtacttaccgtaccggtttaccgggacggggtaaccgggaacccggtaaggggtaggtacggtaacgttccgaaacggtacccggtaaggtttcggtacgggtccgttcggacccttaaccgg

SEQ ID NO: 11796 - DNA, 825 bp, Homo sapiens
  misc_feature: GYAE6OF01DKQ0E.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccactccctccctgtcctgcatctataggagacagaactcaccatcacgtcgccgggcagtcaggacattaacatgtatctagaattggtatcagacaaggaaaccgtaagggaacctaccccctaaatccgtagactaccgtcgatgctaacgtacctaaagttacggaaaccgtacgggtacccagttaccgtaaggttaccgaagggttaggaacggttcgggaccgttacggtacggggtaaccttaaaggtttacctttttttaacccgttacctaaccccgtacgtttaacccggacccgtaacggttaccgtacgggtaccctaaacggtacccgtttaaggtaaaaccggttatttaacgttaacccggtaaacctaaaaacgtttaacttttaaccggttttaaaccgtttacggttaaaaccctaaaaccgttaggggtttaaacttaacggttaaaacccggtttaaaccctttccccggttaaccccccgttacgttaaccccggtttaaccggggttttacccggggggaaaccggttaaaccggggtaaacccggttaaacggggggtaagtaaccggtaaaccggttacggaaaccgttaaccggtaaacggttgggtacccggggtactaccggtacccctaacg

SEQ ID NO: 11797 - DNA, 583 bp, Homo sapiens
  misc_feature: GYAE6OF01EVN8V.52.2.A02.1.454.CMB.1.raw
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctcctgtctgcatctatagganacagaatcaccatcacttgccggngagtcaggacattaacatgtatctgaattggtatcagcaagaaaccagggaaacncccctaaactccnttcgacgtacctcgactgcctaattaccgaaactttggggaaacctaggggtacccaaggttaccaaagggtttcgaaggttgggaacgttcggcgtacctaggggtacttaggtattttaacttctaccactacgacctagactagcctagacttagaagtagattacgactaactattaattacctaagtacgtaactagtaataagtacttaaccgtctacccgtcttcgaccgtttacgggacggtagggtaccgaagggtggacgagtacgtacgacggtacgtagtggtcctgacg

SEQ ID NO: 11798 - DNA, 713 bp, Homo sapiens
  misc_feature: GYAE6OF01DWIUZ.52.2.A02.1.454.CMB.1.raw
  modified_base (192)..(192): a, c, t, g, unknown or other
  misc_feature (192)..(192): n is a, c, g, or t
  modified_base (702)..(702): a, c, t, g, unknown or other
  misc_feature (702)..(702): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctagtagganacagaatcaccatcacttgccgggcgagtcaggactattaacatgtatctgaattggtatcagcaacgaaaccagggaaacgacccctaaatccgtgactccctcgattcgactaactcctaaagtttacgggaaaccgtcggggtaccccaattaccgaaagggtttaccaagggttagggaaacggttcgggccgttacggttacgggggaaccttaaggtttaacgtttttttaaccttttaacccgaacccgtaacgtttccccggaacccgacgttaaccgtttcgggacctaacggtaccccgtttaagggaaaacggttactttaaagtttccggaaacctaaacgttacttttaaactttacctaggttaaccaaacgtaaggttactaggtaaattaacccttccgtaccccgtctaccgttaccggtttcggggaccggtaaggggaacccgtaaggggtacgaggtaactaccgagaaaccgtacgtacggtcggtccngaccgtaaccg

SEQ ID NO: 11799 - DNA, 589 bp, Homo sapiens
  misc_feature: GYAE6OF01AGQ9V.52.2.A02.1.454.CMB.1.raw
  modified_base (578)..(578): a, c, t, g, unknown or other
  misc_feature (578)..(578): n is a, c, g, or t
  modified_base (583)..(583): a, c, t, g, unknown or other
  misc_feature (583)..(583): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctagtaattggtatcagacaagaaaccgtagggaaacgcccctaaactcctagactccgtacgatcgctatacctaagtttacggaaacgacgggtacccagtacgaaacggttcgaaggtcgggtaaaggtcggtcttcgtgggtaactagttacttttaccttacaacctatccgacctaggtactgcctagcctagaaagtattaacgttgactaactataactttacgtgttaccaatagttatagtacttacgttccctcccgtctaccgttacggttccggggacggggtaacctaagggtcggaagtactcgaacgtacgacgtcggagtccncgccncctacg

SEQ ID NO: 11800 - DNA, 707 bp, Homo sapiens
  misc_feature: GYAE6OF01CAOD9.52.2.A02.1.454.CMB.1.raw
  modified_base (191)..(191): a, c, t, g, unknown or other
  misc_feature (191)..(191): n is a, c, g, or t
  modified_base (280)..(280): a, c, t, g, unknown or other
  misc_feature (280)..(280): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctcctgtctgcatctatagganacagaatcaccatcacgttgccgggcagtcgaggacattaacatgtatctagaagttggtatcagcgaacggaaaccgaagggaaaccnccccgtaaatccgtagactccgtcgaatcgactaactaccgttaaagtttacgggaaaaccgtaccggggttaccctaacgttacggtaaacgggttacgtaagggttaggggaacggttacgggtaccgttacgggtacgggggtaaacttaacgggttttaacctttttttaaccctttaccgtaacccgtaacgttacccggtaccccgtaaggtaacccgtacgacccgtacgtacccttaagggaaacgttattacgtttacgaaccctaagttactttaacttaacgtagttaccctaaagtaacgttaagtacgtaacttacgttaccctcccgtacttccgtaacggttccgggacggtaaccgggtaccgagggttacgagtacacgtaggaaccgtagtacggagtcctagcctacg

SEQ ID NO: 11801 - DNA, 334 bp, Homo sapiens
  misc_feature: GYAE6OF01BH0TO.52.2.A02.1.454.CMB.1.raw
  modified_base (245)..(245): a, c, t, g, unknown or other
  misc_feature (245)..(245): n is a, c, g, or t
  modified_base (295)..(295): a, c, t, g, unknown or other
  misc_feature (295)..(295): n is a, c, g, or t
  modified_base (325)..(334): a, c, t, g, unknown or other
  misc_feature (325)..(334): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctagaagatattgcaacattattactgtcaacagtatgataatcctccgctcactttcggcggaggaccaaggtggagatacagacgaacgtgngctgcaccatctgtcttcgatccttcccgactatctagatatacgatcgntggacggcggcgtggacaacggcgcatagnnnnnnnnnn

SEQ ID NO: 11802 - DNA, 707 bp, Homo sapiens
  misc_feature: GYAE6OF01CSMH3.52.2.A02.1.454.CMB.1.raw
  modified_base (232)..(232): a, c, t, g, unknown or other
  misc_feature (232)..(232): n is a, c, g, or t
tcagcgcagtacgacacgaccggtgctcgatttagactcatctacaggggggagtcagtcccaaccaggacacagcatggacatgagggtccctgctcagctccgtgggctcctgctgctctggctctcaggtcgccagatgtatcatccagatcgacccagtcctccatccctccctgtctgcatctagtaggagacaagaactccaacctatccgacgttcgggccgggngacgtcaaggaactaattaacaatgtatctagtaatttggtatcaagcaaacggaaaaccgaacggggaaaacctacccccttaaaactccctagaacttcccgtagaactcaactactacccgtaaagtttacgggaaaacgtacgggttaccccaagttaccgaaaggtttcgaaggttagggaaagttcgggccgttaggtacgggaactaacggtttacttttttaacccgttacaaccctacgttaccgacccgtaggtaacctcgaccgtaacgccgttaaggaaagtaagtttacgttaggaactaaacctatttaaacttacgtacgtaacctaaacgtaaggtaattaagtaattaaaccgttccctccccgtacgtaccgttaccggttacgggaccgggtaaacgggaaccgtaagggtaggacgagttacccgaagaaccgtacgtgtaggcctgcctaaccg

SEQ ID NO: 11803 - DNA, 575 bp, Homo sapiens
  misc_feature: GYAE6OF01CB22K.52.2.A02.1.454.CMB.1.raw
  modified_base (418)..(418): a, c, t, g, unknown or other
  misc_feature (418)..(418): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggcagtcaggacattaacatgtatctgaattggtatcagcaagaaaccagggaaacgcccctaaaactcctagaactccctacgatcgacacttccaattttcggaaaacacggggtcccaagtacgaaggttcaaggtggaagtggtctcgtgggactaggttattttacgttcaccgtatccgaccagactgcagcctagaagntattgactaactattaattactagtacaacgtaagttatgtaacttaactccttcccgcttaccgtacgtttcgggccggtaaagggacccgtaagggttcggaacgtacgtaccgaaacggaacgtaacgttcggtaggccgtacgacctaacccg

SEQ ID NO: 11804 - DNA, 628 bp, Homo sapiens
  misc_feature: GYAE6OF01AREGH.52.2.A02.1.454.CMB.1.raw
tcagcgcagtacgacacgaccggtgctcgatttagactcatctacagggggggagtcagtcccaaccaggtacacagcatggacactgagggtaccctgcgtcagctcctggggctcctgctgctctaggctctcaggtgccagatgtatcatccagatgacccagtctccatcctccctgtctgcatctataggagaccagatcaccatcacttgccggcgagtcaggacattaacgatgtatctgaattggtatcagtcagaaaccagggaaacgtcccctaaactcctagactcctcgactgactatcctaagttttacgggaaaaccgtcggggttacccagttaccgaaagggtttcgaacggttagggaacggtcgggcttacggtagggaactaggttactttttactttcaaccgtattccgaccaacgtactcgacgacgccctaggaaacgtactagttacgaccaactattaacttaccgtagtacaacgtagttactacggtaacttaacgtccttaccccgtctaccgtacgtttccgggacgggtacgggtaacccgtagggtaggagtacgtcgtaacggaacccgtacgttcggacggtctcggcctaaccg

SEQ ID NO: 11805 - DNA, 325 bp, Homo sapiens
  misc_feature: GYAE6OF01C6XSL.52.2.A02.1.454.CMB.1.raw
  modified_base (316)..(325): a, c, t, g, unknown or other
  misc_feature (316)..(325): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtgagatcagacgaactgtggctgcaccatctgtctcatcttcccgcatctgaatatacgactcgctgacgcggggctaggcaaggcgcatagnnnnnnnnnn

SEQ ID NO: 11806 - DNA, 809 bp, Homo sapiens
  misc_feature: GYAE6OF01CXDCQ.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtctccatccctccctgtctgcatctagtaggagacagaatccaccatcacttggaccgggcagtcaggacaattaacatgtatcgtagtaattgtatcgagacgaagaaaccgagggaaaaccgaccctaaaaccttcctacggtactacccgtacggtactacggacctacttaccctaaagttttaacggggaaaaccgtacggggtaccctaacgtacgtaaacgggttcgaaggtacgggtaacggtggtcgtacggtagggtaccgttaaggtttaactttttaccctttaccgtaacccgtacgttacccggaccgtaacgtaacccgttacgaccgtaaaccgttacccgggttaaacggaaagtttaacgttaacggttttacggaaaacccttaaacggtttaaactttaaccggttttaaacctacgggtttaaaccctaaacgtaaacggtttaacgttaaacggtaacctttaaaccgttccccggttaccccgttacccgtttaacccgggttaccgttttaccgggggaacccgggttaaaccgggggtaaccggtaaacgggggttaggaacggttacgttaacggaacgggtaaccgtacggtaggttaccggcgtacgcccgttaacccg

SEQ ID NO: 11807 - DNA, 742 bp, Homo sapiens
  misc_feature: GYAE6OF01BEQH0.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaactcacctatcacgttggccgggcagtcgaggactattaacatgtatctagtaattggtatcgagacaacgaaaccagggaaacgaccccctaaactccgtagaactcctcgatcgactactacgtaaagtttacgggaaacgtacggggtacccaagttaccgtaaagggttacgaagggttagggtaaacggtcgggtaccgttcggtaggggtaactaacggtttaactttttacctttaccgaaccctacgtacccgtaccgtaacgtaccgttacggaccgtaacggtacccgtaaggtaaacgtaatttaaccgttaacgaacctaaaacgttatttaaaccgtttaacgttacgtaaccgtaaacgtaagttaacgtaagtaaaccgttaaacttcccgttaccccgtacgttacccgttaccggtttcccggggaaccggtaacgggggtaaacccggtaaggggttaggaaacggtactaccggtaacgggtaaccgtaaacggttcggtaaccggtccgtacgcccgttaaacccg

SEQ ID NO: 11808 - DNA, 667 bp, Homo sapiens
  misc_feature: GYAE6OF01EOR7M.52.2.A02.1.454.CMB.1.raw
  modified_base (196)..(196): a, c, t, g, unknown or other
  misc_feature (196)..(196): n is a, c, g, or t
  modified_base (217)..(217): a, c, t, g, unknown or other
  misc_feature (217)..(217): n is a, c, g, or t
tcagcgcagtacgacacgaccggtgctcgatttagactcatctacagggggggagtcagtcccaaccaggacacagcatggacatgagggtccctgctcagctcctgggggctcctgctgctctggctctcaggtgccagatgtatcatccagatgacccagtctccatcctcctgtctgcatctataggagacanaatcaccatcacttggccggngagtcaaggacaattaacatgtatctagtaattggtactcgagacaaggaaaaccgaaggggaaacgacccctaaactcctgactcctgatgcatacctaagtttacggaaacgtacgggtacccagtaccgaaggttcaaggtgggaaggtcggtacgttcgtagggggtaactaaggtttactttttaaccttccaaccttagtcccgacctagtactcgaccgaacgtcctaggaaacgtaattacgttacgaccctaaaacgtatttaaactttacgtagtaaccaaacgtaggttaataggtaaacttaacgttccccttacccgacttaccgttaaccggtttccgggggaacgggtaacggggtaacccggtaagggttacggaaaggtactaccgaaagggtaacccgtaacggttggtagggcccttacgaccgttaaccg

SEQ ID NO: 11809 - DNA, 634 bp, Homo sapiens
  misc_feature: GYAE6OF01A4AW8.52.2.A02.1.454.CMB.1.raw
  modified_base (191)..(191): a, c, t, g, unknown or other
  misc_feature (191)..(191): n is a, c, g, or t
  modified_base (467)..(467): a, c, t, g, unknown or other
  misc_feature (467)..(467): n is a, c, g, or t
  modified_base (528)..(528): a, c, t, g, unknown or other
  misc_feature (528)..(528): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacgttgccgggcgagtcgaaggacattaacatgttaatctagtaattggtatcagacaagaaaaccagggaaacgacccctaaactcctagtactccctagactgcctactacctaagtttaggaaaccgtacggggtcccaagttacgaacgggttacaaggttaggaacggttggaccttggtacgggactaacggttactttttaaccttacaccctatacccgaccagtacctaggactacggtactacggtaaagtnttaacgttgaactaactaattacgttactagttaacccaaagtatagtagtactttaaacnccctaccgccttacgtaccggttcggacgggtaaccggggaaccgtagggtagaggtactacggaacgtaccggtaacgttacggtagaccctcggtacctacccg

SEQ ID NO: 11810 - DNA, 609 bp, Homo sapiens
  misc_feature: GYAE6OF01EATX2.52.2.A02.1.454.CMB.1.raw
  modified_base (194)..(194): a, c, t, g, unknown or other
  misc_feature (194)..(194): n is a, c, g, or t
  modified_base (224)..(224): a, c, t, g, unknown or other
  misc_feature (224)..(224): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccactcctccctgtctgcatctagtagganacagaactccaccatcacgttcggccgggngagtcgaaggactattaacatgtatctagtaagttgtatcagacaagaaaccgaggaaacacccctaaactcctagactcctagactcgactaacttactaaagtttacgggaaacgtcgggtaccaagtacgtaaaggttcgaaggtacggtaaggtcggtacgtacggtacgggacttagttactttttacctcaactctaccgacaagcctgaccacgactagaacgtatagttacgaacctaagtattaactttacgtagtaactaaagtagttactagtaaacttactccctccgtactcgttaacgttccgggacggtaagggtaccgtagggtacgaagtcgtaacgaagtaacggtacgtcggagctcgacctaacg

SEQ ID NO: 11811 - DNA, 719 bp, Homo sapiens
  misc_feature: GYAE6OF01C7YBX.52.2.A02.1.454.CMB.1.raw
  modified_base (215)..(215): a, c, t, g, unknown or other
  misc_feature (215)..(215): n is a, c, g, or t
  modified_base (705)..(705): a, c, t, g, unknown or other
  misc_feature (705)..(705): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggnagtcgagacattaacatgtatctgtaattggtatcgagacacgaaacgagggaaacgtcccctaaaactcctcgactacctcggaattcgactaactacctaagtttacggaaacgtcgggtaccctagtacgaaggttacgaggtacgggaagtcggtcgtacgtggggtaactaggttaactttttacgttacctaccgtataccggaccgtaagtaaccgtcgactacggtaccgttaaggaaacgttagttacgttacggtaaccaaactttaacgtttaactttaaccgttacggttaaaccgtaaaaccttaagtttaaacgtaagggttaaacctttaaaacgttccccttacccggtccttaaccgttacccgggttttacgggacccgggtaacggggtaaacccggtaaggggtaacggtaacggtaacgttaaccggtaacggaaaccggttaaaccgttcggggtacggtttaccggngtacccgtaacccg

SEQ ID NO: 11812 - DNA, 611 bp, Homo sapiens
  misc_feature: GYAE6OF01DJO2Y.52.2.A02.1.454.CMB.1.raw
  modified_base (202)..(202): a, c, t, g, unknown or other
  misc_feature (202)..(202): n is a, c, g, or t
  modified_base (232)..(232): a, c, t, g, unknown or other
  misc_feature (232)..(232): n is a, c, g, or t
  modified_base (491)..(491): a, c, t, g, unknown or other
  misc_feature (491)..(491): n is a, c, g, or t
  modified_base (599)..(599): a, c, t, g, unknown or other
  misc_feature (599)..(599): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcgaggtcgccagatgtatcatccagtatcgaccctagtcctccacttccctcctgtctgctactctagtagganacagaactccaccatcgacttcggccgggngagacgaggactaattacatgtatctagtagttgatcgagaccgaaggaaacccgaggggtaaacccaccccttaacgtcctacgaccttccgtaggtactcgacctaacttaccgttaacgttaacgggaaccgtacgggtaccctagttaaccgtaaggtcgtaggtaggtaacgtcggtctacggtacggactttagttacttttccgtacaccgtacgtccgtacctagctacgcagtacgtaagtagtatgtanctaatactttatactagtactaagtagtatactacttactaccctcgacttccgttacggttcggacgggtacgacggtaggtgaacgtgacgaagtacgtagttcgngactcgctaccg

SEQ ID NO: 11813 - DNA, 653 bp, Homo sapiens
  misc_feature: GYAE6OF01CT1A3.52.2.A02.1.454.CMB.1.raw
  modified_base (293)..(293): a, c, t, g, unknown or other
  misc_feature (293)..(293): n is a, c, g, or t
tcagcgcagtacgacacgaccggtgctcgatttagactcatctacaggggggagtcagtcccaaccaggacacagcatggacatgaggtccgtgctcagctcctggggctcctgctgctctggctctcgagtcgaccagatgtatcatccagatgaccagtctcatccgcctgtctgcatctataggagactagactcgacagtcaacgtgccgggacaggtaccaaggtacctaattaacatggtactactagtaagttcggtatacgagcgaacgaaaccgagggaaaccnccctaaactcctagactacgcgatcgactacctcgtaagttaccggaacgcgggttccaagtacgaaacggttcaacggtaggaacgtcgacgtacggtcggaactaggttacttttaccgtacgtaccgtacgttaccggactaacgttaccgtagtaccgaacggtccgttaaggaaacgtaacgttaccggttaacgaaccgtaaacttaacgtaacggtttacctacgtaacgtaaccgtaaggttaactaacggtaactttaacctcccgaccgttctaccgttacgttaccgggcggttaaaggaccggtaagggtacgactgtaccgagacgtacgttcggcacgtgacctac

SEQ ID NO: 11814 - DNA, 729 bp, Homo sapiens
  misc_feature: GYAE6OF01A3S2M.52.2.A02.1.454.CMB.1.raw
  modified_base (225)..(225): a, c, t, g, unknown or other
  misc_feature (225)..(225): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccaagatgtatcatccagatcgacccagtctccatccctccctgtctgctatctagtaggagacagaatcaccatcacgttcggccgggnagtacaggaactattaacatgttatctgtaattggtatcagacaaggaaaccgagggaaaccacccctaaactcctacgactcctacgatagaccaacttaccgtaaagttacgggaaacgtaccggggtacctaagtaccgtaaggttcgaggtagggtaagtcggtactacggtagggactaggtttacttttaccgttacaccgtacgtccgaccgtacgtacgtacggactacggtacctaacggtaaagtacttaacgttacgaacgtaaacttaactttaactttaccgttaacttaaccgtaaacgttaacggttaacttaaacggttaaactttaccgttacccgttaccccgtaccgtttacccgttaccgggtttaccgggaaccgggttaaccgggggtaaacccggtaaagggggttacggaaacggtaccgtaaaccggtaacggtaaccggttaaacggttcggtaccggcgttacccggaccgtacccg

SEQ ID NO: 11815 - DNA, 620 bp, Homo sapiens
  misc_feature: GYAE6OF01AVBSB.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcgaggactattaacatgtatctgtaattggtatcagacaaggaaaccgagggaaaccgtacccctaaacgtccgtacgacttccgtacgtatcgacctactacctaaagttttacggaaaccggtacggggtaccctaagtacgtaacgggttcgaaggtagggaaggtcggtcgtacggtagggaacttaggtttactttttaccttaccaaccgtactaccgaccgtagtactacgacctacgcctaagaatactatacgactaactattacttacgtgtaactaatagtatagtacttaacgttcccgtacccgtacttaccgttacggttccgggacggtaacgggacgtagggtagacgacgtacgagaacgtacgtaggtagctacgctaacg

SEQ ID NO: 11816 - DNA, 679 bp, Homo sapiens
  misc_feature: GYAE6OF01AMM2T.52.2.A02.1.454.CMB.1.raw
  modified_base (193)..(193): a, c, t, g, unknown or other
  misc_feature (193)..(193): n is a, c, g, or t
  modified_base (220)..(220): a, c, t, g, unknown or other
  misc_feature (220)..(220): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccactcctcctgtctgcatctagtagganacagaactcaccatcacttggccgggnagtcaggacattaacagttgtactctagtagtttcgtatcgaagaccgaacggaaaccgaacggggaaaaccctaccccgtaaaactccctagtaactccgtacgatgtacctaactacgttaaacgtttacgggaaacgtacggggtacccaagtaccgtaaggttcgtaggtagggtaaggtcggtcgtacggtcggggtaaactaggtttaacctttttaccttacgaacccttacgtcccgtaccgtaacgtacgttacgacgtacgttaccgtaagtaccgtaagtttacgtacgaacctaacgtattaaccttatacgactaacgtagttatacgtaacttactcccgtaccaccgttacgttaccggttcgggaaccggacgggtaacgtacggggtagaacggtcacggtaaacggtcccgtaaggtcgggtaacgcttacggccctaacg

SEQ ID NO: 11817 - DNA, 764 bp, Homo sapiens
  misc_feature: GYAE6OF01CCCD6.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctagtaggagacagaatcaccatcacttcgccgggcgagtcaggacattaacatgttatctgtaattggtatcagacaacggaaaaccgagggaaaaccgcccctaaactccgtagactcctgactgacctacgttacctaaagtttacgggaaaaccgtacggggtacccctaagttaccgtaaaggtttccgaaggtaggggaaaggttcgggtaccttacggtagggggtaaccttaaggttttaaaccttttttaccgttttaccaacccgttagttcccggacccgtagtaaccccttggaccctaacggttacccttaagggaaacgttactttaagtttaccggaaacttaaactaatttaacgttttaaccttacggttaaaccaaacgtaaggtttaataaccggttaattaacccttcccggttacccccgtacctttaccgttaaccgggttttaccggggcccggggtaaaacggggttaacccgtaaacgggggttagggaacgtaacgtaccggaaacggtaccgggtaaacgtttcgggtaccggtccgttacgaacccgtaaccg

SEQ ID NO: 11818 - DNA, 761 bp, Homo sapiens
  misc_feature: GYAE6OF01B4GYZ.52.2.A02.1.454.CMB.1.raw
  modified_base (190)..(190): a, c, t, g, unknown or other
  misc_feature (190)..(190): n is a, c, g, or t
  modified_base (270)..(270): a, c, t, g, unknown or other
  misc_feature (270)..(270): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacttgccggcgagtcaggacattaacatgtatctgaattggtatcagcaagaaaccgagggaaacncccctaaactcctagactcctacgatcgacctactaccgtaaagtttacgggaaaaccgtacggggtaccccaagttaccgtaaagggtttaccgaagggttacgggaaacggttcgggtaccgttaccgggttagggggtaaccttaacggtttaaccttttttttaacccgtttacccgaaaccccgttacgttacccggaacccctaaggtaaccgtttcggacccgtacggtacccgtaaggtaaacgtatttaacgtttacgaacccttaaacgtaactttaaccgtttaccttacggttaaccaaaccgttaaaggttaacgttaacgtaaactttaaaccgttccccgtaccccgttacctttacccggttaaccggttttccggggaacccgggtaacgggggtaacccgtaagggggttacggaacgttacgtaccgaacgggtaaccgtaacgttcgggtacggtccgtaggccctaaccg

SEQ ID NO: 11819 - DNA, 731 bp, Homo sapiens
  misc_feature: GYAE6OF01C9TBT.52.2.A02.1.454.CMB.1.raw
  modified_base (188)..(188): a, c, t, g, unknown or other
  misc_feature (188)..(188): n is a, c, g, or t
  modified_base (193)..(193): a, c, t, g, unknown or other
  misc_feature (193)..(193): n is a, c, g, or t
  modified_base (215)..(215): a, c, t, g, unknown or other
  misc_feature (215)..(215): n is a, c, g, or t
  modified_base (232)..(232): a, c, t, g, unknown or other
  misc_feature (232)..(232): n is a, c, g, or t
  modified_base (377)..(377): a, c, t, g, unknown or other
  misc_feature (377)..(377): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtcctccatcctccctgtcctgcatctanagganacagaatcacatcactgccggnagtcaggacatttaacntagtatctgaatttggatcagacaagaaaccaagggaaactcccctaaactcctagactcctacgatgaccaactacctaaagtttacgggaaaccgtcgggtaccctagtaccgtaaaggtttcaggttaggaagtggcttagngggtaactagttactttttacgttccaacctacgtccgacctagtaccgtgacctacgaccgtaaggaacgtaattacgtttacgaacgtaaaccttaagtttaactttaccgtacggtttaaccaaaacgttaacggttaaattaacgttaactttaaacccgttacccgttacccccgtaccggtttaccgtttaacccggttttaccgggggaacccgggttaaacggggtaaccccggggttaaaaggggttacgggtaaacggttaaaccggttacccggtaaaagggtaacccggttaaacgggttccgggttaaggggtcccctttacgggacccttaaacccccgg

SEQ ID NO: 11820 - DNA, 639 bp, Homo sapiens
  misc_feature: GYAE6OF01E2ZAN.52.2.A02.1.454.CMB.1.raw
  modified_base (565)..(565): a, c, t, g, unknown or other
  misc_feature (565)..(565): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacaagaatcaaccatcacttcggccgggcagtcaggacattaacatgtatctagtaagttggtatcagacaacgaaaccgagggaaacgtccctaaactcctagactccgtacgatcgacattacctaaagtttaggaaaccggtacgggttcccaagttccgtaaaggttcgtaaggtaggaacggttcggactacgtacgggtaactaacgtttagttttaacctttacgaacctacgtaccggtaccctaaggtaccgtacgtacgtaacgttaccggtaaggttaaactagtttacttaacggaaccttaaacgtaatttaacttacgtacgtaacaacgtaagttatagtacttaactcccgtacccncttaccgtacgttcgggacggtacggacggtagtagggactacgacgacgacggtactggtaggactgcctacg

SEQ ID NO: 11821 - DNA, 754 bp, Homo sapiens
  misc_feature: GYAE6OF01D6GDG.52.2.A02.1.454.CMB.1.raw
  modified_base (197)..(197): a, c, t, g, unknown or other
  misc_feature (197)..(197): n is a, c, g, or t
  modified_base (565)..(565): a, c, t, g, unknown or other
  misc_feature (565)..(565): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgaccctagtctccactccctccctgtctgctatctatagganacagaactcaccatcacgttcggccgggcgagtcgaaggactaattaacattgtatctagtaattggtatcgacgacaaggaaaacccggaagggaaacctaccccccttaaaacgttccgtacgtaaccttcccgtagacttcgacctacttaccgtaaagtttacgggaacgtaccgggtacctaagtacgtaaacggtttacgagggtacggtaacggtcggtaccttcgggtacgggtaacttaggttttaactttttaaccctttacccaaccgttacgtcccgtaaccctaaggtacctccgggtaacctaacggtacccgttaaagggaacttacgttaagttaccggaaactaaactttntttaacgtttacttaacgtaactaaagtacgttaatacgtaacttaacctccccgtcccgtaccttcgggttaacccggtttcggggaaccggggtaaacccgggtaacgtaagggttacggaaacgtaccggtaagaacggttaaacccggtaacggttcgggtaccgtaaccgtccgtacctaaccg

SEQ ID NO: 11822 - DNA, 720 bp, Homo sapiens
  misc_feature: GYAE6OF01A9CHE.52.2.A02.1.454.CMB.1.raw
  modified_base (680)..(680): a, c, t, g, unknown or other
  misc_feature (680)..(680): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtccctactcctccctcgtctcgcactactacgtaggagaacaagaactaccaccactactaccgtcggtccgggcggtacgtcgacgacgtaacttaacgtactaggttactacgtagtaagttaggttactacacggaacgtaaacggaaaccggaaccggggtaaaccgaacccccttaacctaccgtcgaacgttacccgtcgatagacctactaacgttaaacgttaacgggaaacggtaaccgggtcccgtaactaacgtaacggttcggtaaggtaccggtaaggtcggtcttacggtacggtaaaccggtatttaacttttaccgtttacacccgtaagtcccgaccgtaagaccgtcgtaccgaacgtaccgttaagaaacgtacttaacgttgaaccgtaaattacgttacttaacgtctaacgaagttaacggtaatacgtacttaaccgttccgacccttacgtccttaacggttccgggacgggaaccggtaagtaaggtcgggtaanactacggaacaggaccgttgcggctacgacctcgttaacc

SEQ ID NO: 11823 - DNA, 660 bp, Homo sapiens
  misc_feature: GYAE6OF01D3BI6.52.2.A02.1.454.CMB.1.raw
  modified_base (190)..(190): a, c, t, g, unknown or other
  misc_feature (190)..(190): n is a, c, g, or t
  modified_base (214)..(214): a, c, t, g, unknown or other
  misc_feature (214)..(214): n is a, c, g, or t
  modified_base (272)..(272): a, c, t, g, unknown or other
  misc_feature (272)..(272): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctatagganacagaatcacatcacttgccgggnagtcaggacattaacatgtatctgaatttggtatcagacaagaaaccgaggggaaacncccctaaaactcctagactcctacgatcacatacctaaagtttacggaaacgtacggggtacccagttacgtaacggtttacgaaggttagggtaaacggtcggtaccgttacggtacggggtaactaggtttaactttttaccttacaaccttaacgtaccgtaccctaaagtccgtaacgtccgaacgtccgtaaggtaacgtagttacttacgactaaactattaacttaccgtagttaacaactagtaacttagtaactaacgttcctacccggacttccgtaacgtttaccgggacggtaaccggggtaaccgtaaagggtaggtacgtaaacgtacgtaacgaaacggtaaccgtaggttaccggacttccggacctaaccg

SEQ ID NO: 11824 - DNA, 815 bp, Homo sapiens
  misc_feature: GYAE6OF01AZURD.52.2.A02.1.454.CMB.1.raw
  modified_base (779)..(779): a, c, t, g, unknown or other
  misc_feature (779)..(779): n is a, c, g, or t
  modified_base (807)..(807): a, c, t, g, unknown or other
  misc_feature (807)..(807): n is a, c, g, or t
tcagcgcagtacgacacgaccggtgctcgatttagactcatctacaggggggagtcagtcccaaccaggacacagcatggacatgagggtccctgctcagctccgtgggctcctgctgctctggctctcgaggtgccagatgtatcatccagactcgaccctagtcctccactccctcctgtctgctatctagtaggagacagaactccgactatcgtacgttcggccggacgagtacaggtaactattaacagttgtacttcgtaaggttaacgttcggtaactccgaacggaccgaaaacggaaaacccggaacggggtaaaaacccctaccccccttaaaagttccccggtagaaccgtttaccccgtacgtaggttaccgacccttaaacgtttaccccggttaaaaggttttaaccgggaaaaacccgggttcccgggttacccctaaagtttacccgggtaaaggtttccgaaaggggtacgggtaacggttccggtacgtacggggtagggtaaactttacggttttaaccttttaacccggttcaaccgttacgtcccggtaacctaacgtcgttaccggactaaccgggtacgttaaaggtaaacgtttacttaacgtttaccggaaacccttaaagtttagtttaaccgtttacgtaacgttaaaccgtaagtaagtttaccgtaattaacccgttaccgttccgtaccccgttagttacgttaaccggggttccgggaaaggttaccgacggtaagggtgaacgttanaccggaagtacggtacgtgtaacgtccngtcctacg

SEQ ID NO: 11825 - DNA, 678 bp, Homo sapiens
  misc_feature: GYAE6OF01B1LL0.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtcctccactcctccctgtctgctatctataggagacagaactcaccatctacgtcggccgggagtagtacgaggtactaattaacattaggtatcgtagtaagttggtatacgaagacgaacgaaaaccgagggaaaccaccctaaaccgtcacgtactccacgtatcgactaacttactaaagttaacggaaacgtacggggtaccctagtaccggtaaggttacgtacggtaggtaacggtggtccgtacggtagggtaactaacgtttaacttttaaccgttaccaacctacgtccgacctaggtacctagactaccggtacgtaagtaagttacgttactagaaccttaataactttacgtaactagttaacaacgttaagttagtacgtaaataccgttaccgttacccgtaccttaccggtaccgggttacgggacccgggtaaggtaacccggtaggtagacggttaacgagtaaaccggacgtacggtaggtcgacgtcgccgttaacc

SEQ ID NO: 11826 - DNA, 661 bp, Homo sapiens
  misc_feature: GYAE6OF01CICD0.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctcctgtctgcatctagtaggagacagaactcaccatcacgttggccgggcgagtcaggacattaacatgtatctagtaagttggtatcagacaacggaaaccgaaggggaaaccgtaccccctaaactcccgtagtactcccgtacgtatcgactactaccgtaaagttacggaaaccggtacgggtacctagttacgtaacggttacgaggtaggtaaggtcggtcgtcggtagggactagttactttttaccttacctacctacgtccgaccgtagtaccgtcgacgtacgtaccgtagaacgtattacgttacgaactaactattacttactacgtaactaacgtaagtagtacgtacgttacgttcccgtacccgtacgttccgttaccgggtttaccggggaccgggggtaaccgtaaggggtcggaagtacggtaccggaacgtccggtaacggttcgggtcggacttccggacgtacccgtacg

SEQ ID NO: 11827 - DNA, 350 bp, Homo sapiens
  misc_feature: GYAE6OF01DFTMT.52.2.A02.1.454.CMB.1.raw
  modified_base (158)..(158): a, c, t, g, unknown or other
  misc_feature (158)..(158): n is a, c, g, or t
  modified_base (174)..(174): a, c, t, g, unknown or other
  misc_feature (174)..(174): n is a, c, g, or t
  modified_base (287)..(287): a, c, t, g, unknown or other
  misc_feature (287)..(287): n is a, c, g, or t
  modified_base (313)..(313): a, c, t, g, unknown or other
  misc_feature (313)..(313): n is a, c, g, or t
  modified_base (330)..(350): a, c, t, g, unknown or other
  misc_feature (330)..(350): n is a, c, g, or t
tcagcgcagtacgacacgaccggtgctcgatttagactcatctacagggcacgaccggtgctcgatttagactcatctacgaggggtcccatcaaggttcagtggaagtggctctgggacagattttacttcacatcgcagactgcagcctgaagatnttgacaacatattacngtacaacagtatagataatctcccgctcacgtttcggacggaagggaccaaggtggagatcgagacgaactggtgctgcaccagtctagtctacactctcccgactagtctanagtactacgatcgctggacgcgggtntggcaaggtcactagannnnnnnnnnnnnnnnnnnnn

SEQ ID NO: 11828 - DNA, 788 bp, Homo sapiens
  misc_feature: GYAE6OF01A38PS.52.2.A02.1.454.CMB.1.raw
  modified_base (215)..(215): a, c, t, g, unknown or other
  misc_feature (215)..(215): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctagtaggagacagaatcaccatcactgccggnagtcaggactattaacatgtatctgtaattggtatcagcaagaaaccgaggaaactacccctaaactccgtagacttcctacgatcgactacttaccgtaagtttaagggaaaaccgtacgggttacccaagttacgtaaacgggtttacgaagggttaggaacggttcggtaccgttacggtaggggtaaccttaaggtttaacttttttaacccgtttacccgtaacccgtaacgttccccggtaacccgtaaggtaaccccttcggtacccgtaaccggtacccgtaagggtaaaacgttacgtttaacgttacggaaaccctaaacgttaatttaacgtttaacctacgtttaaacctaaacgttaacgtttaagtaacgttaaacgtttaaacccttccccgttaccccggttacttacccggtttaacccggttttaccgggggaaccgggtaaaccggggttaacccggtaaaggggttaccggaagggttaaaccgttaccggtaaagggtaaaccgggttaacggttacggtacggggtaccccttggtaaccccttaaacccg

SEQ ID NO: 11829 - DNA, 700 bp, Homo sapiens
  misc_feature: GYAE6OF01DNNW7.52.2.A02.1.454.CMB.1.raw
  modified_base (651)..(651): a, c, t, g, unknown or other
  misc_feature (651)..(651): n is a, c, g, or t
  modified_base (686)..(686): a, c, t, g, unknown or other
  misc_feature (686)..(686): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtcctccactcctcctgtctgcatctagtaggagaacagaactccaaccattccacgttcggccgggacgtagtacgaggtaactaattaaacattaggttataccttaggtaaacgtttggtaattacacgtacgaaacggaaaacccgaacgggggaaaacccgtacccccgtaaaactcccgtagacctacctcgatcgactactaacctaagtttacgggaaaccgtacgggtacccagttaacgtaacggtacgaaggttaggggaacgttcgggtcgtacgtagggaacttaggttaactttttactacctacgtactaccgcgtaacgtctacgacgtacgtacgtaagtaacgttacgtaattacgaacctaaaggttatttaaccgttagtactaactaacaagttagtaacgtataaccgttccacccgttctacgttaccggttcgggaaccggtaacggaccggtaaagggtcgggtaanaacggttaccgaaggaaactaggttcggacgtccncggtccctaaaccg

SEQ ID NO: 11830 - DNA, 622 bp, Homo sapiens
  misc_feature: GYAE6OF01ES61B.52.2.A02.1.454.CMB.1.raw
  modified_base (272)..(272): a, c, t, g, unknown or other
  misc_feature (272)..(272): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccactcctccctgtctgcatctataggagacagaatcaccatcacttgccggcactcaggactattaacatgtatctagaattgtatcagacaagaaaccgagggaacnccctagaactcctagatctagtgttcacttcctactttgctggacggtcgggtcccagtacgtaaggttcagtggcgtaggtggactcggagagtacgtatacgactaccacctaactactaacccacgtacgtcgacgcggtacggtacgttaggtacgtttacgttacgtaacctttacgttacttacgtacgtaaccgtaagttaacgttaaccgttaccttaccgttacccttacgttacccggttacccggaccggttaccggtaacgtacggttaacggtagttaaactaacgttaaaccgtaaacggttacggttacggtacgtaaccgtcgacccgttaacg

SEQ ID NO: 11831 - DNA, 642 bp, Homo sapiens
  misc_feature: GYAE6OF01DULQA.52.2.A02.1.454.CMB.1.raw
  modified_base (194)..(194): a, c, t, g, unknown or other
  misc_feature (194)..(194): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccactcctccctgtctgcatctagtagganacagaatccaaccatcacgttggccgggcgagtcgaggactaattaacatgtatctagtaatttggtatcagacaaggaaaccgagggaaaaccgacccctaaaactccctagactccctcgatcgactattacctaatttacgggaaacacggggtcccaatacgtaacggttacaggtaggaagtggtctacggtgggaactggttaatttttacctttaccaccgtattaccgaccgacgtacgtacgtccagtaccctaggaaagtattaacgttcggaacctaactaattaactttacgtacgtaactaaagtaacgttattaggtaacttaacttcccgttcccgtcctacgttcccggttacgggaccgggtaacgggaccgtaagggtggaacgtacgaccgaaggtaacgtaacgtcggtgggtctcggaccgtaaccg

SEQ ID NO: 11832 - DNA, 623 bp, Homo sapiens
  misc_feature: GYAE6OF01DH8D4.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaactcaccatcacgttcgccggcgagtcgaggacaattaacatgtatcgttagaatttggtatcagacaagaaaccgagggaaactacccctaaactcctagactcctcgatgactatacctaagttacggaaacgtcgggtacccagtacgaaggttacgaggtaggaacgtggactcgtagggactaagttattttacttacactatcgagcgagtctgcacgtctaggaagtattagtacgactaacgtattacttacgtagtaacctaagtacggttaatagtaacttacgttaccctaccccggtacttaacccgggttacgggttacccgggggaacgggggtaaccgtaagggtagggtaacgtacgttaccgaaacgggtaccgtaacggttacgggtaggtccgtcgtaccggtaaccc

SEQ ID NO: 11833 - DNA, 597 bp, Homo sapiens
  misc_feature: GYAE6OF01DV20G.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatccaccatcacgttgccgggcagtcaggacattaacatgtatctagaattggtatcgagacaagaaaccgagggaaacgacccctaaactccgtagactcccgtagatcgactaacttaccgtaaagtttacgggaaaaccgtacggggtaccctaagtacgtaaaggttcaaggtggaagtggctcgagggactagttacttttacgttacacctatccgactagactgcagacctagaagtatattcgactaactagttacttacgtagtaacaacgtaagttactagtaacttacgtccctacccgtactaccgtacggttcgggacgggtaacgggaaccgtaagggtgaacggtactacggaagaaccgtacgttggtacggtactggcctaaccg

SEQ ID NO: 11834 - DNA, 936 bp, Homo sapiens
  misc_feature: GYAE6OF01EDO8C.52.2.A02.1.454.CMB.1.raw
  modified_base (197)..(197): a, c, t, g, unknown or other
  misc_feature (197)..(197): n is a, c, g, or t
tcagcgcagtacgacacgaccggtgctcgatttagactcatctacagggggggagtcagtcccaaccaggacacagcatggacatgagggtccctgctcagctcgtggggctcctgctgctctggctctcgaggtgccagatgtatcatccagatcgacccagtctccactccctcctgtctgctatctagtagganacagactccactactcgacgttcggccgggtacgagtacgaggtactaagttaacattacggtattcgtaagttaagtttaggtaactacgaacgacgaaacggaaaaccggtaaccgggtaaaccctaacccccgttaaaaccgttcccgtaacggtaccttaccggtacgtacgtacgtaccgtaaccttaaccgttaaggttaaacgggaaacccgggttacccggggtaacctaacggttaaccggttaaacggttacgggttaacggggtacgggtaacgggttaccgggtccggttaacggggttacgggtaaacgttttaaacggttttaaccttttttacccgtaacccgtacccgttaacgttaccccggtaaccgtaacggttacccggtacgttaacccggtaaccggttaacgttaaacggtaaaccgtttagttaaccggttaacggttaaacccttaaaacggtttaacgtttaaccttttaacgggtaacctttaaacccgaagggtttaaacctttacgtaaaccggtttaaacttacccgtttacccgttaccccgttacgttaacccgggttaccggggtttaacccggggtaccgggtaaaccgggggtaacgggttaaacggggtacgggttaaccgtaacgggttaaacccgggaaaccggtttaaccggtaacgggttcccgggtaccgggtaaccgtccggtacccgttaaacccg

SEQ ID NO: 11835 - DNA, 735 bp, Homo sapiens
  misc_feature: GYAE6OF01COSVA.52.2.A02.1.454.CMB.1.raw
  modified_base (135)..(135): a, c, t, g, unknown or other
  misc_feature (135)..(135): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtnccagatgtatcatccagatcgacccagtctccatccctcctgtctgcatctagtaggagacaagatccaccatcacgtcggccgggcgagtcaggactattaacatagtatctagtaattggtatacagacaaggaaaccgaagggaaccacccctaaactccgtcgactcctcgtatacgactactaccgtaagtttacggaacggtacgggtaccagttacgaaggttacgaaggttacggaaggttcgggccgttacggtacgggtacttaacggtttacgttttttaaccttccgttaacctacggttacccgaccttaacggtacctcggtaccttaacggaccgttaaagggtaacgttacgtttaacgttcggaaacctaacttaacggtttaactttaccgtaacggtaactaaacgttaggttaaacgttaacgttaacttaacctttcccggaccccgttacgttaacccggtttaccgggttttaacccggggacgggacccggggtaacgtaaacgggggtaggtaacgtaacgttaccggaagtaaccgggttacgttacgggtacggtcctagggttacccaaccc

SEQ ID NO: 11836 - DNA, 649 bp, Homo sapiens
  misc_feature: GYAE6OF01AN650.52.2.A02.1.454.CMB.1.raw
  modified_base (151)..(151): a, c, t, g, unknown or other
  misc_feature (151)..(151): n is a, c, g, or t
  modified_base (574)..(574): a, c, t, g, unknown or other
  misc_feature (574)..(574): n is a, c, g, or t
  modified_base (603)..(603): a, c, t, g, unknown or other
  misc_feature (603)..(603): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagntcgacccagtcctccatccctccctgtcctgcatctagtaggacgacaagaactccaccatccacgttcggccgggcgagtacgaggactattaacagtgtatcgtagtaattggtactcgagtacgaacgaaaaccgaggggaaacctacccctaaactccgtagactccctacggatcgactacgtaccgtaaagtttacgggaaaccggtacgggtaccctaagtacgtaaacggttcgaaggttacgggaaggtcggtccgtacgggtacgggaactttaaggtttaccttttccgttaccaccgtacgttcccgacgtacgtacgtcgaccgtacggtaccgtaagaagtacttacgtacgaactaacgttattaacgtttacgactaacgtaactagttactagtactaccgttccnccgttactcgtacggtggacggagtacgnggtagacgtcgtacgaacgtccgtaatcggtaacgctcgactaccg

SEQ ID NO: 11837 - DNA, 871 bp, Homo sapiens
  misc_feature: GYAE6OF01CA5Z7.52.2.A02.1.454.CMB.1.raw
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
tcagcgcagtacgacacgaccggtgctcgatttagactcatctacagggggggagtcagtcccaaccaggacacagcatggacatgagggtccctgctcagctccgtggggctcctgctgctctggctctcaggtgccagatgtatcatccagatcgaccagtcctccacttccctcctgtctcgactagtctagtaggananaacgaatcaaccatctaacggtcggccgggtacgacggtacgaaggtaactaaatttaaccgatttaggtactacgttaaggtaagtttaggtaactacgaacgaacgaaaaccggaaaaccggaaacggggtaaaaccctaccccgttaaacctccgttagtaccttaccgtacgtaagtcacttaactaccgtaaagttaacgggaaacgtacgggtacctaagtacggtaaacggttacgaaggttacggggaaacgttcgggtcgtacgggtaacgggtaacgtttaacggtttactttttaacgttacccacgttaaccgtcccgtaacgtaacgtacgtacgtacgtaaccgtacgttaacggaagttactaagttaacccgtaactaacttaacttaaacgttaccgtttaaccggtaacttaaaccgttaagttaccggtttaaagtaaccgtttaaaccctttccggttaacccccgtttacggttaacccggttttaacgggtaacccggggttaacggggtaaaccgggggtaaaccggttaaacggggttagggaaaccggttaccggttaaaccgggaaaccggttaaacggggttaacccgggttaacggtacccggggttaacccgttaggggtaacccctttaaaccccggg

SEQ ID NO: 11838 - DNA, 681 bp, Homo sapiens
  misc_feature: GYAE6OF01BAZS0.52.2.A02.1.454.CMB.1.raw
  modified_base (194)..(194): a, c, t, g, unknown or other
  misc_feature (194)..(194): n is a, c, g, or t
  modified_base (219)..(219): a, c, t, g, unknown or other
  misc_feature (219)..(219): n is a, c, g, or t
  modified_base (310)..(310): a, c, t, g, unknown or other
  misc_feature (310)..(310): n is a, c, g, or t
  modified_base (477)..(477): a, c, t, g, unknown or other
  misc_feature (477)..(477): n is a, c, g, or t
  modified_base (672)..(672): a, c, t, g, unknown or other
  misc_feature (672)..(672): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgaccagtctccatccctcctgtctgctagtctagtagganacagactcacatctacgtggccggnagtcgaggactattaacgatgttatctagtaagttggtactcagacgaacgaaaccgacgggaacctaccctaacgtcctacgacttaccncgtactacgctaactactaacgttacggaaacgtacgggtaccaagtacgtaacggtacgaggtaggaggtcggtacctacggtcgggtaacttaggttttaacctttacggtttacctaaccgtacgtttaccgacgttaagcgtacgtacgtaccgtaccggtanaaaaccgtgttaacgtcggaaacttaaacgtacgtttaagttaacccgtagtaaactaaccgttaggttaactaagttaaccttaacctttcccgaacccgttacgtaaccgttacgggtccgggtaaaccgggtacggtaaccgggtacggtaggtacgtaacggacgtaacgacgttacgacgtagtacgtcncgttaaccg

SEQ ID NO: 11839 - DNA, 751 bp, Homo sapiens
  misc_feature: GYAE6OF01DFAIL.52.2.A02.1.454.CMB.1.raw
  modified_base (260)..(260): a, c, t, g, unknown or other
  misc_feature (260)..(260): n is a, c, g, or t
  modified_base (281)..(281): a, c, t, g, unknown or other
  misc_feature (281)..(281): n is a, c, g, or t
tcagcgcagtacgacacgaccggtgctcgatttagactcatctacgagggggggagtcagtcccaaccaggacacagcatggacatgacgggtccctgctcagctccgtggggctcctgctgctctggctctcgaggtcgccagatgtactcatccaagtactcgacccatcctcctactccctccctgtctcgactatcgtagtaggacaacagaactaccacctagtctacgtcggaccggcgagcgaagactatacntgtactcgtagtagttggtanacagacgaaacggaaaccggaacggtaaaccgtaacccctaactccgtacgtacctcgtacacgttacacgtacttaccgtaaaggttaacggaaaccggtaccgggtacctaacggttaggtaacggttacggtaaggtacgggtaacggtcggtcgtacggggttacggtaactttacggtttaaccttttaccgtaccaaccgttacgtaaccggtacccgtaacgtaccgtacgaaccgtcgggtaacgtaacgtaagtaactttacggtaacaaaccgttaaacttatttaaccgttactacggtaactaacgttaagttacggtaattaacgtaccctccgttaccctacgttacgttaccgggtacgggtaccgggtaacgggtacggtaacggtaggtaacgtacggaacggtaacggtaaccggtcggtacgggttaccgtacggtaccgaccgtttaacg

SEQ ID NO: 11840 - DNA, 731 bp, Homo sapiens
  misc_feature: GYAE6OF01DRRM6.52.2.A02.1.454.CMB.1.raw
  modified_base (135)..(135): a, c, t, g, unknown or other
  misc_feature (135)..(135): n is a, c, g, or t
  modified_base (180)..(180): a, c, t, g, unknown or other
  misc_feature (180)..(180): n is a, c, g, or t
  modified_base (674)..(674): a, c, t, g, unknown or other
  misc_feature (674)..(674): n is a, c, g, or t
tcagcgcagtacgacacgaccggtgctcgatttagactcatctacagggggggagtcagtcccaaccaggacacagcatggacatgagggtccctgctcagctccgtgggctcctgctgctctggctctcaggtnccagatgtatcatccagatcgacccagtctccatccctcctgtcngcatctagtaggagacagtaactccaaccattaccgtacgttcggaccgggacgacggtacaggaacttaattaacgagttgtactacgttagtaagttggtatacgaacggaccgaaacggaaaaccgtaacgggtaaaaccctacccccgttaaagttccgtacgactccgtacgtatcgtactacttaacgtaacggttacggaaccgtacgggtaccctagtaaccggtaaggttacgaacggtggtaacgtcggtactcggaggtacttatttaccgttttactaccgtacgtacttccgaacgtacgtaccttacggactacggtacgtagtaacgtactacgttacgaacttaacgttaagtttacgttaacaccgttaaacggtaataacgttagtaacgttaaccgttacctacccggttcccgttacgtaaccgggtttccgggttaaccggggggaccggttaaacgggaaggtaccgggtanaacggttaccggacggttacggaacgttcggccgtaacggcggtaacctcgttaacg

SEQ ID NO: 11841 - DNA, 768 bp, Homo sapiens
  misc_feature: GYAE6OF01APTFM.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacgttggccgggcgagtcaggactattaacatgtatctagtaattggtatcagacaagaaaccacgggaaacgcccctaaactcctagactcccgtacgatcgactactacctaaagttttacgggaaaacgtacggggtacccaagttaccgtaaaggtttcgaaggttacgggaacgttcgggtcgttacggtacggggtaactaacggtttaactttttaaccgtttacccgaaccttacgttacccggaccgtaacgtaaccgtcggacctaacggtacccgtaaggtaaacgtacgttaacgtttacggaaccttaaacctaacgtttaacgtttaaccttacggttaaccgtaaaccgttaaggttaacgttaagttaaactttaaaccgttccccgttacccccgtacgtttaacccggttaccggtttaccggggaacccgggggtaaacgggtaaaccccggttaagggggtaccggtaacggtacgttaccggtaaacgggttaaccggtaaaccggttcgggtaccgggtaccgttccggacttaaccccgg

SEQ ID NO: 11842 - DNA, 767 bp, Homo sapiens
  misc_feature: GYAE6OF01B9PH4.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtcctccactccctccctgtctgcatctataggagacagaatccaccatcactcgccgggcgagtcgaggactattaacattgtatctagtaatttggtatacgagacaaacggaaaaccgaagggaaaccgtaccccctaaacttcccgtagtaacctcctacgtaacgtcgtactaacttaccgtaaacgtttaacgggaaaaccggtaccggggtaccctaacgttacgtaaacgggttaccgtaagggtacgggtaaacggttcgggaccgttacgggtacgggtaacttaaaggtttacctttttaacccgttacctacccgtaacgtcccggtaccgtaaacggtacctcggtacccgtaacgtaccgtaaagggaaacgttactttaacggtactaaacctaaaccttaagtttaaacctttacgtacgtaacctaaacgtagttaactagtaacttaaccgttccccgttaccgtaccttacggttaacccggtttacgggaaccggggtaaccgggaaacggttacgggtaaggtaacggaacgttaaccgaaagggtaaccgtaacggtcggtaccggtcgtacccgaacgttacg

SEQ ID NO: 11843 - DNA, 776 bp, Homo sapiens
  misc_feature: GYAE6OF01A1Y56.52.2.A02.1.454.CMB.1.raw
  modified_base (166)..(166): a, c, t, g, unknown or other
  misc_feature (166)..(166): n is a, c, g, or t
tcagcgcagtacgacacgaccggtgctcgatttagactcatctacagggggggagtcagtcccaaccaggacacagcatggacatggagggtccctgctcagctccgtgggcctcctgctgctctggctctcgaggtcgccagtatgtatcactcagactcgaccngtcctcctacctccctccctgtctcgctactctaagtaggaacgactaagtaacctcctaacccgattccgtacggttccgggacccgggactacggtaccgaacggtaacctaagttaacagttagttacttacgtagttaagttcgtatcgaagacgaacgaaaccggacggaaacctaccccttaactccgtacgtccgtaccacggtataccggctaacgttaacgttaaggttaaccggaacggtacggtaccctaagtacgttaaaggtcgtaagggtcgtagggtcggtacgttaggtacggtaacctttagttaccttttacgcgtaacctaccgtccgtaaccgtacggtcctacggtaccgacgttaacgtaacgtaacgttaattaccgtaaccgtaacttaacggtactttaacggtttaccgtacttaacggaaattacgaaaccgttagtaccgttaacccgttacccgtacccgttacccgtcgggttaaccgggtaccgggggtaccggtaaacggggtaccgtaaggggtacgtaacggtacgtacccggtaagaaccggttaggtaccggcggtacttcccgaaccgttacc

SEQ ID NO: 11844 - DNA, 732 bp, Homo sapiens
  misc_feature: GYAE6OF01D3IZG.52.2.A02.1.454.CMB.1.raw
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcatccagatgaaccagtctccatccctcctgtctgcatctagtaggagacagaatccacatcacttcggccggcgagtacgaggactattaacagtgtatctagtaattggtatacgagacgaaacggaaaccgaacggggaaaacctccccttaaaacgtccgtacggtaccttacccgtagtacgtcgacctaacgttaccgttaaaggtttacgggaaaacccggtcggggttaccccaagttacgtaaacgggtttcgaaggtacggtaagttcggacgttcggtagggtactaacggtttacttttaaccttaccgaacctacgtcccgtaaccgtagtaccgttacggctaacggtcgtaagaacgttattacggttaccaacgtaaccttaatttacgtttaactacgtaacgttaagtagttaacgtacgttaacttaacctttcccgacccgttacttaccggttaaccggtttaccggggacggaaacgggtaacccggtaaagggtagggtaacgtaaccgtacggaaccggtaacggtaacgtttcggacggttaaccgtcggtaaccctaacgg

SEQ ID NO: 11845 - DNA, 542 bp, Homo sapiens
  misc_feature: GYAE6OF01A3LAO.52.2.A02.1.454.CMB.1.raw
  modified_base (272)..(272): a, c, t, g, unknown or other
  misc_feature (272)..(272): n is a, c, g, or t
  modified_base (318)..(318): a, c, t, g, unknown or other
  misc_feature (318)..(318): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttcgccgggcgagtcaggacattaacatgtatctgaattggtatcagcagaaaccagggaaacncccctaaactcctagactctcgatcgcatcctaagttacgaaacgngggtcctagtcgtaagtcgagtggaagtcggctcgngggactagtacttttactcacatcgaccagtactcgcagcctagaactatacgtgactaanattactacgtagtactaacagtatagtactacgtccctccgtacctcgtaccggttccggggcgggggaaccgtaagggtcgaggataccggagaccgtattcgggacgtacgtgccctaccgtacg

SEQ ID NO: 11846 - DNA, 614 bp, Homo sapiens
  misc_feature: GYAE6OF01E0KCM.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcgaggtgccagatgtatcatccagatgacccagtctccatccctcctgtctgcatctataggagacagaatccacatcacgttggccggcgagtcaggactattaacatgtatctagtaatttggtatcaagacaaggaaaaccgtaaggggaaaaccgtaccccctaaacgtccgtacgtaactcccgtacgactcgactattaccctaaagtttacgggaaaaccgtacggggtacccaagttacgtaaacgggttcaagggttagggtaaacggttcggtactcggtagggtaactaggttactttttaccttacacctagtcccgacagtactgacacgtctaggaatagttactacgaactaacgtattacttaacgtgtaacaagttagtatagtaattacctccgtcctactcgtaccgttcgggacggtaacgggaccgagggtagagctacgaagaccgtaagtgaggctacgctac

SEQ ID NO: 11847 - DNA, 917 bp, Homo sapiens
  misc_feature: GYAE6OF01DOITT.52.2.A02.1.454.CMB.1.raw
tcagcgcagtacgacacgaccggtgctcgatttagactcatctacagggggggagtcagtcccaaccaggacacagcatggacatgagggtccctgctcagctccgtggggctcctgctgctctggctctcgaggtgccagatgtatcatccagatcgacccagtctccactccctccctgtctgctatactaagtaggaagacaagaactaccaacctacgttacctaaccggttcgggcccggggtacgacggttaccggaacggtaaacctaatttaaaccgtaagttacggttaactttaccttaaggttaaagtttacgggttaactaccggtaacggaaacccggaaaaaccggtaaaaaccccggggtaaaaccgggggtaaaacccccgttaaccccccgttaaaaaccgttcccgtaacgttaacccgttaccccgtaaccggtactaccggtaaccttaaaccgttaaccggtttaaaacggttaaaccggggaaaaacccgggtacccggggttaacccctaaacggttaccggggttaaaacgggttaccggtaaggggttaacggggtaaacggttccgggtaccggttacgggttaacgggggtaactttaaacggtttttaacccgtttttaaccctaccgttaacccggtaccgtttaaccccggaaccgtaaccggttacgtacggaccgtaacgtaccggtaagtaacttagttaactacgaactaaacgttacttagtactacggtaactagtaacgttagtaacgtaacctttaccgtcctacccggtaccttaccggttcgggtaccgggaaccggggtaacggtaaccgggtaggtaaccggtaatccgaacggtaaccggtaacgtacggtttcggaccgctacgaccttaccg

SEQ ID NO: 11848 - DNA, 680 bp, Homo sapiens
  misc_feature: GYAE6OF01BENSG.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccattcctccctgtctgcatctagtaggagacagaatccaccatcacttggccgggcgagtcaggacattaacatgtatcgtagtaattggtatcagacaagaaaccgaagggaaacctacccctaaactcctagtactcctacgtatgactactacctaagtttacggaaacgtaccggggtacccaagttaccgtaaacgggttacgaggtacgggtaagtcggtacgttcggtaggggaacttaaggtttaactttttaacctttaccgaaccgtaacgtccgaccgtaacgtacgtcgacccgaaggtcccgtaagaaacggtattacgttacgaactaaacgtattaattacgtacgtaacctaatagttatacgtaattaaccttcccgtaacccgtcttaacccgttacggttccggggaacgggtaaccggggtaaccgtaaggggtaggaacggtacgaccgtacgggtaaacgtaacggttacgggtggacctcgaccttaacccg

SEQ ID NO: 11849 - DNA, 399 bp, Homo sapiens
  misc_feature: GYAE6OF01A9M6L.52.2.A02.1.454.CMB.1.raw
  modified_base (238)..(238): a, c, t, g, unknown or other
  misc_feature (238)..(238): n is a, c, g, or t
  modified_base (272)..(272): a, c, t, g, unknown or other
  misc_feature (272)..(272): n is a, c, g, or t
  modified_base (308)..(308): a, c, t, g, unknown or other
  misc_feature (308)..(308): n is a, c, g, or t
  modified_base (337)..(337): a, c, t, g, unknown or other
  misc_feature (337)..(337): n is a, c, g, or t
  modified_base (342)..(351): a, c, t, g, unknown or other
  misc_feature (342)..(351): n is a, c, g, or t
  modified_base (353)..(399): a, c, t, g, unknown or other
  misc_feature (353)..(399): n is a, c, g, or t
tcagcgcagtacgacacgaccggtgctcgatttagactcatctacaggggcgacgaccggtgctcgatttagactcatctacaggggtcccatcaaggttcagtgggaacgtggctctgggcaggattttactttcaccatcgccagactcgcagcctgaagatattgcaacatattactgtcaacagtatgactaagtcctcccgctcacgtttcgggcggagggaccaaggtgganatcagacgacgtgtggctgcaccatctgtccttnatctcccgcatctgatatacggataccgcttgacgngggtcctaggcgaaggccgtcaacgtgcntagcnnnnnnnnnngnnnnnnnnnnnnnnnnnnnnnnnnnnnnnnnnnnnnnnnnnnnnnnn

SEQ ID NO: 11850 - DNA, 692 bp, Homo sapiens
  misc_feature: GYAE6OF01B7N1C.52.2.A02.1.454.CMB.1.raw
  modified_base (195)..(195): a, c, t, g, unknown or other
  misc_feature (195)..(195): n is a, c, g, or t
tcagcgcagtacgacacgaccggtgctcgatttagactcatctacaggggggagtcagtcccaaccaggacacagcatggacatgagggtccctgctcagctccgtggggctcctgctgctctggctctcgaggtgaccagatgtatcatccagatcgacccagtcctccactcctcctgtctgcatctagaganacagaactcacatactacgtcggccggagagcgagactaagtacatcgtatctagtattggatcgagacaagtaaccgaggtaaccacccctaatccgtagactcgtacgatcgactaactacgtaagtacggaaacgtcggtaaccaattacggtaagtacgtacggttacgaaggttccgacgtaggtaacgggtaccttaaggttttactttaccctacgaacgtacgtaccgtaacgtacgtacgtcgaccgtacgtaccgtaaggtaagttacgttagtaccggaaacttacggttaactttaacgttaactacgtaaccgtaaagttagttaaacttcgttaaaactcccgttacccgttacccgttacttaaccgggttaccgggttaccgggaacgggttaaaccggtaaccggttaagggacgggtaactaaccggacggtaacggtaaccggtaggttccggagtcccgtaccggacccttaaccgg

SEQ ID NO: 11851 - DNA, 761 bp, Homo sapiens
  misc_feature: GYAE6OF01BXA4K.52.2.A02.1.454.CMB.1.raw
  modified_base (265)..(265): a, c, t, g, unknown or other
  misc_feature (265)..(265): n is a, c, g, or t
tcagcgcagtacgacacgaccggtgctcgatttagactcatctacagggggggagtcagtcccaaccaggacacagcatggacatgagggtccctgctcagctccgtggggctcctgctgctctggctctcaggtgccagatgtatcatccagatcgacctagtcctccactccctccctgtctgctatctaagtagacgacagtaactccaacctataccgtacgtcgggccgggcgtaggtacgacggtaacctaagttaacngttattacgtacgttaggtaagtttggtacacggaacgaccggaaacgaaaccgggtaacggaaaccccgttaaccccgttaaacgtccgtacgtaccttaccgtacgtacgtctacctaacgttaacgttaaaacgggttacgggaaccgttacgggtacctagttaacgggtaacgttacggaacggtacgggtaacgtcgggtacgttacgggtacgggtaacctttaaggttttaccttttacccgtaaccctaacgttaccgtaccgtacgtaacggtacgtacccggtctaaaccgggtcttaaggtaaacgttcgttaaccgttacgtaactaaacttaccgttatttaccacgttaacaacgttagtactaggtaaccttcttacccgtccgtacttaccggtaccgggttacggggaccgtaccgggtaagaggggtacacggttacgagacgtaccggttagacgtaccgtacgtactccgtaacg

SEQ ID NO: 11852 - DNA, 696 bp, Homo sapiens
  misc_feature: GYAE6OF01CVOA0.52.2.A02.1.454.CMB.1.raw
  modified_base (677)..(677): a, c, t, g, unknown or other
  misc_feature (677)..(677): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtctccatcctccctgtctgcatctagtaggagacagaactccacctatccacgttcggccgggtcgagtacgaggactaattaacatagtatctagtattggtatcagacgagaaaccgaggaaccaccctaaactcctagtactccgtacgtatcgactactaccgtaaggtttacggaaaccggtacggggtacccagttaccgtaaacgggttcgtaaggtagggtaacggttcggtacgttacggtacggggtaacttaaggtttactttttaccttaaccgtacctacgttacccggaccgtacgtacgtacggactacggtacctaaggaaccgttagttaattaccggaacctaattaacgtttaactacgtacgtaactaaacgtaagttacgtaacgttaacttaaccgtcccgttaccgtacttaccggttaccggtaccgggtaacggggtaccggtaacggagggttagaacgtaacgtaccggaaacgacggtagtacgggngtaaccgtgtaaccctacg

SEQ ID NO: 11853 - DNA, 678 bp, Homo sapiens
  misc_feature: GYAE6OF01AT0LN.52.2.A02.1.454.CMB.1.raw
  modified_base (630)..(630): a, c, t, g, unknown or other
  misc_feature (630)..(630): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccgagatcgacccagtctccactccctccctgtctgctatctagtaggagacagaatccaccatcacgttcggccggcgagtcacggactaattaacatgtatctagtaattggtatcgagacaacgaaaccgaacgggtaaaccgtaccccctaaacgttccgtaaggtaaccttccttacggacttcgacctaacgttaccttaaaggttacggaaacggtaccggggttacctaacgtacgttaaacgggttacgtaagggttaggaacgggttcgtacggttacggacgggtacttaacggtttactttttaccgttaccacgttactccgtaaccgagtaaccgtgaacacggtaccttaggaacgtattagtacgaacctaatagttacttactagtaacctaagtacttagttaacgatttaccgtcgtaacccgtctaaccgtcggttacggaccggtacgggaacgttacgggngaacggtctacggagacccgtaagttccggaaggtccaggtccctacg

SEQ ID NO: 11854 - DNA, 699 bp, Homo sapiens
  misc_feature: GYAE6OF01CA8CI.52.2.A02.1.454.CMB.1.raw
  modified_base (199)..(199): a, c, t, g, unknown or other
  misc_feature (199)..(199): n is a, c, g, or t
  modified_base (391)..(391): a, c, t, g, unknown or other
  misc_feature (391)..(391): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtcctccactccctccctgtactgctatctagtagganacaagaactccacatcacgttggccggacgagtacgagactattaacagttgtactcgtagtaagtttggtactacgaagaccgaaacggaaaacccgaaggggtaaaaccctaccccctaaacttccgagtacctccgtacgatcgactactacgtaaagttacggaacggtcggtaccagtacgtagttnaggtaggagtcggctggtaggtaacttacgtttactttaccttacgactacgtccacgtacgtactacgcgtaaccgtacgtaagtaacgtacttacgtagaaaccgttaacttacgtttaacgttacgtaccgtaaccttaagtaagttaacgtaactaaccttaaccctttcccgtaccgttaccgttaccggttaccgggttaccggggacccggtaaagggtaaccggtagggtacgacggttaacggtacccgtaaacgggtacgtaacggttcgggaaccgtccgtaacctaccggttaccg

SEQ ID NO: 11855 - DNA, 633 bp, Homo sapiens
  misc_feature: GYAE6OF01C2O8E.52.2.A02.1.454.CMB.1.raw
  modified_base (423)..(423): a, c, t, g, unknown or other
  misc_feature (423)..(423): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccactccctccctgtctgcatctagtaggagacagaatcaccatcacgtgccgggcgagtcaggacattaacatgtatctagaagttggtatcagacaacggaaaccgaacgggaaacgtaccccctaaactcctagactcctacgatcgactactacctaagttacggaacgacgggtacccagtacgaaggttcgaggtaggagtcggctcgtagggtactagttacttttacgttacactacgtccgacgacgtacngacgacgacttaagaagttactaattacgaactaacgtatttaacttacgttacgtaaccaaacgttagttaacttagtaacttaacttcccgtacccgtcttaccgttaccggtttccggggacgggtaacgggtaaccggtaaagggtggaacgtactaccggaaacgtacggtaacggtacggttaggaccgtccgtaccgtaaccg

SEQ ID NO: 11856 - DNA, 717 bp, Homo sapiens
  misc_feature: GYAE6OF01C9EBZ.52.2.A02.1.454.CMB.1.raw
  modified_base (204)..(204): a, c, t, g, unknown or other
  misc_feature (204)..(204): n is a, c, g, or t
  modified_base (520)..(520): a, c, t, g, unknown or other
  misc_feature (520)..(520): n is a, c, g, or t
  modified_base (583)..(583): a, c, t, g, unknown or other
  misc_feature (583)..(583): n is a, c, g, or t
tcagcgcagtacgacacgaccggtgctcgatttagactcatctacaggggggagtcagtcccaaccaggacacagcatggacatgagggtccctgctcagctccgtgggctcctgctgctctggctctcaggtgccagatgtatcatccagatcgaccctagtcctaccacttccctcccttgtcctacgctatctagtagganacgaagaactccacctagtactacggtcggccgggcgagtacgaggaacctaattaacattcgtatacgttagtaagtttggtaactcgagaccaaacggaaaaccgtaacgggtaaaccgaccccctaaactcccgtagtacctacctacgacgttacgacctaacgttaaccgtaacggtttaaggaaaacccggtcggggttacccaacgttagaaaccggtttgaaggtacggtaaggtcggacgttacggtacgggaacgtttaacgttactttttaaccctacacctaacgtccgtaaccgaggttaccncgtaacgtaccgtaccgtaagtaaagtacttagtactaacgtaaacttaagttaattacgtanaactaacgtaagttctagtaaccttaacctccgttactacccgtacgttcggttaccgggacggtaacgggtaacggtacgggagtacgtacgttagaaaccgttacgtacgttaggagtcctagccgtaaccg

SEQ ID NO: 11857 - DNA, 837 bp, Homo sapiens
  misc_feature: GYAE6OF01BT4HT.52.2.A02.1.454.CMB.1.raw
tcagcgcagtacgacacgaccggtgctcgatttagactcatctacgaggggggagtcagtcccaaccaggacacagcatggacatgagggtccctgctcagctccgtggggctcctgctgctctggctctcaggtcgccagatgtatcactccagatcggaccctagtcctacctacgtccctcccgtgtctgactatataagaagggacaacaataacctaccaacctatccgtacggttccggggccgggtacgtacggtacgaacggtaacctaagtttacaagttagttacgttcgtaagttaaggtttcgtaatccgaaggaaccgaaaacgggtaaaaccggaaaccggggtaaaaccccctaaccccgttaaaccgtaccgtacgtacccgttaccgaggtactaccggtacttaaaccgttaacggtttaaacggttaaacgggaaaacccgggtaccgggggttaaccctaacggtttaacgttaaaccggggtttacggaaaggggtttacggggtaaacggttccgggttaccggttaacggggtaacgggttaaccgtttaacgtttttaaccggtttaaccctaccgtaccgtaacggttcccgaacgtacgtaacggtcaggtacccgtagtaacgtaatctaacgtactacctaattacggtaacttagtaacgtaacgtagtaagttagtaacccgtaacgttacctcccgggttacctacgttacggttaccggtacgggaccgggtaacgtacgggtacggttaagacctacggtacgggaacgttacgggtacgtggtacgctaaccgtacgttaccg

SEQ ID NO: 11858 - DNA, 688 bp, Homo sapiens
  misc_feature: GYAE6OF01BL3D5.52.2.A02.1.454.CMB.1.raw
  modified_base (188)..(188): a, c, t, g, unknown or other
  misc_feature (188)..(188): n is a, c, g, or t
  modified_base (505)..(505): a, c, t, g, unknown or other
  misc_feature (505)..(505): n is a, c, g, or t
  modified_base (645)..(645): a, c, t, g, unknown or other
  misc_feature (645)..(645): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatccctcctgtctgctatctanaggagacagaatccaccatcacgttcggccgggcgacgtcgaaggacaattaacatgtattctagtaatttggtaactcgagaccgaaaggaaaaccgaacggggaaaccgtaccccctaaacgtccgtacgacttccctagatcgactactacgttaagtttacgggaaaccgtacgggtacccagtacgtaacggttacgagggtaggtaaggtcggtctcgggtacggtaaactaggtttaactttttaccgttaccaaccgttacgtcccgaccgtacggtaccgtcgaccgtagtaccgtaaggtaaagttnttaaccgttgaacctaaacttatttaacgtttactacgtaactaacgtagttaactaagtaacttaaccgttcccgtacccgtacgttacccgttaccggttacggggacgggtaaaccggggtacgaaagggtggaacncggaccgaagggtaccgtagttcgggtacgctggccctaccgg

SEQ ID NO: 11859 - DNA, 720 bp, Homo sapiens
  misc_feature: GYAE6OF01EY23J.52.2.A02.1.454.CMB.1.raw
  modified_base (190)..(190): a, c, t, g, unknown or other
  misc_feature (190)..(190): n is a, c, g, or t
  modified_base (220)..(220): a, c, t, g, unknown or other
  misc_feature (220)..(220): n is a, c, g, or t
  modified_base (236)..(236): a, c, t, g, unknown or other
  misc_feature (236)..(236): n is a, c, g, or t
  modified_base (492)..(492): a, c, t, g, unknown or other
  misc_feature (492)..(492): n is a, c, g, or t
tcagcgcagtacgacacgaccggtgctcgatttagactcatctacgaggggggagtcagtcccaaccaggaccacagcatggacatgagggtccctgctcagctccgtggggctcctgctgctctggctactcaggtgccagatgtatcatccagatgacccagtctccatcctcctgtctgctatctanaggagacagatcactatcacgtcggccggnagtcaggacattaacntgtatctagattgtatcaagcgaagaaaccgtagggaaacgtacccctaaactccgtacggacttacccgtacgtacgtcgtacctacttacccgtaaaagtttacgggaaaaccggtccgggtaccctaaggtaccgtaaagggttcgtaacggtagggtaaacgttcggacttacggtaggggtaacctaggtttacttttaaccgtcgtaaccgtagtccgacctaacgtacttcggactacggtaccgttanaaacggttattaacgtcggaacctaaaggttacttaacggtactaacgtactaaagtaacttaagtacgttaaacttaccgttccccgtacggtaccctttagggtaacccgtttaccgggtaccggggaaacggggttaccgtaaacgggggtacgaacggttaaccgaccgtaaacgggaacgttaacccgggtagggtacggacccgttagaccccgttaacccg

SEQ ID NO: 11860 - DNA, 775 bp, Homo sapiens
  misc_feature: GYAE6OF01C9WLK.52.2.A02.1.454.CMB.1.raw
tcagcgcagtacgacacgaccggtgctcgatttagactcatctacgagggggggagtcagtcccaaccaggacacagcatggacatggagggtccctgctcagctccgtggggctcctgctgctctggctctcgagtgccagatgtatcatccagatcgacccagtctccactccctcccttgtcctcgctatactagtaaggagacaagtaactccaaccatacctacgttccgggccgggacgtaggtacgacggtaacctaattaacattagtactcgttagtaagtttggtatacacgacaacggaaaccgaacgggtaaaacctaccccctaaagtcctgacctccgtacgatcgacctaactacgtaaaggtttaacggaaccgtacgggtaccctagtaacgtaagggtttacaagggtacgggtaaacggtcgggtaccttacgggtacggggtaaacttaacggtttaaccgttttttaccttaccgacccgtaacgtaccgaccgtacgtacgtacggtaccgtacgtaccgtaaggtacgtaattaacgttactaaaccgtaaactaacgtttaatttaaccgttaagttaaccgtaaacgttaagttaacgtagttaaccgttaaccgttcccgttaccccgttaccgttaaccggttaacccgggtttacgggaccggggtaacgggaacgggtaacgggtacgggaactacggacggtaacgtaccggttaagtaccggttacggcgtacgtccgtaaccg

SEQ ID NO: 11861 - DNA, 657 bp, Homo sapiens
  misc_feature: GYAE6OF01E4108.52.2.A02.1.454.CMB.1.raw
  modified_base (202)..(202): a, c, t, g, unknown or other
  misc_feature (202)..(202): n is a, c, g, or t
  modified_base (244)..(244): a, c, t, g, unknown or other
  misc_feature (244)..(244): n is a, c, g, or t
  modified_base (252)..(252): a, c, t, g, unknown or other
  misc_feature (252)..(252): n is a, c, g, or t
  modified_base (444)..(444): a, c, t, g, unknown or other
  misc_feature (444)..(444): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgaccctagtcctccactcctccctgtctgctatctagagagacagacncaccactctacgtcggaccggcgataccgagtactattaacnttagactntagtaagttcgtactacgacgaccaaacggaaaccgaacggaaaccgtaccccttaaacgtcctaggtaccttaccgtacgactactacctaaccgttaacgtaaacgttacgggaaccgtacgggtttaccaagttacgaggttcgtaaggtcgtaaggtcgtacgtagacgtaattacgttacttttacncctacgtaccacggactacgcgcgtacacgtacgtaggtactattacgtacaactaccttaataccttactacgtaacctaggtaccaattacctaattacccttccgcccgtaagttcccgtacggttaccggaaacgggaccgtacggtaagtaccggaactcggtaaaccggacttaggtaacccgttggacgctttaccgcgtttaccg

SEQ ID NO: 11862 - DNA, 795 bp, Homo sapiens
  misc_feature: GYAE6OF01EHW0D.52.2.A02.1.454.CMB.1.raw
  modified_base (220)..(220): a, c, t, g, unknown or other
  misc_feature (220)..(220): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctagtaggagacagaatccacatcacgttggccgggngagtcaggactattaacatgtatctagtaagttggtatcagacaagaaaccgagggaaactaccccgtaaactcctacgactcctacgatcgactactacgtaagtttacgggaaacgtacggggtacctagtaacggtaacggttacgtaaggttagggaacggttcgggtaccgttcggttaacggggtaaccgttaaggtttaaaccttttttaccgtttaccgtaacccgttaacgttacccggaccgtaacggtaccgttacggtaccgtaaccggtaccgtaaggttaaacgtactttaacggttacgaacccgtaaacttaacgtttacgtttaaaccgttacgttaacctaaaccgttaaggtttaacgttaaacgtaaacttttaaccgtacccgtttacccccgtacttttaccccggttaaccggtttaccgggggaacccgggttaaaccgggggtaacccggtaaacggggttacggtaaaccggttaaccgaacgggtaaaccggtaaccggtaaacccggttacggtaccgggtacttacccggaacccgttaaaccccg

SEQ ID NO: 11863 - DNA, 738 bp, Homo sapiens
  misc_feature: GYAE6OF01D4GQ2.52.2.A02.1.454.CMB.1.raw
tcagcgcagtacgacacgaccggtgctcgatttagactcatctacaggggggagtcagtcccaaccaggacacagcatggacatgagggtccctgctcagctccgtgggctcctgctgctctggcttctcgaggtcgccagacttgtactcaactccgagtagtccgtacccgcgttcctaccgtacttccccttaccgtgtctacgaccttaagtacgtaagaacggacgaactacgtaacctacctaccgtacgtcgtacggtccgggaccggtacgacgttaacgagtaacttaaacttacgtaagttacgttcgtaagtagttagttacgtacgacaacggaaaccgaccggaaaacggtccccggtaaccgtaacctacgtacgtccgtacgtccgtaacgtacgtaacgtacgtacgttaacgtacggaaacgtttccgggaaacctaggtaaccgtagtaccgaagggttacggtacggtcgtacgtacgggtacgtacgtaagttttacgttacaccgtacgtcgtaccgtaagtactcgacgtacgtcgtacgaagtactctagtactaataacgttactaacgtacgtacgtaacgtaacgtacgtacgtacgtaactaccgtaccgtaccgtaccgtacgtacggtacggtacggtaacggtaacggtacggtaacgtacggtacgtacgtaacgtacgtacgtacgtaccgtacgtcgtacgtacg

SEQ ID NO: 11864 - DNA, 931 bp, Homo sapiens
  misc_feature: GYAE6OF01DOXN5.52.2.A02.1.454.CMB.1.raw
  modified_base (144)..(144): a, c, t, g, unknown or other
  misc_feature (144)..(144): n is a, c, g, or t
tcagcgcagtacgacacgaccggtgctcgatttagactcatctacgagggggagtcagtcccaaccaggacacagcatggacatgaggtccctgctcagctccgtgggctcctgctgctctggctctcgaggtgccagatgtancatccgagatacgacccagtcctccactcctcctgtctagcatctagagagacagtaactcacctatcgtacgtcggaccgggtacgtacggtacgaacggtaactaactttaaaccagttagttaacgttacgttaaggttaaagtttgggtactaacggaagaccgtaaaaccgggaaaaccggtaacggggtaaaacccctaaccccttaaacgttacccgttacgtaaccttcccggtaacgtaacttaccgaaccttaaccttaaccggttaaaacggtttaaccgggaaaaacccgggtcgggaaacccccttaagtttaaccggtaaaacggggtttaccgtaacggggttaggggtaacgttccggggtacccgtttagggttaaaccggggtacctttaaacgggtttttaaccctttttaacccgttaacccacccgtaacgtttcccgaacgtaccggtacgtaccggaagtttacccggaacgttaaggtaacgttaattacccggttaaaccgactaaaaccgtttagtttaacccgtttaagtacttaaacccgtaacgttaagttaacgttaacggtaaaacctttaccctttccgggtaaccccttttaaccgggtaccttaccggggtttaccgggaaaccgggggttaaaccgttacccggggaaaaggggttaaccccgtagttaaacccccgggaacgggtaaaacgtaccccgggttaaacgggtttccggaaaaccggcctttaccgggaaacctttccccgggg

SEQ ID NO: 11865 - DNA, 753 bp, Homo sapiens
  misc_feature: GYAE6OF01CCW27.52.2.A02.1.454.CMB.1.raw
  modified_base (193)..(193): a, c, t, g, unknown or other
  misc_feature (193)..(193): n is a, c, g, or t
  modified_base (275)..(275): a, c, t, g, unknown or other
  misc_feature (275)..(275): n is a, c, g, or t
  modified_base (623)..(623): a, c, t, g, unknown or other
  misc_feature (623)..(623): n is a, c, g, or t
  modified_base (633)..(633): a, c, t, g, unknown or other
  misc_feature (633)..(633): n is a, c, g, or t
  modified_base (650)..(650): a, c, t, g, unknown or other
  misc_feature (650)..(650): n is a, c, g, or t
  modified_base (671)..(671): a, c, t, g, unknown or other
  misc_feature (671)..(671): n is a, c, g, or t
  modified_base (713)..(713): a, c, t, g, unknown or other
  misc_feature (713)..(713): n is a, c, g, or t
  modified_base (721)..(721): a, c, t, g, unknown or other
  misc_feature (721)..(721): n is a, c, g, or t
  modified_base (744)..(744): a, c, t, g, unknown or other
  misc_feature (744)..(744): n is a, c, g, or t
  modified_base (752)..(752): a, c, t, g, unknown or other
  misc_feature (752)..(752): n is a, c, g, or t
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcactccagtatcgaccctagtcctaccaccttcccttccctgtcgtcnctacttacgtagtacggaagacaagtaacaccacctatctacgtcggaccgggtcgtacgtacgaaggacctaattaaacgntttacggtatttacgtaaggttaagtttacggtaactaccgaaagtaaccggaaaacggtaaaaacccggaaacccggggtaaaaacccctttaaaccccccgttaaaaccgttccgttaacggttaacccttacccgtaacggtaactccggtaaccttaaacgttaacccgttaaaggtttaaacgggaaacccggtacgggtacctacggtaacgtaagggtttacgaagggtcggtaagtcggcgttacggtagtacgttaacgtttactttaacctccaacgtcgaccgtacgacggttctacgacgtacctagtaaacgagttactacgtacaactaacttntaacggttanaccgtaactaagtaatntaacgtactccctcgttaccnctttaaccggtacggtcgggaacgggtacgtaacggaggtanaacgtaanaccggagtaacgtgacggtgacncgttaccnc

SEQ ID NO: 11866 - DNA, 655 bp, Homo sapiens
  misc_feature: GYAE6OF01EWFGW.52.2.A02.1.454.CMB.1.raw
  modified_base (136)..(136): a, c, t, g, unknown or other
  misc_feature (136)..(136): n is a, c, g, or t
  modified_base (246)..(246): a, c, t, g, unknown or other
  misc_feature (246)..(246): n is a, c, g, or t
  modified_base (296)..(296): a, c, t, g, unknown or other
  misc_feature (296)..(296): n is a, c, g, or t
  modified_base (443)..(443): a, c, t, g, unknown or other
  misc_feature (443)..(443): n is a, c, g, or t
  modified_base (463)..(463): a, c, t, g, unknown or other
  misc_feature (463)..(463): n is a, c, g, or t
  modified_base (470)..(470): a, c, t, g, unknown or other
  misc_feature (470)..(470): n is a, c, g, or t
  modified_base (477)..(477): a, c, t, g, unknown or other
  misc_feature (477)..(477): n is a, c, g, or t
  modified_base (518)..(518): a, c, t, g, unknown or other
  misc_feature (518)..(518): n is a, c, g, or t
  modified_base (550)..(550): a, c, t, g, unknown or other
  misc_feature (550)..(550): n is a, c, g, or t
tcagcgcagtacgacacgaccggtgctcgatttagactcatctacaggggggagtcagtcccaaccaggacacagccatggacactgagggtccctgctcagctcctgggctcctgctgctctggctctcaggtcnccgagatgtatcatcctagattcgacccagttctacctactccctccttgtcctgcctatactagtaaggagaacagtaactccgacctacttccgacgttcggaccggngtagtacaggtaactaactaacgtagttgtactcgtagtaagttgacgtnaagaccgtaaagaaacccggtaaggaaaccccgttaccccttaaacggtccttagtaccttaccgacggaccctagtacctacgttaccgttaagttaaccggaacggtaccgttaccagtaccgtaagttcgacggtagtgcggtntacgagtactgttattaccncgtacancccgtanacgttcagacgctactagacgtactgtacactatatacttnacgttaacagtagtaactagtaattccgtacnccctacttaccgagggttccggtaacgggaacgtccggtaaggggtagtactcggtaaacgacccggttaataacgggtcggtaactcggttccaaacggttccc

SEQ ID NO: 11867 - DNA, 723 bp, Homo sapiens
  misc_feature: GYAE6OF01AIO5G.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtctccatccctccctgtctgcatctataggagacagaatcaccatcacttggccgggcgagtcaggacattaacatgtatctgaattggtatacagcaaggaaaccgagggaaacgacccctaaactccgtagactccgtacgactcgactactacctaagtttacgggaaaccggtacggggtccctaagtaccgtaagggttacgaggtagggtaaggtcggtaccgttcggtagggtacgtacgtttaactttttaccgtttacccaaccgtacgtcccgaccgacgtacttcgccgacgtccgttaaggaaacgtattacgttacgaacctaaacttactttaactttacgttacgttaacaaaccgttaagttaacgtttacggtaaaccttaacgttccccgttacccggtaccgttcccgttaacgggtttcccggggaccggggtaacggggtaacccggtaacggggttaggaacggttacgaaaccgggtaaccgggtaaaccgggttaaccggttacgggtacgggtaccgttccgggacccttaacccg

SEQ ID NO: 11868 - DNA, 685 bp, Homo sapiens
  misc_feature: GYAE6OF01CAEGZ.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtctccactccctcctgtctgcatctataggagacagaactcaccatcacgtgccgggcgagtcagactattaacatagtatctagtaattggtatcgagacaagaaaaccgagggaaaccgtacccccttaaactcctagtaccttaccgtacgatcgactaacttaccgttaaagtttacgggaaaaccgtaccggggtacccctaagttacgtaaacggttcgaagggttagggtaagtcggtcgttacggtaggtaacttagtttacctttttacgttaccaccgtacgtaccgaccgtaagtaccgtacggacctacggtaccgttaaggaacgttaagttacgttacgaactaaacttatttaaacgttacttacgtaactaacgtaattactagttaacttaacctcccttaccgtcttaccggtaccggttcggggaacggtaacgggaccggtaagggtagaacgtacggtaccgaaggtaacgtacgtggtaccgtacgttcgaacccgtaccg

SEQ ID NO: 11869 - DNA, 721 bp, Homo sapiens
  misc_feature: GYAE6OF01C027Y.52.2.A02.1.454.CMB.1.raw
  modified_base (142)..(142): a, c, t, g, unknown or other
  misc_feature (142)..(142): n is a, c, g, or t
  modified_base (195)..(195): a, c, t, g, unknown or other
  misc_feature (195)..(195): n is a, c, g, or t
  modified_base (199)..(199): a, c, t, g, unknown or other
  misc_feature (199)..(199): n is a, c, g, or t
  modified_base (225)..(225): a, c, t, g, unknown or other
  misc_feature (225)..(225): n is a, c, g, or t
  modified_base (683)..(683): a, c, t, g, unknown or other
  misc_feature (683)..(683): n is a, c, g, or t
  modified_base (700)..(700): a, c, t, g, unknown or other
  misc_feature (700)..(700): n is a, c, g, or t
  modified_base (710)..(710): a, c, t, g, unknown or other
  misc_feature (710)..(710): n is a, c, g, or t
  modified_base (713)..(713): a, c, t, g, unknown or other
  misc_feature (713)..(713): n is a, c, g, or t
tcagcgcagtacgacacgaccggtgctcgatttagactcatctacaggggggagtcagtcccaaccaggacacagcatggacatgagggtccctgctcagctccgtggggctcctggctgctctggctctcgaggtgccagntcgtatcatccagatcgaccagtctccactcctcctgactgcatctagagganacanactcacgatctacgtcggccgggtanacgtacgaggactaagttactagttgtatacgtagtaagttggtaactcgaacgaacgaacggaaaccgtaacgggaaaacccgtaaccccttaaacgtccgtacgtacctccggtacgtacgtacactaaccttacgtaagttaaccgggaaacggtacggtacctagttaacggtaacggttagacggtaggtaacgtcggtaccgttacggtcggtaaacgtttacggttaaacctttttacgtaacccttacggtaaccgtaccgtaccggtagtacgttacccgacgtacgtaacgtaaagacgtttaattacggttaactacgtaaactacgtttaacgttacgtacgttaaccgtaataacggttaattacgtaaacttctaccccgttaccgtacgttacgtaccgggttacgggacggtaacgggtacgacgggttaggacgtacgtanaaacggtacgtaccggnggtactaccncgngtaacccg

SEQ ID NO: 11870 - DNA, 626 bp, Homo sapiens
  misc_feature: GYAE6OF01BOZ8U.52.2.A02.1.454.CMB.1.raw
  modified_base (193)..(193): a, c, t, g, unknown or other
  misc_feature (193)..(193): n is a, c, g, or t
  modified_base (260)..(260): a, c, t, g, unknown or other
  misc_feature (260)..(260): n is a, c, g, or t
  modified_base (508)..(508): a, c, t, g, unknown or other
  misc_feature (508)..(508): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccatccctccctgtctgcatctatagganacagaatccaccatccacgttcggccgggcgagtcgaggactattaacatgtatctgtaagttgtanacagaccaaggaaaccgaggaaaccgaccccttaaactcctagacctcctcgatcgactacgtacctaagtttaacgggaaaccgtcgggtacctaatacgtaaggttcgaaggtaggtaacggtgtcgttcgtacgggtaacttaggtttacctttttaccgttaccacctacgtccggaccctaggtaccgtgacaccggtctaagtaatattagttcgaactaacgtatttaattacgtcgtaanaactagttatagtaattactccctaccgtctacgtacggttccgggacgggtaacggaaccggtagggttcgaacgaacgtccggaaacgacgttacggcgttaggcaccgtctaccg

SEQ ID NO: 11871 - DNA, 954 bp, Homo sapiens
  misc_feature: GYAE6OF01EV4Q5.52.2.A02.1.454.CMB.1.raw
  modified_base (725)..(725): a, c, t, g, unknown or other
  misc_feature (725)..(725): n is a, c, g, or t
  modified_base (789)..(789): a, c, t, g, unknown or other
  misc_feature (789)..(789): n is a, c, g, or t
tcagcgcagtacgacacgaccggtgctcgatttagactcatctacgagggggggagtcagtcccaaccaggacacagcatggacatggagggtccctgctcagctccgtggggcctcctgctgctctggctctcgaggtcgccagtatgtactcactaccagtactccgaccctcgttcctcctaccttcccctcccttgtcgtacgtactactacgtaggtaacggaacgaactaacgtaacctacctaacctacgttaccgtaccggttccggggcccggggtacggtaacggtaccggtaaccggtaaacttaaacgttaaccgtaagtttacggttacttaacggttaaggttaaggtttacggtaacgtaccggaaacggtaaacccggaaaacggaaaaaccccgggtaaccggggtaaacccccgtaaacccccttaaccgttacccgtacgtaacccgtttacccgtaacggacttaccggtaccttaacgttaaacggttaaaacggttaaaccggggaaacccgggttaacccggttaccgtaaacggttaaccgggttaaaccgggttaaggttacggggtaaaggggttacccggttacggtccggtaacggggttaacgggtaacgttttaaccgttttaacgttttaccctaaccgaaccttacggacccgtacgtaccggttacgtaccggtacgaacgtaccggtaaanaaccgttattacctaaacgactttaacgttatttaagtaaccgacgttaaccaagtttaacgtnttaaaccgtttaccgaccccgtttccctaccggttaaccgtttcgggaaccggggttaacccggggaaccggggtaaacgtaaaccggggtggtacggaaacggtcttaaaaccggggtcctaacgggttaccggggttactaccggacttacccaccgggttac

SEQ ID NO: 11872 - DNA, 803 bp, Homo sapiens
  misc_feature: GYAE6OF01BDL4A.52.2.A02.1.454.CMB.1.raw
tcagcgcagtacgacacgaccggtgctcgatttagactcatctacagggggggagtcagtcccaaccaggacacagcatggacatgagggtccctgctcagctccgtggggctcctgctgctctggctctcaggtgccagatgtatcatccagatcgacccagtcctccactccctccctgtctgcatctagtaggagacagaactccaccatcacgttcggccgggcgagtacgaggactaacttaactatgtatcgtagtagttggtatacgacgacgaaacggaaaaccggaacggggaaaacccgtacccccgtaaaaccttcccgtacgtacctccgtacgtactcgacctaacgttaaccgtaaagtttaacgggaaaccggtaccgggtacccgtaagttaaccggtaaacgggttcgtaaggggttaacgggtaacggtcgggtaccgttacgggttacggggtaaacttaacggttttaactttttaacccgttacccgtaacccgttacgtacccgtaaccggtacgtaaccgtcggtaccgtaacgttaccgtaaggtaaacgttcgttaagttacggaaccttaaattaccgtttacgttaacgttacgtaaccgtaaacttaacggttaattaacgtaaccttaaacccgttcccgttacccgtaccgttaacggtttacccgggtttacggggaccgggtaaccgggtaaccgggtaacggggtaggaacgtacggtacgtaaacggtaccggtaacggttcgggtacggtaccgtccgtaccgtaacg

SEQ ID NO: 11873 - DNA, 823 bp, Homo sapiens
  misc_feature: GYAE6OF01CA4EB.52.2.A02.1.454.CMB.1.raw
  modified_base (164)..(164): a, c, t, g, unknown or other
  misc_feature (164)..(164): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagttcnccatccctccctgtctgcatctataggagacagaactcaaccatccacgttcggccgggacgagtcaggacattaacatgtatctagaattggtatcagcaacggaaaaccgagggaaacgtaccccctaaactccgtagtactccgtacgtaatcgactactacctaaagttttacgggaaaccgtacggggtaccctaagtaccgtaaggttccgaagggtagggaacggtcgggacgttacggtaggggaaccgttaaggttaacttttttaaccggttttaccctaaccgtaccgtaccgtacccgtaacgggtaccgttacgaccgtacgggtaccccttagggaaaccgttaatttaaccgttacggaaaccctaaaccttaatttaactttaaccgttaacgtaacccgtaaaaccgttaagggttaacttaacggttaaacgttaaacccgttttccccgttaacccccggttacgtttaaccccggtttaaccgggttttaccgggggtaacccgggggtaaacccggggttaacccggggtaaacggggttacgggggaaaaccgttagggtaaccccgtaaaacgggttaacccggttaaacggtacccgggttagggttaacccggttcgaacccgttaaaccccgg

SEQ ID NO: 11874 - DNA, 602 bp, Homo sapiens
  misc_feature: GYAE6OF01AWS56.52.2.A02.1.454.CMB.1.raw
  modified_base (135)..(135): a, c, t, g, unknown or other
  misc_feature (135)..(135): n is a, c, g, or t
  modified_base (196)..(196): a, c, t, g, unknown or other
  misc_feature (196)..(196): n is a, c, g, or t
  modified_base (225)..(225): a, c, t, g, unknown or other
  misc_feature (225)..(225): n is a, c, g, or t
  modified_base (255)..(255): a, c, t, g, unknown or other
  misc_feature (255)..(255): n is a, c, g, or t
  modified_base (568)..(568): a, c, t, g, unknown or other
  misc_feature (568)..(568): n is a, c, g, or t
  modified_base (593)..(593): a, c, t, g, unknown or other
  misc_feature (593)..(593): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtnccagatgtatcatccagatcgacccagtctccatccctcctgtctgactatctagtagganacagaatccaccatcacgttcgccgggtnagtcagacattacatgtatctagattggtntacagacaacggaaacgacgggaaaccgtcccctaaactcccgtagtacctcccgtacgtatcggtaccacgttacccgtaaagtttacgggaaaaccgtacggggtccctaagtacgtaagttacgaggtaggaaggtcggtctacggtaggtactagtacttttactcaccgtatcgacctagtactgtaccgacgtctagaacgttatacgtacgtaccaatacttacttaacggtactaacgtaactaggttaatcggtaacttaccgtacctcccgtactacgtcgttacggcggaaacggtcgaggnaggctacgacgtaacggattcggancgtgctacg

SEQ ID NO: 11875 - DNA, 785 bp, Homo sapiens
  misc_feature: GYAE6OF01CQZ2O.52.2.A02.1.454.CMB.1.raw
  modified_base (122)..(122): a, c, t, g, unknown or other
  misc_feature (122)..(122): n is a, c, g, or t
  modified_base (324)..(324): a, c, t, g, unknown or other
  misc_feature (324)..(324): n is a, c, g, or t
tcagcgcagtacgacacgaccggtgctcgatttagactcatctacaggggggagtcagtcccaaccaggacacagcatggacatgagggtccctgctcagctcctggggctcctgctgctcnggctctcgaggtgccagatgtatcatccagatcgaccagtcctccactccctcctgtctgcatctagagaagacaagaactcacatccgacgttggaccggtgagtacgacggtacaattaacgtatagtaatacgttagtaagttggtaactacaacgaacgaaacgaaaccgaaagggtaaacctaaacccccttaaacncccgtaacgtactacccgtacgacgtacgacctaactacgtaaacgtttacggaaaacggtacggtacccctaagtacgtaaaggttacgtaaggtaggtaacggtacgtaccgtacggtacgggtaacgttaagtttaacgttttttaaccttaacgtaccgtaacgttacccggacctaacgttactacggaaccgtacgtaaccgtaagtaacgtaacgtaagtacgtaaacctaacgttaattaacgttaacgtacgttaaacgtaaaccgttaggttaactaaacggtaacttaacccgttacccgtacccgtaccgttaactttacccggggttaacggccgggtaaaaccgggtaacggtaaacgggggttaccgaaacgggttaaccgtaaaccggtaaccggtaaaacgttaccggttaagtccggtaaccggtaccgtccgtaaaaccccg

SEQ ID NO: 11876 - DNA, 862 bp, Homo sapiens
  misc_feature: GYAE6OF01EFPUH.52.2.A02.1.454.CMB.1.raw
tcagcgcagtacgacacgaccggtgctcgatttagactcatctacagggggggagtcagtcccaaccaggacacagcatggacatgagggtccctgctcagctccgtggggctcctgctgctctggctctcgaggtcgccagtatgtatcatccagactcgacctagtcctccacttcctcctgtctcgactactacgtagtaggacgaacaagtaactccaacctactaccgtacgttccggggaccgggtacggtacgtacgaacggtaactaattaacagttgttaactcgtaagtacgtttaggactacgaacgacgaaacggaaaccgtaacgggtaaacctaaccccttaactcgttagacttcgttagttcgttactacttaccgttacgttcggtacgttcggggtacggttccggggtacccttaaggtaaccggttaagggttaccggacgggtacggtacggttacgggtacgggtaccgttacggggtaaacgggaaccgttaaacgttaaccttacccgtaaacccttccgttaaacccgtaacctacgtacccgtaaacggttccgtacgtacggacggttacgtagggttaacgttacggtttactttaccgttaacccttttaacgttaccgtttaacgacggtttaacctaaacggtttaacccgttacgtttaacccggttacccgtttacccggttaccggtttacccggtttaccggggaacccggtttaccggaaaacggtttacgggtttaccgtaagggttaaaaccttaccggtaaaaccgggttaaacggtcggtttcgggaaccgttaaccgtcccggaaatttaccggttaccgg

SEQ ID NO: 11877 - DNA, 670 bp, Homo sapiens
  misc_feature: GYAE6OF01A3KF6.52.2.A02.1.454.CMB.1.raw
  modified_base (183)..(183): a, c, t, g, unknown or other
  misc_feature (183)..(183): n is a, c, g, or t
  modified_base (196)..(196): a, c, t, g, unknown or other
  misc_feature (196)..(196): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcgaggtgccagatgtatcatccagatcgacccagtcctccatccctccctgtctncatctagtagganacagaatcaccatcactggccggcagtcaggactataacatgtatctagattggtatacgagacaagaaaaccgagggaaaccaccctaaaccgtcctagtactccgtacgatacgactattacctaaagtttacggaaacgtcgggtacccaagtacgtaacggtcgtagggtaggtaacggtgtccgtacgtcgggaaactagtttaactttttaccttaccaaccgtaacgtccgtacccgtagtacccgtagtaccgtacgtccgtaaggtaaagtagtttaatacggtaacctaaacggtactttaacgtttaacgtacgtaaccgaaacgttaacgttaagtacgtaatttaacccgtaccgtaccccgttactacccggttaacgggttccggacgggtacgggtaaaccgtgggtacgaagtacgtaccgagtaacccggaagttcggtacgcgtgtacccgtacg

SEQ ID NO: 11878 - DNA, 685 bp, Homo sapiens
  misc_feature: GYAE6OF01CZL28.52.2.A02.1.454.CMB.1.raw
  modified_base (592)..(592): a, c, t, g, unknown or other
  misc_feature (592)..(592): n is a, c, g, or t
  modified_base (656)..(656): a, c, t, g, unknown or other
  misc_feature (656)..(656): n is a, c, g, or t
  modified_base (672)..(672): a, c, t, g, unknown or other
  misc_feature (672)..(672): n is a, c, g, or t
  modified_base (676)..(676): a, c, t, g, unknown or other
  misc_feature (676)..(676): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcgaggtgccagatgtatcatccagatcgacccagtcctccactccctccctgtctgcatctagtaggagaacagaactccaaccactcgaccgttcgggcccgggacggtacggtacgaacgggtaactaagttaaactagttacgtaacgttacgttaagtaagtttaggtaatacgaacgaaaccgaacggtaaaaccggaaaccgggtaaaccggtaacccccttaaaccgtcccgtacgtaccgtcccgtacgtacgtacgtacctaacgttaaccttaacgttaacgggaaacggtacccgggtacctacgttacgtaaggttacgtaggtacgggtaaggtcggtacgttacggtacgggtaacgtacgtttaacgtttttaccttacgtaccctacgtaccgaccgtacgtacgcgtctacgtctaagtagtatagtgtaactatacttatactanactaatagtagtatactactcctacgtctacgtacggtcggacgggacgtacgagggtgaggtnacggagagtacgtagngtcngacgtaccg

SEQ ID NO: 11879 - DNA, 663 bp, Homo sapiens
  misc_feature: GYAE6OF01CFY7Z.52.2.A02.1.454.CMB.1.raw
  modified_base (194)..(194): a, c, t, g, unknown or other
  misc_feature (194)..(194): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccatccctcctgtcctgcatctagtagganacagaactcaccatccacgttcggccgggcgagtacgaaggtactaattaactagttgtattcgtagtaagtttggtatcgagacgaaacggaaaccgaagggaaacctacccctaaactccgtagtacctccgtgtactcgtacctactaccgtaagttacggaaaccgtcgggtaccctaggtaccgtaaggttccgagtaggtaagtcgtcgtacgtaggtactagttctttactacgacctatccgacacgtactgacacgtcgtagaagtagttactgaacctactattacgttactagtaacctaagtaagttacacggttaacttaccttccgtacccgtcgttaacggttaccggttaccgggaaccggggtaacgggtaaccggtaggggtaggaacgtccgttaaacggaacccggttaacggtaacgtcgggttaccgtcctaaccgggcctaaaccg

SEQ ID NO: 11880 - DNA, 842 bp, Homo sapiens
  misc_feature: GYAE6OF01BMMYS.52.2.A02.1.454.CMB.1.raw
tcagcgcagtacgacacgaccggtgctcgatttagactcatctacaggggggagtcagtcccaaccaggacacagcatggacatggagggtccctgctcagctccgtggggctcctgctgctctggctctcaggtgccagatgtatcatccagatcgacccagtctcctactccctcctgtctgctatctagtaggagacagaactcacctatactaccgttcggcccggggacgtacggtcgaacggtaactaacttaacgtagtagttacttcgttaggtaagtttggttaacacgtaacgaccgaaaacggaaaaccccggaagggtaaaaccccgtaccccccttaaaacgttcccgttacgtaccttacccgttagacgttcgacctaacgttaccgttaaagttaaccggggaaaccggtaccggggtaccctaagtaacggtaacggttcggtaaggtaggggtaacggttcgggtaccttacgggtaacgggtaacttaacggtttaaccttttttaccgttaaccacccgttaaccgtcccgggtaaccgtacgttaccgtcgggtaaccctacgggttacccgtaagtaaacgttacgttacgttacaacctaaaacttcgtttaacctttaaccgtacgtaacgtaaagtaacgtttaacgtacgtaaaccttaccgttaccccacccggttaccgttaaccgtttaccgggtttacgggggacggggaaaccggggtttaaccgaaggggtttacggaactaaccggttaaggaccgggttaaaccggtaagtttcccgggaaggtttaccggaaccgttaaccgtacgg

SEQ ID NO: 11881 - DNA, 808 bp, Homo sapiens
  misc_feature: GYAE6OF01DC059.52.2.A02.1.454.CMB.1.raw
  modified_base (130)..(130): a, c, t, g, unknown or other
  misc_feature (130)..(130): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcnggtgccagatgtatcatccagatcgacccagtctccactccctccctgtctgcatctagacggagacagaactccaacctactccgtacgttcgggacccgggtacgacggttaccgaacggtactaaacgtttaaacctagttacggttacttaccgttaaggtaaagttttagggtaacttaccgaagaccgaaacggaaaaccccggtaacgggtaaaaccggtaccccccttaaaacctcccgttagacccttacccgtcggtactcgaacctacgttaccgtaaacggtttaaccgggaaaccggtaccgggtaccctaacgttaacgttaacgggttacgtacgggtaggtaacgtcggtacgttacggagggtaacttaacggtttacctttttacgttaaccgaccgtcgttaccgaccgtaacggtactcgggacctaagggtcctaaaggtaacgttacgtaacgtttaccgaaacctattaaacctttagtttaaccgttacgtaacccaaagttacctaaggtacttaccttaacgttccccgttaccgtacgttacccgtttaccgggtacgggaacccggtaggtaacccgggtagttacggaacgttacccgtaacgtaacggttactaccgggtttagcccggtaacgtccgaccgttaccg

SEQ ID NO: 11882 - DNA, 646 bp, Homo sapiens
  misc_feature: GYAE6OF01CNB4K.52.2.A02.1.454.CMB.1.raw
  modified_base (195)..(195): a, c, t, g, unknown or other
  misc_feature (195)..(195): n is a, c, g, or t
  modified_base (218)..(218): a, c, t, g, unknown or other
  misc_feature (218)..(218): n is a, c, g, or t
  modified_base (417)..(417): a, c, t, g, unknown or other
  misc_feature (417)..(417): n is a, c, g, or t
  modified_base (598)..(598): a, c, t, g, unknown or other
  misc_feature (598)..(598): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtcctccatccctccctgtctgcatctagtagganacagaatcacatcactggccggngagtcagactaattacatgtatactagtaagttggtatcaacgacaacggaaaaccgagggtaaaaccgtccccttaaaactccgtagacttcccgtagatcgactactacgtaagttacggaaaccgcgggtaccagtacgtaagttcgaggttaggacgttcgcgttcgacggtaacttacgtttattttaccctanaccgtacgtacaccgaacgtacgtcgacgtacgtacgtaaggacgtaattacggttacgaacttaatactttacttaacgtctaaaccgtaactatagtaacgttaattacccttccgtaacccgttcttaacttccgggttaccgggacgggtaacgggtaccgtaagggtggtaaacgngtacccggaaggtaaccggttaacgtcgggattccgcggtaccctacg

SEQ ID NO: 11883 - DNA, 888 bp, Homo sapiens
  misc_feature: GYAE6OF01AMYWI.52.2.A02.1.454.CMB.1.raw
  modified_base (195)..(195): a, c, t, g, unknown or other
  misc_feature (195)..(195): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtctccatccctccctgtctgcatctagtagganacgagactcacatcgtacgtcggccgggcgagtacgagtactaattaacgtattgtacttcgtaggttaagttggtactacgaacgaccgaaacggaaaacccggaacggggtaaaacccgtacccccgttaaaccgtccgtacgtaccgtacccgtacggtactacggtacctaacgttaccggtttaaacggttaaccgggtaaaccggtaccgggtaaccctaacggttaaccggttaagggtacggtaacggtacggggtaacggttcgggacggtttacggggtaacggggtaaccttaacgggttttaaccttttttaaccgtacccgtaacccgttaccggttaccggaccgttaaccgtaaccgtccggtaaccgtaaccggttacgtaaggtaaacgttaacgttaacgttacgtaaaccgtaactttaacgtttaacgtttaacgttaaccggtaaactaaaccggtttaacttaacgttaaacggttaaccctttaacccgttaccccgttaccccggttacgttaacccggtttaacccggggttcgggggtaaacccggggtaaccggggttaaacccggtaacgggggtttaacccgaaggtaaccccgtaacgggtaaccggttaacggttaaccgggttcggaaccgggtttaccgacccggtacccgttaacccgg

SEQ ID NO: 11884 - DNA, 875 bp, Homo sapiens
  misc_feature: GYAE6OF01DPCDR.52.2.A02.1.454.CMB.1.raw
  modified_base (153)..(153): a, c, t, g, unknown or other
  misc_feature (153)..(153): n is a, c, g, or t
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
  modified_base (858)..(858): a, c, t, g, unknown or other
  misc_feature (858)..(858): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagangaccagtctccatcctcctgtctgcagtctagtagganacagaatcaccatcacttggccggngagtcaaggtacaagttaacattaggttactactaggtaatttagggtattacgacgacaaacggaaaaccgacggaaaccgtacccctaaacgtccgtagactccgtacgacgtgacctactaacctaagtttaacggaaagttaccggggtacctagttaaccggtaaggttaccgtaacgggttaagggtaaaaggttccggggtacgttaccggtacggggggtaaaaccttaacggttttaaaccggttttttttaaccttaacccgtacccggtaacgttttacccccgggacccgtaaacgggttaaccttaccgggaaccggttaacccggtaacggtttaaacgggaaaaccgggttaattttaaacggtttaacccggtaaaccttaaaacccgttaaagtttttaaaaccgttttaaccctaagggtttaaacccctaaaaccggtttaaggtttaaacttaacgggtttaaaccttaaccggtttaccccttaaccccgttacgtttaccgttaaacccggggttaccgggttacgggggaaaccggtaaacccggggttaaacgggtaggtaaacggttaaccggaacgtaaaccggaacggttaacggttaccggcggtttaacccgnggtaacctaaaccccgg

SEQ ID NO: 11885 - DNA, 768 bp, Homo sapiens
  misc_feature: GYAE6OF01ATXLU.52.2.A02.1.454.CMB.1.raw
  modified_base (142)..(142): a, c, t, g, unknown or other
  misc_feature (142)..(142): n is a, c, g, or t
  modified_base (757)..(757): a, c, t, g, unknown or other
  misc_feature (757)..(757): n is a, c, g, or t
  modified_base (760)..(760): a, c, t, g, unknown or other
  misc_feature (760)..(760): n is a, c, g, or t
tcagcgcagtacgacacgaccggtgctcgatttagactcatctacgagggggggagtcagtcccaaccaggacacagcatggacatggagggtccctgctcagccgtccgtgggggcctcctgctgctctggctctcaggtnccagatgtatcatcagatcgacccagtctcctactccctcctgtctgctattacgtagtaaggaagactaacgaactaccaaccactacgtaccgttgggaccggggtcgtacggtacgaacggtaactaattaacatacgttaacttaccgtagtaagtttacggtatacgaacggaccaacggtaaaaccgaacgggtaaaacccgtaaccccttaaactccgtacggtacctaccgttaacgacgtacaacgtaaccttaaccgttaaacggttaacgggaaacccggtaccggggtaaccaacgttaacggtaaacggtttaccgtaagggtacggtaaacggggttaccgtcgtaacgggtaacgggtaaacttaaccggttttaacctttttaaccgttacccgaaccgttacttaccccgaagtaccgtaacgtcgtaacgtcgtaacggtaagtaagtacttaacggttagaaccgtaaactattaacgttctaaccgtactaactaggttataactaacgttacctcgtacctactaccggtacggttcggacgggttaacggacggtaggtaggtagaactacgggaagacctacggcgggttanacncgataccg

SEQ ID NO: 11886 - DNA, 698 bp, Homo sapiens
  misc_feature: GYAE6OF01BYDJW.52.2.A02.1.454.CMB.1.raw
tcagcgcagtacgacacgaccggtgctcgatttagactcatctacgagggggggagtcagtcccaaccaggacacagcatggacatgagggtccctgctcagctccgtggggctcctgctgctctggctctcgaggtgccagatgtatcatccagtatcgaccctagtcctccactccctcctgtctgctatactagtaggagaacagaactccaactatcgtaccgttcgggccgggcgagtacgaaggtaactaattaacattacgtaatcgtagtaagttggtactacgagacgaacgaaaccggaacggtaaacctacccctaactcgtagacttccgagatacactaacttactaaggttacggaacggtacggtaccagtacgtagtagaaggtaggtacgtcggtcgtacggtagggtaacctagttttaacttttacctacctaccgtacgtcccgaccgtagtacccgtagtacccgacgttagaaggtaattattacgtacgaactaagttacttactacgttataacctaataacggtttataacgtaacttaacccttcccgtaccgtacctttaccggtaccgggttaccggggaacgggtaaaccgggtaacgtaacggggtagaacgtacgtaacggaacggtaaacggttccggttaggacggttaccaacgtcccgtaacg

SEQ ID NO: 11887 - DNA, 729 bp, Homo sapiens
  misc_feature: GYAE6OF01BOIJ7.52.2.A02.1.454.CMB.1.raw
  modified_base (193)..(193): a, c, t, g, unknown or other
  misc_feature (193)..(193): n is a, c, g, or t
  modified_base (208)..(208): a, c, t, g, unknown or other
  misc_feature (208)..(208): n is a, c, g, or t
  modified_base (212)..(212): a, c, t, g, unknown or other
  misc_feature (212)..(212): n is a, c, g, or t
  modified_base (719)..(719): a, c, t, g, unknown or other
  misc_feature (719)..(719): n is a, c, g, or t
tcagcgcagtacgacacgaccggtgctcgatttagactcatctacagggggggagtcagtcccaaccaggacacagcatggacatggacgggtccctgctcagtctccgtggggctcctgctgctctggctctcgaggtcgccagatgtactcatccagactcgaccctagtcctcctactccctcctgtctncctatctagtagganacanactcactatctacgtcggccgggtactaggtcaacggtactaacttaactagtacgtactacgtagtacttaggtactacgaacgacgaacggaaaaccggaacgggtaaaaccccggtacccttaaccgttccgtacgtacgtacccgtagtaacgtccgtaacctacgttaaccgttaacggttaaccggaaccgggtacgggtacctaaggtacggtaacggttacgagggtacggtaggtacgtcggtacggtacggtattaacgttacgtttaccgtaccacgtacgtaccgtcgtagtaccgtagacgtacgtactaaaggtacgtattacggtacaaccgtaactagtttaacgtttaccgacttaacgtaaaccggtagttacttaacgtaacttaacccgtcccttaccggtacccttagggtaacccggtttcgggaacgggtaaccggtacgtacgggagtagtacgacggtaacgacggtactcgggtagtaccncgtactccgg

SEQ ID NO: 11888 - DNA, 597 bp, Homo sapiens
  misc_feature: GYAE6OF01CGNL7.52.2.A02.1.454.CMB.1.raw
  modified_base (214)..(214): a, c, t, g, unknown or other
  misc_feature (214)..(214): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctagaggagacagaatcacatcatcgccggnagtcaggacattacatgtatctagtaattggtatcaagacaacgaaaccgaagggaaaaccgtacccctaaaactcctagactcctacgatcgacaacttacctaaagtttacgggaaaacgacgggtaccctaagtacgtaacggttcgaggtagggaagtcggacgttcggagggtaacttagttacgtttttactaccactactaccgaccgagtactcgcacgtctaggaatatagttcgactaaactattaacttactacgaactaacgtatagtataagtaacttcctcctacctacgtaccggttacgggaccgggtaaggaccgtaagggtggaagtcgaacgaacgtaacgactaggtccgactcgcctaaccg

SEQ ID NO: 11889 - DNA, 697 bp, Homo sapiens
  misc_feature: GYAE6OF01CFTLP.52.2.A02.1.454.CMB.1.raw
  modified_base (607)..(607): a, c, t, g, unknown or other
  misc_feature (607)..(607): n is a, c, g, or t
  modified_base (649)..(649): a, c, t, g, unknown or other
  misc_feature (649)..(649): n is a, c, g, or t
  modified_base (656)..(656): a, c, t, g, unknown or other
  misc_feature (656)..(656): n is a, c, g, or t
  modified_base (683)..(683): a, c, t, g, unknown or other
  misc_feature (683)..(683): n is a, c, g, or t
tcagcgcagtacgacacgaccggtgctcgatttagactcatctacgaggggggagtcagtcccaaccaggacacagcatggacatgagggtccctgctcagctcgtgggctcctgctgctcgtggctctcgaggtcgccaggtatgtactcactccagatcgaccagtctccacttccctcctgtctgactatactagagacgacaagactcaacctagtcgtacgttcggccgggacgtaacgaccgaaggtaacctaatttaaaccagttatacgttgtaagtaacgtttggaactagaacggaccaaaacggaaaccgaacgggtaaaccctaaccccgtaaactccggtatactaccctagactacgactaacgttctaaacgggttacggaaaccgtcgggtaacctacgtaaggtaacgtacgaggggtagttaggacggtcggtttacgacggggtaacttaaacgttttcctttaaccgttaccgaacctacggttacccgacgtaacggttaccacgggtacctaacggtactaacgggaaattacctaggttacaaacgtacttaatcgtacttacgataagtatagactagttccncgtaccctgttaacgtcggttcggaacggagtaacggtacgnggttaanacggtacgaacggattggtaccggganaccggtcacggtac

SEQ ID NO: 11890 - DNA, 715 bp, Homo sapiens
  misc_feature: GYAE6OF01B5648.52.2.A02.1.454.CMB.1.raw
  modified_base (193)..(193): a, c, t, g, unknown or other
  misc_feature (193)..(193): n is a, c, g, or t
  modified_base (222)..(222): a, c, t, g, unknown or other
  misc_feature (222)..(222): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtctccatcctcctgtctgcatctagtagganacagaactccaccatcacgtcggccgggngagtacgagactattaacatgtatctagtagttgtatcgagactaacggaaacgaacggaaacctacccctaaacgtccagtacctcctacgatacgactacgttacgttaacgttaaggaaacccggacgggttacccagttaccgtaagggtttccgaaggtacgggtaggtcggtcgtacggtacggtaacttacggttactttttaccgtacgtacctagtcccgtactaacggtacctcggtacacgtaccgtaagaaacgttacttacgtacgacttaaacgttacgttaaactttacgtacggttaactaaacgttaggttaacttacggtaaacttacccgtttacccgtacccgttacgttacccggtttaaccgggtttccgggggaaacccggggttaaccgggtaaccgggtacggggtaggaactccggaccggttaacgaaccggttacggtcggtaccgtaccgtggtaacccctacg

SEQ ID NO: 11891 - DNA, 814 bp, Homo sapiens
  misc_feature: GYAE6OF01AVX9D.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagactcgaccacgtcctcactcctccctgtctgctatctagtaggagacagaatccacctatacctacgttcgggacccgggacgacggtcaaggtaacctattaaactattacggtacttacgtagtaaacgtttaggtaacgtacaagaccgaaacggtaaaaacccgaacggggaaaaccgtaacccccgttaaaaccgtccgttacggacgttacccgtaccgtacgttaccgacaactttaaccgtaaggtttaacggaaaccggacgggttacccaacgttacgtaacgggttactaaggttaacgggtaacggtcggttacgttaccggtacggggtaaacttacggttttaatttttacccttacgtaacccgttgtacccggaaccgtaacggtactacggacgtaccgtacggtaaagtaaggtactttaacttacgaaccttaactacgtttaactttaccgtaacgtttacgaaacgtagttaacgttacggtaacttacccgtttaccccgtaaccccgttcgtttaacccgttaccggggtttcccgggggtaacccggggtaaacgggtacggttaacgggtaacgggactaaccggtaaacggtaccgtaaacggttccgggtacgtaccgcgtaccgtacgttaccgg

SEQ ID NO: 11892 - DNA, 788 bp, Homo sapiens
  misc_feature: GYAE6OF01EX9HE.52.2.A02.1.454.CMB.1.raw
  modified_base (558)..(558): a, c, t, g, unknown or other
  misc_feature (558)..(558): n is a, c, g, or t
  modified_base (739)..(739): a, c, t, g, unknown or other
  misc_feature (739)..(739): n is a, c, g, or t
  modified_base (777)..(777): a, c, t, g, unknown or other
  misc_feature (777)..(777): n is a, c, g, or t
tcagcgcagtacgacacgaccggtgctcgatttagactcatctacaggggggagtcagtcccaaccaggacacagcatggacatggagggtccctgctcagctccgtggggctcctgctgctctggctctcgaggtcgccagattgtactcactccagactacgaccctagtcctccactcccttcctgtctgctatactagtaggacacaagaactaccaaccatcgtacgttcgggccggcgtaggtcgaacggtaacttaattaaacagttagttactcgttaacggttaagttttggaacttcgaacggaccgaaaacggaaaaccggaaaccggggaaaccgtaacccccgttaaacgtttacccggtacggtactttacccggtaacgactcggtaacctaacgtttaccgtaaagttaacgggaaaccggtaccggggttaccaaacgttacggtagttaccgggtaaggtacgggtacggttcgccggttaacgggtacgggtaatttaacggttttaacttttaccgtacctacctacgtacccggtanacgtacgttacgaccgtaggtacctaaggaacgttacttaacgggactaaccaaacttaacgtttactttaaacgcgtaacgttacgtaaatcggtaacgttaaccttaacgtcccgttaccgtacttcccggtaccgggttacgggacggaaacggttcggaaagggtactaccggtacnggtaaacggccgttaagggtacgaccggtccggttaanccggttaaccc

SEQ ID NO: 11893 - DNA, 689 bp, Homo sapiens
  misc_feature: GYAE6OF01BTKN4.52.2.A02.1.454.CMB.1.raw
  modified_base (196)..(196): a, c, t, g, unknown or other
  misc_feature (196)..(196): n is a, c, g, or t
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcatccagatcgacccagtcctccactccctccctgtctgcatctatagganacagaactcacatctacgttcggccggacgtagtcgaggactagttaacagttgtatctagtaatttggtatacgaaggaaacgaaacccgaagggaaacccgtacccccttaaaccgtcctagtaactcccgtacgactcggacctacttaccgtaagtttaacgggaaaccggtacgggtaccctaagtaccgtaaggttaccgagggtaggtaagtcggtcgttcggtacgggtacttaacgttttacttttaccttacaccctagtcccgaccgtacgtaccgtcgtacctaccgaccgtaggtaaagtacttagtagaactaacttaatttactttacgtactacgtaacgttagtaattaacgtaacttaaccttcccgttacccgtacttacccggttacggttaccgggacgggtacggtaaccgtagggtaggactagtacccggagtaacggtacgttcggacgtacctacgccctggttacc

SEQ ID NO: 11894 - DNA, 835 bp, Homo sapiens
  misc_feature: GYAE6OF01B6SV3.52.2.A02.1.454.CMB.1.raw
tcagcgcagtacgacacgaccggtgctcgatttagactcatctacagggggggagtcagtcccaaccaggacacagcatggacatgagggtccctgctcagctccgtggggcctcctgctgctctggctctcgaggtgccagatgtatcatccagatcgacccagtcctccactccctccctgtctgcacttactaagtaggaacgaacaagaactccaacctatacctaaccgttcgggccgggtacggtacgtacgaaggtaacctaattaactagttagttaactacgttaaggtaagttacggttaatacgaacggaaccgaaacggaaaaccccggaaacggggtaaaacccctaacccccgttaaaaccgttcccttacggtaccttacccgtacgtacgttacgaccttaacttaacccgttaaacggtttaacgggaaaacccggtacggggtaaccccttaacggttaaccggttaagggttaccgtaaggggtacgggtaaacgggttcggtaccggttacgggtaagggtaaacgttaggttttacctttttaacgttacctaccgtaacgtccgtaacgtaacgtaccgtcggaacctacgtacgtaagtaaccgtattaacgtagaaacctaagttattaacggtttaaccacgtaaagtaaaccgttaattagtaacttaacttaaccgttacccgtaccccgttacttaccggttaccgggtaaccgggggaacggtaacccgggtaaagttacggggtacgaacggtacgtaacgaaggttaacccggaggttcgaacgggtctacccggaccttaacg

SEQ ID NO: 11895 - DNA, 762 bp, Homo sapiens
  misc_feature: GYAE6OF01DE8LN.52.2.A02.1.454.CMB.1.raw
  modified_base (751)..(751): a, c, t, g, unknown or other
  misc_feature (751)..(751): n is a, c, g, or t
tcagcgcagtacgacacgaccggtgctcgatttagactcatctacgaggggggagtcagtcccaaccaggacacagcatggacatgagggtccctgctcagctccgtggggctcctgctgctctggctctcgaggtcgccagtattgtatcactccagatcgacctagtctccactccctcctgtctgctatctagtagacgacaataactccacctactccgtacgttcggccgggagtacgtacgacgtactaagtttaaaccgtattacggttaactttcgtaaggtttaaaacgtttggtaacgttaccggaacgtaaaccggaaaacgggaaaaccccgggtaaacgggaaaaccccgttaacccccttaaaccgttccgtaagtacccttccgaacgtactcggtaacctacttaaccgttaacggtttaaccgggaaccggttaccgggtacctacgttaacggttaaagttaccggtaggtaagggtacgtacggtaccgttacgggtacggtaaacttacgtttttaaccttttacccgtactacccgtacgtaccgtacgacgttacgcgtactacggtaccgtaagtaagttcgtagtaacgacctaaattagtttacgttaacgtacgtaacgtaacttagtacgtacttaacgtacctccgttcccgtattaccggttacgggttacgacgggtacccggaggtaggtacagtacacggtacgtacgtacggtcgtanccacgtctacg

SEQ ID NO: 11896 - DNA, 869 bp, Homo sapiens
  misc_feature: GYAE6OF01EVWX0.52.2.A02.1.454.CMB.1.raw
  modified_base (228)..(228): a, c, t, g, unknown or other
  misc_feature (228)..(228): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcgaggtcgccagatgtatcatccagatcgacccagtcctccactccctcctgtctgctatctagtaggagacagaactcaccatctacgtcggccgggngagtcaaggactaacttaacattgtatcgtagtaagttcggtatacagacgaacgtaaaaccggaagggaaaccgacccccttaaactccgtacgtaccttcccgtacgtactaggtactacgttaccgtaaagtttaacggggaaaacccggtcggggtaaccctaacgttaacccggttaaagggttaccggaagggtacgggtaaacgggttcggtaccggttaccgggtacgggtaacgttaaggttttaaacctttttaccgttaaccgtaacccgttaaggtacccggtacccgtaacggtaccccgttacggacccggttaacggtaacctaaggggtaaacttaacgggtttaattaaccggtaaaccttaaaacgttaccgtttaacgttttaacccgacggtttaaagtaaacccggtttaaagttaccgttaacgttaaacctttaacccgttaccccggttcccggttaccgtttaaccggttaacccgggggttttacccgggaacgggggaaacgggttaaaccggggtaacggggtaagggaccgttaacgggttaaacggaaacccggttaacggggttaaccgttccgggtaaggggtccccttaacgggaaccttaaccccgg

SEQ ID NO: 11897 - DNA, 763 bp, Homo sapiens
  misc_feature: GYAE6OF01ELXEI.52.2.A02.1.454.CMB.1.raw
tcagcgcagtacgacacgaccggtgctcgatttagactcatctacagggggggagtcagtcccaaccaggacacagcatggacatgagggtccctgctcagctcctggggcctcctgctgctctggctctcaggtgccagatgtatcatccagatgaccagtctccactccctcctgtctgcatcgtagtaggagacagaatccaacgatcctacgttacggccgggacgaggtcgaaggactaattaacatagtacttacgtagtaagtttaggtactacgaagacgaaacggtaaaaccggaaacggggtaaaccgacccccttaaaacgtacccgtacgaacgttacccgtacggtacttacggactaaacttaaccgtaaaggttttaacgggaaaaccggtacggggttaacccctagtaacgtaaacgggttaccgtaagggtagggtaaacggtcggtaccgttacggtaacggggtaactaaggttttaaactttttacccttaaccgaacctacggtacccgtaaccgtaaaggtacccgtagtaacccggtaacgtaccggtaagaaacgttaacgtttaacgttacgaacttaaactaagttaactttaacgtacctaagaacctaagtaatacgtaataccgttcctaccggtacttccgtacgggtttacggaaccggggtaacgtaaaccggtagggttacggaatacgagaaaccggactaaggttcgcggtaactccgacgttaacc

SEQ ID NO: 11898 - DNA, 915 bp, Homo sapiens
  misc_feature: GYAE6OF01C16M3.52.2.A02.1.454.CMB.1.raw
tcagcgcagtacgacacgaccggtgctcgatttagactcatctacagggggggagtcagtcccaaccaggacacagcatggacatgagggtccctgctcagctccgtggggctcctgctgctctggctctcgaggtcgaccagtatgtatcatccagactcggacctagtcctacctactccctccgtgtacctgactatctagtaggacgaactaagactacacctatccgtacgtcggaccggtacgacgtacgaaggtaactaagttaactagtagttactagttagtaagttaggtactacgaagaaccgtaaacggaaaccggaacgggaaaccctacccctaaaccgtcctacgtacctaccgtaacgagtactactacgttaaccgttaacggttaaccggggaaaccgtaccgggtaacctacgtaaacggttacggttacgtaaggtacgggtacgtacggtaccggtacggtacgggtaactttaacgttttaccttttaaccgtaaccctacgtaaccggttacccggtaaccgtaacggtttacccgacgggtaacccgtaaccggttaaaccggtaagggtttaaaccgtaagggtttaaacccgttaacggttaaaaaccctaaacgttttaaccgttttaaaggtaccccgtttaaaggttaaacccgttaaaccgttaaagttaaccggtttaaaccggtaacctttaacccggttcccccgttaaccggttacccgtttaaacccggggtttaccggggtttaaacccggggacccggggttaaaaccggggtaacgggttaaaccgggaagggttaaacccggttaacttaacccgggtaaggtacccggtttaaaccgggtggtaacccgggtactacccgtaacggttaaccccg

SEQ ID NO: 11899 - DNA, 625 bp, Homo sapiens
  misc_feature: GYAE6OF01EPOJK.52.2.A02.1.454.CMB.1.raw
  modified_base (228)..(228): a, c, t, g, unknown or other
  misc_feature (228)..(228): n is a, c, g, or t
  modified_base (620)..(620): a, c, t, g, unknown or other
  misc_feature (620)..(620): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtcgccagatgtatcatccagatcgacccagtcctccactcctcctgtctgctatctagtaggagacagaactcaacgatccacgttcggccgggnagtcaggactaacttaacagtagtatctagtaagttgtatcacgacaacgaaaaccgacgggaaaccaccccttaaactccgtagtactcctacgatcactactacgtaacgttacggaacgtacgggtacctagtacgtaagtcgtaaggtaggaagtcggtactcgggtaggtacttaagttacgttttacctaccaacgttagtcccgacacgtacgtcgacgtaccggtactaacgtaacgttaatacgttacgaaccgttaaactatttaacgtttacgtaactaactaaactaggttaactagtaacttacctccttacccgtactacggtacctacgggtacgggaacgtacgaggtagactagacgtaagaccgagtgagcgtngtacc

SEQ ID NO: 11900 - DNA, 728 bp, Homo sapiens
  misc_feature: GYAE6OF01E33DK.52.2.A02.1.454.CMB.1.raw
  modified_base (488)..(488): a, c, t, g, unknown or other
  misc_feature (488)..(488): n is a, c, g, or t
  modified_base (501)..(501): a, c, t, g, unknown or other
  misc_feature (501)..(501): n is a, c, g, or t
  modified_base (608)..(608): a, c, t, g, unknown or other
  misc_feature (608)..(608): n is a, c, g, or t
tcagcgcagtacgacacgaccggtgctcgatttagactcatctacaggggggagtcagtcccaaccaggacacagcatggacatggagggtccctgctcagctccgtggggctcctgctgctctggctctcgaggtgcagatgtatcatccagatcgacccagtcctccactccctcctgtcctgactatacgtagtacggagacaagactacaccatccgtaccgttcggcccgggagtacggtacgaacgtaacttaacttaacagttatacgttacgtaggtaagttcggacacgacgaacgaaaccggaaaccggaaccggaaaccctaccctaacgtctacgtactaccgtagtcacgtacttaaccttaacggttaacggaaacggtaccgggtacgtacctaacgtaacggttaggtagtaacggggtatgggtcctacggtagtaggtaaactttgttttaaccttacccgacaacgtcncccgtaacgtacnccgtagccttaacgacggtaataaacgttcgtaccgtaaacaactttaaacgttacgttaccgtacgttaacgtaacgtaaccgtttaaatacggtacctttaaacnccccgttacccgtaccttaccggttaaaccgggttccgggaacgggtaacggaaccggtaaggtacgaagtaccgttaacacgggtaacgtccgtaagtccggacgcttagtcccgtaac

SEQ ID NO: 11901 - DNA, 702 bp, Homo sapiens
  misc_feature: GYAE6OF01C337A.52.2.A02.1.454.CMB.1.raw
  modified_base (198)..(198): a, c, t, g, unknown or other
  misc_feature (198)..(198): n is a, c, g, or t
  modified_base (254)..(254): a, c, t, g, unknown or other
  misc_feature (254)..(254): n is a, c, g, or t
tcagcgcagtacgacacgaccggtgctcgatttagactcatctacgagggggagtcagtcccaaccaggacacagcatggacatgagggtccctgctcagctccgtggggctcctgctgctctggctctcaggtgccagatgtatcactccagatcgaccagtctccactcccttcctgtactgctagtctagagganacgagatccacctatcctacgttcggccggacgacgtacgaggtactaattaaacngttagtacgtcgttaaggtaagtttacggtactacgtacggaacgtaaaccggaaaccggaaacgggtaaaccctaccccttaaacgtccgtacgtaacctccgtacgtatcgtaccgtaacttaccgttaagtaaccggtaaaccggtcggtacctagtaacgtaacggttcaaggtacggtagtcggacgttcggtacggacgtttaacgtttacttttacctactaccgtacgtaccgtaccgtacgtacgtcgtacgtacgtacgtaagtaacgtactagtactaacgtaacgtaacttaacgttacgtacgtaacgtaacgtacgttagtacgtaactacgtcccgtaccgtaccttacgtaccggttacgggaccggtacggtaacggacggtttagacggtacgacgaacgtacgtacgtacggtacgtacgcgtcgtacg

SEQ ID NO: 11902 - DNA, 639 bp, Homo sapiens
  misc_feature: GYAE6OF01DZE5K.52.2.A02.1.454.CMB.1.raw
  modified_base (233)..(233): a, c, t, g, unknown or other
  misc_feature (233)..(233): n is a, c, g, or t
  modified_base (261)..(261): a, c, t, g, unknown or other
  misc_feature (261)..(261): n is a, c, g, or t
  modified_base (503)..(503): a, c, t, g, unknown or other
  misc_feature (503)..(503): n is a, c, g, or t
tcagcgcagtacgacacgaccggtgctcgatttagactcatctacgagggggggagtcagtcccaaccaggacacagcatggacatgagggtccctgctcagctccgtggggctcctgctgctctggctctcaggtgccagatgtatcatccagatcgaccctagtctccactccctccctgtctgctatctagtaggagacagactccaaccatcctacgttcggaccgggngacgtacgagactattaacattgtactntagtaattggtatcagacaagaaaccgaaggaaacctaccccttaaactccgtagtacctcctacgatcgactactaccgttaagttaacggaacgtcgggtaccagttacgtaagtacgaggtaggagtcggcgtaggtacggaactagtttaccgttttactaccgactacgtccgaccgtagtacgtcgactacgtactaggtaatgtacgttacgaactaatattcttaactacgtanaacgttatacgtagtaacttaccgttctaccccttacgtacccgttaccgggttacgggaccggaacggtaccgtaagggtacggtagaccggttaacgacgtaacgtcggtacggttagaccgtgacccgtaccg

SEQ ID NO: 11903 - DNA, 684 bp, Homo sapiens
  misc_feature: GYAE6OF01C8SAW.52.2.A02.1.454.CMB.1.raw
  modified_base (136)..(136): a, c, t, g, unknown or other
  misc_feature (136)..(136): n is a, c, g, or t
  modified_base (204)..(204): a, c, t, g, unknown or other
  misc_feature (204)..(204): n is a, c, g, or t
  modified_base (662)..(662): a, c, t, g, unknown or other
  misc_feature (662)..(662): n is a, c, g, or t
tcagcgcagtacgacacgaccggtgctcgatttagactcatctacaggggggagtcagtcccaaccaggacacagcatggacatgagggtccctgctcagctccgtggggctcctgctgctctggctctcgaggtnccagatgtatcatccagactcgacccagtcctaccacttccctccctgtcctgactatctagtagganacaagaactcaccatcacgttcggccgggctaggacgaaggtactaattaacagttagttactagttaggtaatttcgggtataccgagacgaacggaaaccggaacgggaaacccgtaccctaaacgttcctacgtacctccgtacggtactacgtcctaacgtaccctaaggttacggaaaccgtacggggtacccaagttaccggtaaggttaccgaaggtacggtaacggtcggcgttacggacggtacttaaggttacttttaccgtacaacgtacgaccgtacgtacgacttcgacgtaccgtacgtagtaacgtatacgttacaactacttagttacttacgtacgaacgtaacgtattactacggttaacttacctcccgttacacccgttaccggttcggtacccggacgggacgttaaccggaggtacggatacggacgagtaccggngtacggttacgctgccgtaacg

SEQ ID NO: 11904 - DNA, 856 bp, Homo sapiens
  misc_feature: GYAE6OF01A57P1.52.2.A02.1.454.CMB.1.raw
tcagcgcagtacgacacgaccggtgctcgatttagactcatctacagggggggagtcagtcccaaccaggacacagcatggacatgagggtcccctgctcagctcctggggctcctgctgctctggctctcgaggtgccagatgtatcatccagatcgacccagtcctccactccctcccttgtctcgctactacgtagtaaggagacacgaactaccaccattacctaccgtcggacccgggacgtacggtacgacggtaacctaagttaacctattacggttattacgtagttaagtttaggtaataccgagtacgaaaccggaaaccggaacgggtaaaacccgtacccccgtaaccttaccgtcggtaccctaccgtactacggttacgaccttaacttaaccgttaaacgggtttaacgggtaaaccgggtaacccggggtttaacctaaacggttaaccggttaacgggttaacggtaacggggttagggtaacgggtacgggttaccggttaacgggtaacggtagtttaacggttttaaccttttaaccgttacccaccggtctacccggtaccgaagttaccccacggtacccgtaaggtaaccttaaggtaacgtactttaacgtccgaaaacttacgtttactaaccgtttctaaacggtacgtaaccttaaagggtcttaaaccttaccgtttaaccgtccgttaaccccgttccttaaccgggttccgggtaaaccggggacggggaacccgggttacggggtaaggtaaccggagtaaccggccgtaaaacgggacgtttaaccgggcgggttaaccctccgggttccgaaaccttacccgg

SEQ ID NO: 11905 - DNA, 742 bp, Homo sapiens
  misc_feature: GYAE6OF01B8HG6.52.2.A02.1.454.CMB.1.raw
  modified_base (181)..(181): a, c, t, g, unknown or other
  misc_feature (181)..(181): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (203)..(203): a, c, t, g, unknown or other
  misc_feature (203)..(203): n is a, c, g, or t
  modified_base (208)..(208): a, c, t, g, unknown or other
  misc_feature (208)..(208): n is a, c, g, or t
  modified_base (702)..(702): a, c, t, g, unknown or other
  misc_feature (702)..(702): n is a, c, g, or t
tcagcgcagtacgacacgaccggtgctcgatttagactcatctacaggggggagtcagtcccaaccaggacacagcatggacatgaggtccctgctcagctccgtggggctcctgctgctctggctctcaggtcgccagatgtatcactcagatcgacctagtctccactcctcctgtctnacnctactagagganacgananccacntacacgtcggcggcgagtacgaggtaactaacgttaacagttcgtacttacgttaggtaaagtttggttacacggacgaaccgaaacgggaaaaccggacgggtaaaacccctaccccgtttaaaacgtcctaacgtaccggttacctacggtactacgacctaacgttaccgttaaaggttaacgggaaaccggtacgggttacctaaacgttaccggtaaacggtttccgaaggggttacggttaacggtacgggttccccgttaagggtacgggaaacttttacgttttactttaccggttacaccgtacgttccgaccgtagtaacgccgtacgtaaccgtcggaactaaacgttcgttaaccgtacaaacggttaaattaccgtttaactttaagtaacctaacgtaaccgttagtacgttacctaactaacccgtcccgttactaccgttacggtcgtacggggcggaaccgtaggtacggcgtaacncggaccgtaacgaacggtcgtagcgacctcgtaccctacg

SEQ ID NO: 11906 - DNA, 783 bp, Homo sapiens
  misc_feature: GYAE6OF01AW9GQ.52.2.A02.1.454.CMB.1.raw
  modified_base (142)..(142): a, c, t, g, unknown or other
  misc_feature (142)..(142): n is a, c, g, or t
  modified_base (155)..(155): a, c, t, g, unknown or other
  misc_feature (155)..(155): n is a, c, g, or t
  modified_base (766)..(766): a, c, t, g, unknown or other
  misc_feature (766)..(766): n is a, c, g, or t
tcagcgcagtacgacacgaccggtgctcgatttagactcatctacagggggggagtcagtcccaaccaggacacagcatggacatgagggtccctgctcagctccgtggggctctgctgctctggctctcgaggtcgccagntgtatcatccagntcgaccctagtcctccactccctcctgtctgctaatctaagtaggagtacaagtaactccacctaatcctaacgttcgggacccgggtagaacggttacgaacgggtaactaacgttaaactaagttcggttaactttaccgtaaggttaaaagtttcgggttaaactccgaaacggaaccgttaaaaccgggaaaaacccggtaaaccgggggtaaaaaccccgtacccccttaaaaaccggttccctaacggtaacccttcccgtaacgtaacggtacgtaacctaacgtacccgttaaagtttaacgggaaaccggttaccgggtaccctagttaacgtaacggttacgtaaggtggtaaacggttcgcggttacgtaagggacttaagtttactttactaccgaacttcgtaccgactaacgtcgtcggaacacgtcgtaaataaaggtatttacgcgaaacttaactactttaacgttacaacgtaacgtaagaatccgtaagttaacctaaccctcgtacctcgtacgttacgggttacggacggtaccgggaatcggggtaatacggaacgtaccgaaaggtacggtaaccgttggtaacccgnggtaccctcttaaacgg

SEQ ID NO: 11907 - DNA, 818 bp, Homo sapiens
  misc_feature: GYAE6OF01DQGL6.52.2.A02.1.454.CMB.1.raw
tcagcgcagtacgacacgaccggtgctcgatttagactcatctacgagggggggagtcagtcccaaccaggacacagcatggacatgacgggtccctgctcagctccgtggggcctcctgctgctgtggctctcgaggtcgccagtattgtatcataccgagtacgtccgaaccctcgtccctaccgtaccttccccgttcccgttgttccgtacgtacctaagttaccgtaaggacgggaacgaacaacgtaaccacccgtaacctacttaccgtaaccggtccggggcccgggtaggtacggtacgaacggtaactaacttaacagttacgttatacgtagttaagttcgaactacgaacgaaccgaaaaccggaaacgggtaaaccggtaaaccccgttacccctaatccgtacgtacctccgagacgtactactaacgtaacgttaaacggtaaccggaacggtacggtcctaagttacggtaggtagaggtacggagtcgacgtcggacggtttaacttaacgtttactttaccgacccgtactccggtaccgtaccgtaacgtccgtacgaccggttaccgtaaggttaacgtaacggttaatttaaccggtaaacaaaccgtttaaatttaaccgtttacgttaacggtaaccgtaacttaacgggttaattacggttaaccgttacttacccggttaccccttacgtacggttacccggttaccggggtacggaaccggggtacgtaacggacgggtagaacgtacggtacgaacggttaacgtcgggacgactcccgatacccgttacg

SEQ ID NO: 11908 - DNA, 433 bp, Homo sapiens
  misc_feature: GYAE6OF01B8TUC.52.2.A02.1.454.CMB.1.raw
  modified_base (260)..(260): a, c, t, g, unknown or other
  misc_feature (260)..(260): n is a, c, g, or t
  modified_base (300)..(300): a, c, t, g, unknown or other
  misc_feature (300)..(300): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (378)..(433): a, c, t, g, unknown or other
  misc_feature (378)..(433): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtacaacagtatacgataactcctacccgctactacgtttcggcgggaagggaaccaaaggtcgaagactacgagaacgactggnggtctacgcaccattactgttcttacattccctcccgctntacngaactagtaccgagttcgccgttaggacgggcggcgttacgggacgtaacgggtaccncgaaataggctgacgnnnnnnnnnnnnnnnnnnnnnnnnnnnnnnnnnnnnnnnnnnnnnnnnnnnnnnnn

SEQ ID NO: 11909 - DNA, 796 bp, Homo sapiens
  misc_feature: GYAE6OF01C7ZSV.52.2.A02.1.454.CMB.1.raw
  modified_base (195)..(195): a, c, t, g, unknown or other
  misc_feature (195)..(195): n is a, c, g, or t
  modified_base (546)..(546): a, c, t, g, unknown or other
  misc_feature (546)..(546): n is a, c, g, or t
  modified_base (745)..(745): a, c, t, g, unknown or other
  misc_feature (745)..(745): n is a, c, g, or t
  modified_base (787)..(787): a, c, t, g, unknown or other
  misc_feature (787)..(787): n is a, c, g, or t
tcagcgcagtacgacacgaccggtgctcgatttagactcatctacgagggggggagtcacgtcccaaccaggacacagcatggacatggaggtccctgctcagcctccgtgggcctctgctgctcgtggcctcgtcgagggtcaccagtagtgtactcctaacgtccgagtactccgacccgtacgtcctacccnccttcccgtccttggtcctacgtactacgttgtaagaagggaacgacaaacgtactaccaaccgtacttcggtaccggtcggggaccgggtacgtaccggtaacgaacgtaattaaccttaagtacggttacgttatacggttaaggttagttacgtaacgtaccgaaggaaccgaaaccggtaaaaccgggaacccggtaaacccctaaccccgtttaaacctccgtaaccgtaccttccgaacggtactaccgtacctaaagttacggttaaacggtaaccgggtaaccggtaccgtacgtagtaacggttaggtacgtaggtagtacggtccgaggttcgtaaacgtntttaaccgttatttacctacgaccgtacgtaccgaccagtaccgtcgaacgtacgtaagtagtaaacgttaattccgtaacgaacgtttaattaaccgtagtttaacaccgtagtaacgtagtacgtacttaacgtccccgaccttccggtacgttccgggtaacggggaccggggtagaacgttacgggaccggttanaacggttcggccgtagttaccggcggttacctaggacccgtntcggttacc

SEQ ID NO: 11910 - DNA, 853 bp, Homo sapiens
  misc_feature: GYAE6OF01BAVLY.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggcctctgaggtgccagatgtatcatccagatcgacccagtcctccactcccttccctgtctcgctatacgtaagtaggagtaaccaagaactccaacctatccgaccgttcggccggggactaggtaccgaacggaacttaaacgttaacctagttacgttaacgttacgtaaggttaacgtttacgggtaactaccgtaacggaaccgtaaaccggaaaacccggtaaacggggtaaaacccctaacccccttaaaccgtccgtacgtaccgttccgtacgtactcgacctacttaaccgttaaaggttaaccgggaaaccggtaccgggtacctaacgttacgtaacggttacggaaggttacgggacggtcggtcggttaacggtacggtaacgttaacgttttaaccgtttttaccttacccgtaactacgtacccgtaacgggacgttacggtccgtagacccggtaccggtaacgttaacgaacgtaaccttacggttaacgaaccttaacgttaactttaaccgttaacgtaacgttaaactaaacggtacgtttagtaaccgggttaacttacccggttaccccgtaccgttaccgttaccggggtttacccggggtacggggggaaacccggggttacggaaaggggtttaccggaactaaccggttaccgtaacggtacccgggttagttaccgggcttaccgtcggaacccgttacgg

SEQ ID NO: 11911 - DNA, 692 bp, Homo sapiens
  misc_feature: GYAE6OF01C0GUO.52.2.A02.1.454.CMB.1.raw
  modified_base (101)..(101): a, c, t, g, unknown or other
  misc_feature (101)..(101): n is a, c, g, or t
  modified_base (189)..(189): a, c, t, g, unknown or other
  misc_feature (189)..(189): n is a, c, g, or t
  modified_base (213)..(213): a, c, t, g, unknown or other
  misc_feature (213)..(213): n is a, c, g, or t
  modified_base (259)..(259): a, c, t, g, unknown or other
  misc_feature (259)..(259): n is a, c, g, or t
  modified_base (496)..(496): a, c, t, g, unknown or other
  misc_feature (496)..(496): n is a, c, g, or t
  modified_base (659)..(659): a, c, t, g, unknown or other
  misc_feature (659)..(659): n is a, c, g, or t
  modified_base (665)..(665): a, c, t, g, unknown or other
  misc_feature (665)..(665): n is a, c, g, or t
  modified_base (673)..(673): a, c, t, g, unknown or other
  misc_feature (673)..(673): n is a, c, g, or t
  modified_base (686)..(686): a, c, t, g, unknown or other
  misc_feature (686)..(686): n is a, c, g, or t
tcagcgcagtacgacacgaccggtgctcgatttagactcatctacgagggggggagtcagtcccaaccaggacacagcatggacatgagggtccctgctcngctccgtggggctcctgctcgctctggctctcgaggtgccagatgtatcatccaggatcgacccagtcctccatccctccctgtactnacatcgtagacggagaacagtaancaacctattcacgttcggccgggacagtccaaggcctaattaacgntagtatattaggtaagttggatacgacgaccgaaggaaaaccgaagggaaaactaacccccgtaactaccgtagacgtcctacgagtacactacgttacctaagttaacgggaaaccgtacggggtacctaaagtaccgtaagggttaacagggtagggtaagtcggtacgtacggtagggaacttaacgtttactttttaacgtaccctaacgacgttacccggacctaagtaccncgggaccctagtacccgaagggtaattaattacggtaccaaacgtaactaactttacgttaacggtactttaacgaaacggttaagttaacgtaacgtacttaacccgtccgttaaccctcgttacgtaaccggttaccggacgggaacgtacggaagtacgngaaacnccagaacncgtaggctaagcnggtaac

SEQ ID NO: 11912 - DNA, 839 bp, Homo sapiens
  misc_feature: GYAE6OF01BEM9O.52.2.A02.1.454.CMB.1.raw
  modified_base (244)..(244): a, c, t, g, unknown or other
  misc_feature (244)..(244): n is a, c, g, or t
tcagcgcagtacgacacgaccggtgctcgatttagactcatctacagggggggagtcagtctcagtcaggacacagcatggacatgacgggtccccgctcagctccgtggggctcctgctactctggctccggaggtgccagatgtgtcactccagatcgacccagtcctcctactccctccctcgtccgctactctggtaggagacagtagtcatcatcgtacttcggccgggacagtcgagngactattagtaacgtttaatttaaagttcggtactaacaaacgaacgaaaccggaaggaaaccgtcccctagtaacctaccgtcgtaacttacttagttcggtttaccacttcccgttacttttgaccggttagggtacggttaccggggtaccctaagttaccggtaaacggttccgtaagggtcggaggttaacggtcgggtaacgttacgggtacgggtaaacgtaagttaacgttccctaaccgttccacctaaccctaactacccgtaacctcggttacctacggaccgtacggttccgtaagggttaacggttacgttttaaccgaacccgttttaacccgtttaccgttactttaaccgaaacccgttaacgaacgttttaaaccggttaccccgtttaaccgtttcccccgttaccgtttacccccggtttaccggtaccccggttaaccgggtaaccttaagggttacggttaccgggttaaaattaaacccggttaaaccggaaacccgtttaaccgggttcgggttaaacgggtacccgttacgaaaccccgtttaacggttccttccgtttcccggtttaacc

SEQ ID NO: 11913 - DNA, 749 bp, Homo sapiens
  misc_feature: GYAE6OF01B2G0Q.52.2.A02.1.454.CMB.1.raw
  modified_base (131)..(131): a, c, t, g, unknown or other
  misc_feature (131)..(131): n is a, c, g, or t
  modified_base (154)..(154): a, c, t, g, unknown or other
  misc_feature (154)..(154): n is a, c, g, or t
  modified_base (227)..(227): a, c, t, g, unknown or other
  misc_feature (227)..(227): n is a, c, g, or t
  modified_base (257)..(257): a, c, t, g, unknown or other
  misc_feature (257)..(257): n is a, c, g, or t
  modified_base (668)..(668): a, c, t, g, unknown or other
  misc_feature (668)..(668): n is a, c, g, or t
  modified_base (739)..(739): a, c, t, g, unknown or other
  misc_feature (739)..(739): n is a, c, g, or t
tcagcgcagtacgacacgaccggtgctcgatttagactcatctacgagggggggagtcagtcccaaccaggacacagcatggacatgagggtccctgctcagctccgtggggctcctgctgctctggcctntcgaggtcgccagatgtactcanccagactacgaccctagtcctccaccttccctccctgtactcgactattacaaggaggagaccgaagttaacnccaaccaataccgaacgttcgggacccggngaacgacgaacggtaacttaataacgtatttgtaacttagtagtaagtttacgatacgaacgaacggaaaccggaaaaccggaaccgggttaaaacccaacccgttaaaccgtcgttaccggaaaccttcccgagtactaccaacgtaccgtaaaaccgtttaagggtaaaacggaaccggttaacccggtaacgaaccgtttaacggtaaacggttaggtaaacgggttaggtaacgggtacggtcgtaaaggtacgggtaattaaccggtttactttaccgttacgaacctcgtaccgtactacgtacgttaccgactaacggaaccgtaaggtaactactaagtacactaaactacgttaattaccggattaaccgtaaatagtacaagtaacctcctacctaccgtntaccgtacggttcgggaaaccgtaaggtacgaggtacaagtccaacggaagtacggtactaggaccgacgnccgttaaacg

SEQ ID NO: 11914 - DNA, 752 bp, Homo sapiens
  misc_feature: GYAE6OF01EFH6U.52.2.A02.1.454.CMB.1.raw
  modified_base (280)..(280): a, c, t, g, unknown or other
  misc_feature (280)..(280): n is a, c, g, or t
  modified_base (342)..(342): a, c, t, g, unknown or other
  misc_feature (342)..(342): n is a, c, g, or t
tcagcgcagtacgacacgaccggtgctcgatttagactcatctacagggggggagtcagtcccaaccaggacacagcatggacatgagggtccctgctcagctcctgggggctcctgctgctctggctctcgaggtcgccagatgtatcatccagactcgacccagtctccactccctcctgtctgctatcgtagtaggagacagtaactaccactactctacgttcgggccgggcgtacgtacgaagactaattacatagtatcgtagtaagttggtanacagacgaacggaaaccgaacgggaacctaccccttaactccgtacgtaccttccgtagtanacgtacaacgttaccgttaaagttaacgggaacggtaccgggtacctagtaacggaacggttaggagggtaggtaacggttcgggtcgtaggtaacgggtaaacttagtttacttttaccgttaccgaaccgtacgtacctccgtaaggtccgtacacggtacgtctaaggaagttactaacgttacgaacttaactaatttacgtttactacgtaacgtaaacgttagtaacgttagttaaccttaaccttccccgttaaccccggtttacgtacccggtttccggggtttaaaccggggaccgggggttaaacggggtaaccggttagggggtaacggttaaccggttacaacgggggttaaacggtaacggttaacggttcgggtaggtacctagggtccctaaccg

SEQ ID NO: 11915 - DNA, 810 bp, Homo sapiens
  misc_feature: GYAE6OF01D6WV1.52.2.A02.1.454.CMB.1.raw
  modified_base (799)..(799): a, c, t, g, unknown or other
  misc_feature (799)..(799): n is a, c, g, or t
tcagcgcagtacgacacgaccggtgctcgatttagactcatctacaaggggaaaggggggctgggggtctcaggaggcagcgctcgtcggggacgtcctccaccatggcctgggctctgcttattcctcaccctctcactcagggcacagggtcctgggccagtctcgccctgactcgacgccttcgtcccgttccggtgtacgttcggggtccttccgtggaactagttcgacttccaactattcctacggtcgacacggtacggaaccactacaagtcggttacggtttagtacctttaattaattctcgttcctccgtacggtaccaaaccgaaccgtaacccggacctaaaccgtaccccaaaactttcgactagtacgttcgtttacggaggttacctaagtcggtacgtcccgggtaccggacggtttacggggtttcctaacgtcgtccggttaccctttccggtccgggtacccttacggacgtcgttacggacctcgaccggtccggtccctaacgtcgtaactcgtcgttcggtccgggctaacggtcggcgtacggacgggtaacgtacggtactttaggttaactttgttaccgtaataccggtacgtacctactaaacgtaaccgtaaacctaaacggtaaccgttaacgttaacgggtttggtaacggttcccgggaggggtaaccggtaccggtacgtaccgttcggtaacccgtaacgggtttcaccgtaacggggtaaccggttcccggttaaccccgcccggtttaccccggttacccgtnttacccccggg

SEQ ID NO: 11916 - DNA, 547 bp, Homo sapiens
  misc_feature: GYAE6OF02HW2PT.52.2.A02.1.454.CMB.1.raw
  modified_base (423)..(423): a, c, t, g, unknown or other
  misc_feature (423)..(423): n is a, c, g, or t
  modified_base (462)..(462): a, c, t, g, unknown or other
  misc_feature (462)..(462): n is a, c, g, or t
tcagcgcagtacgacacgaccggtgctcgatttagactcatctacagggggaggtcgagtcccaaccaggacacagcatggacatgagggtccctgctcagctcctggggctcctgctgctctggctctcaggtgccagatgtatcatccagatgacccagtctcccatcctccctgtctgcatctataggagacagaatcaccatcacttgccgggcgagtcgagacattagcatgtatctgaattggtatcagacaaaaaccagggacagtcccctaaaactcctgatcctcgaatgcatccctaacgtttggaaaacgcggggtacccataccaaaggttcaggtggaaggtggctcgtgggacagtatttttaacctttcacatcagcaggctgcagcctagaagtattatgaccaaanatattactgtacaacgatatacgattacgtctacccgtntccgtacgttttcggggaccgggggaaccgtaagggtcggaaggtaataccggaaagccgtaaaccgttggtcggtactggaccc

SEQ ID NO: 11917 - DNA, 315 bp, Homo sapiens
  misc_feature: GYAE6OF02GE4V2.52.2.A02.1.454.CMB.1.raw
  modified_base (313)..(315): a, c, t, g, unknown or other
  misc_feature (313)..(315): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgcatctgatatacgatcgctgagcgggctggcaaggcgcatagnnn

SEQ ID NO: 11918 - DNA, 319 bp, Homo sapiens
  misc_feature: GYAE6OF02GIINW.52.2.A02.1.454.CMB.1.raw
  modified_base (313)..(319): a, c, t, g, unknown or other
  misc_feature (313)..(319): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatatacgatcgctgagcggctggcaaggcgcatagnnnnnnn

SEQ ID NO: 11919 - DNA, 317 bp, Homo sapiens
  misc_feature: GYAE6OF02G8GJ1.52.2.A02.1.454.CMB.1.raw
  modified_base (314)..(317): a, c, t, g, unknown or other
  misc_feature (314)..(317): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatatacgatcgctgagcgggctggcaaggcgcatagnnnn

SEQ ID NO: 11920 - DNA, 479 bp, Homo sapiens
  misc_feature: GYAE6OF02GYZTV.52.2.A02.1.454.CMB.1.raw
  modified_base (309)..(309): a, c, t, g, unknown or other
  misc_feature (309)..(309): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacngggtccatcaagttcagtggaagtggctctgggacagtattttacttcaccatcgccagactgcagcctgaagatattgcaacatattactgtcaacagtatgaataatctcccgctctactttcggcggagggaccaagggtggagatcagacgaactgtggctgctac

SEQ ID NO: 11921 - DNA, 534 bp, Homo sapiens
  misc_feature: GYAE6OF02I94G1.52.2.A02.1.454.CMB.1.raw
  modified_base (312)..(312): a, c, t, g, unknown or other
  misc_feature (312)..(312): n is a, c, g, or t
  modified_base (390)..(390): a, c, t, g, unknown or other
  misc_feature (390)..(390): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaactcctagactcctcgatgcatccaatttggaaacngggtcccatcaaggttcagtggaagtggctcgtgggacagtatttttacttcaccatcgccagactgcagcctagaanatattgacaaacattattactgtacaaactagttatgtattaactcctcccgacttcacgttttcgggacggaacgggtacccaagggttcggaagtacttcgaacggaccgtaacgttggtacgggccttaggacctaacccg

SEQ ID NO: 11922 - DNA, 473 bp, Homo sapiens
  misc_feature: GYAE6OF02GYTXJ.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaacagggtccatcaaggttcagtgaagtggctctggacagattttactttcaccatcgccagactgcagcctgaagatattgcaacatattactgtcaacagtatgataatctcccgctcactttcggcggagggaccaaggtggagatcagacgaactgtggctgcac

SEQ ID NO: 11923 - DNA, 324 bp, Homo sapiens
  misc_feature: GYAE6OF02HK3WW.52.2.A02.1.454.CMB.1.raw
  modified_base (201)..(201): a, c, t, g, unknown or other
  misc_feature (201)..(201): n is a, c, g, or t
  modified_base (317)..(324): a, c, t, g, unknown or other
  misc_feature (317)..(324): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagccttgaagatattgacaacatattactgtcaacagtatgataatctcccgntcactttcggcggagggaccaaggtggagatcagacgaactgtggctgcaccatctgtcttcatcttcccgccatctgatatacgatcgctgagcgggctggcaaggcgcataggnnnnnnnn

SEQ ID NO: 11924 - DNA, 526 bp, Homo sapiens
  misc_feature: GYAE6OF02GXQV8.52.2.A02.1.454.CMB.1.raw
  modified_base (310)..(310): a, c, t, g, unknown or other
  misc_feature (310)..(310): n is a, c, g, or t
  modified_base (398)..(398): a, c, t, g, unknown or other
  misc_feature (398)..(398): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaagcccctaaaactcctgatcctcgatgcatccaatttggaaacngggtcccatcaaggttcagtggaagtggctcgtgggacagtattttacttcaccatcgccagactgcagcctagaagatattgacaanatattactgtacaactagtatagaataatcctacccgcttacctacgtttcgggacggtagggaaccgtaagggtaggacgtaagttacgaaggaacgtaacgttggtacgggcctaggcctaacccg

SEQ ID NO: 11925 - DNA, 483 bp, Homo sapiens
  misc_feature: GYAE6OF02HYAAC.52.2.A02.1.454.CMB.1.raw
  modified_base (410)..(410): a, c, t, g, unknown or other
  misc_feature (410)..(410): n is a, c, g, or t
  modified_base (427)..(427): a, c, t, g, unknown or other
  misc_feature (427)..(427): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaagcccctaaactcctgatcctcgatgcatccaattggaaacagggtcccatcaaggttcagtggaagtggctctgggacagtattttacttcactatcgcagactgcagcctgaagatattgacaactatattactgtacaaacngtatgataatctcccgntcactttcggcggaggaccaaggtgagactacgagacgaactggtggctgactacc

SEQ ID NO: 11926 - DNA, 466 bp, Homo sapiens
  misc_feature: GYAE6OF02IB8HZ.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccaggaaagcccctaaactcctgatcctcgatgcatccaatttggaacagggtccatcaagttcagtgaagtggctctggacagattttactttcacatcgcagactgcagcctagaagatattgcaacatattactgtcaacagtatgataatctccgctcactttcgcgagggaccaaggtgagatcagacgactgtggctgcacc

SEQ ID NO: 11927 - DNA, 318 bp, Homo sapiens
  misc_feature: GYAE6OF02FP0UJ.52.2.A02.1.454.CMB.1.raw
  modified_base (314)..(318): a, c, t, g, unknown or other
  misc_feature (314)..(318): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatatacgatcgctgagcgggctggcaaggcgcatagnnnnn

SEQ ID NO: 11928 - DNA, 558 bp, Homo sapiens
  misc_feature: GYAE6OF02I6J30.52.2.A02.1.454.CMB.1.raw
  modified_base (347)..(347): a, c, t, g, unknown or other
  misc_feature (347)..(347): n is a, c, g, or t
  modified_base (365)..(365): a, c, t, g, unknown or other
  misc_feature (365)..(365): n is a, c, g, or t
  modified_base (370)..(370): a, c, t, g, unknown or other
  misc_feature (370)..(370): n is a, c, g, or t
tcagcgcagtacgacacgaccggtgctcgatttagactcatctacagggggagtcagtcccaaccaggacacagcatggacatgagggtccctgctcagctcctgggctcctgctgctctggctctcaggtgccagatgtatcatccagatgacccagtctccatcctccctgtctgcatctataggagacagaatcaccatcacttgccgggcagtcaggacattaacatgtaatctgaattggtatcagacagaaaccagggaaacgacccctaaatcctagactcctcgatgacatccaatttggaaacagggtccatcgaaggttcagtggaagtggactcgnggacagtattttacctanacctntccgcaagtactgcagccttagaagtatattacgactaaactattacttactagtaccaaactaggttaatacggtaataacgttcctacccgtacttacgtaaccgtttcgggacgggtaacggaacccgtaagggtcggaagtacgtacgaagaccggtaattcgggtaggaccttagcctaaccg

SEQ ID NO: 11929 - DNA, 744 bp, Homo sapiens
  misc_feature: GYAE6OF02JD3V4.52.2.A02.1.454.CMB.1.raw
  modified_base (189)..(189): a, c, t, g, unknown or other
  misc_feature (189)..(189): n is a, c, g, or t
tcagcgcagtacgacacgaccggtgctcgatttagactcatctacagggggagtcagtcccaaccaggacacagcatggacatgagggtccctgctcagctccgtgggctcctgctgctctggctctcaggtgccagatgtatcatccagatgacccagtctccatcctcctgtctgcatctatagganacagaatcaccatcacttgccggcagtcaggacattaacatgtatctgtaattggtaatcagcaagaaaccgagggaaacaccccgtaaactcctagaactcctacgatcgactactacctaaagttttacggaaaaccgtcggggttaccccaagttaccgtaaaacgggttttccgaaacgggtttagggaaaaggttcggggtaaccttccggttagggggaaactaagggtttaactttttttaccgtttaactaacccgtaacgtttaccggaccctaaacgggtaaccttcggacccttaaaggcccgttaggaaaacggtactttaaacggtttcggaacctaaacgtacgtttaaactttaaccgtaggtaacctaaacgtaagttattacgtaaatttaaccgttcctaccccgttattacccgtaacgttttccggggaacgggtaacgggtaaccccgtaaaggggttaccgaaggtaacctaccggtaacggtaaccggtaaaccgttttgggtaacgggtacccttaggaccctaaacccgg

SEQ ID NO: 11930 - DNA, 318 bp, Homo sapiens
  misc_feature: GYAE6OF02HJTX4.52.2.A02.1.454.CMB.1.raw
  modified_base (313)..(318): a, c, t, g, unknown or other
  misc_feature (313)..(318): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatatacgatcgctgagcggctggcaaggcgcatagnnnnnn

SEQ ID NO: 11931 - DNA, 533 bp, Homo sapiens
  misc_feature: GYAE6OF02ITQGX.52.2.A02.1.454.CMB.1.raw
  modified_base (452)..(452): a, c, t, g, unknown or other
  misc_feature (452)..(452): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcgagacattagcatgtatctgaattggtatcagacaaaaaccagggacagcccctaaactcctgatcctcgatcgcatcctactttaggaaacaggggtcccatacaaggttcaggtggaagtggctcgtggactagtacttttacttacacctatcgagcaggtctagcacgcctagaacgtactattgacaactatattactgtacaactagtatagattacgtctcccgntcctacgtttcggggaccggggaaccgtaagggtggaagagtaccgtaaggaccgtaaagttggtacggtcgtacgacccg

SEQ ID NO: 11932 - DNA, 507 bp, Homo sapiens
  misc_feature: GYAE6OF02GJHSP.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaacgcccctaaactcctagactcctcgatgcatccaatttggaaacagggtcccatcaaggttcagtggaagtgctcgtgggacagtattttacttcacctatcgcagactgcagcctagaagatattgactaactatattactagtacaactagtatagattaactcctacccgtctactactttcgggacggacgggaccaagggtgagatacgagacgaagtggtaggctcgactaccg

SEQ ID NO: 11933 - DNA, 502 bp, Homo sapiens
  misc_feature: GYAE6OF02GN2QE.52.2.A02.1.454.CMB.1.raw
  modified_base (308)..(308): a, c, t, g, unknown or other
  misc_feature (308)..(308): n is a, c, g, or t
  modified_base (388)..(388): a, c, t, g, unknown or other
  misc_feature (388)..(388): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaagccccctaaatcctgatcctcgatgcatccaatttggaaacngggtcccatcaaggttcagtggaagtggctcgtgggacagtattttactttcacctatcgccagactgcagcctagaagntagttgacaatatattactgtcaactagtaatgaataatcctcccgctactacgtttcggcggaggaccaagggtcggagtactacgagaccgtactggtaggctcgactaacc

SEQ ID NO: 11934 - DNA, 787 bp, Homo sapiens
  misc_feature: GYAE6OF02FWODZ.52.2.A02.1.454.CMB.1.raw
tcagcgcagtacgacacgaccggtgctcgatttagactcatctacgaggggggagtcagtcccaaccaggacacagcatggacatgagggtccctgctcagctccctgggctcctgctgctctggctctcaggtcgccagatgtatcatccagatgacccagtctccatccctcctgtctgcatctataggagacagaatcaccatcacttgccggcagtcaggtacattaacatgtatctgaattggtactcagtcaagaaaccagggaaacgacccctaaaactccgtagacttccgtaccgatcggactaacttaccgaaagttttacgggaaaacctcgggggtacccctaagttaccgtaaacgggtttaccaagggttagggaaaggttacggaccgttacgtacgggggaaccttaagggttaactttttttaaccctttaccgaacccgttaacggtttcccggaaccccgtaaagggtacccttacggaccgaacgggttacccgtaggtaaacggttaacttttaagtttacgggaaccttaaaacgtaatttaaacgtttaacctttagggttaacctaaaccgttaaggttaacgttacggttaaactttaaacggtttcccgttaccccgttaccggtttacccgtaaccggtttttaccggggaccggggttaaccggggtaacccgtaaaggggttacgggtaacgtaccgttaacgacggtaaccggtaaccgttcgggttaccggtaccgttacgtacccgtaaccccgg

SEQ ID NO: 11935 - DNA, 684 bp, Homo sapiens
  misc_feature: GYAE6OF02IGDGE.52.2.A02.1.454.CMB.1.raw
  modified_base (190)..(190): a, c, t, g, unknown or other
  misc_feature (190)..(190): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctatagganacagaatcaccatcacttgccggcagtcaggacattaacatgtatctagaattggtatcagacaagaaaccgagggaaaacgaccccctaaacgtcctgaactcctacgatcgactactccgtaaatttacggaaacgtacggggtaccctaagtacgtaaacggtttcgaaggttagggaaacgttcgggaccgtcgtacggggaacctagggtttaactttttttaacctttactaacctaacgttcccggtacccgaacgggtaacctcggacccgtacgtcccgtaaggtaaacgaattacgtttacggacctaaaaccgttaattaacgtttactacggtactaacgtaagttactagtaattaacgtacctcccggtacttaccgttaccggtttacgggaccgggtaacgggtaacccggtaagggtaggtaacgtacgttacgaacgggtacgtaaacgttggtacggtacctccggactaacccg

SEQ ID NO: 11936 - DNA, 501 bp, Homo sapiens
  misc_feature: GYAE6OF02GW40J.52.2.A02.1.454.CMB.1.raw
  modified_base (310)..(310): a, c, t, g, unknown or other
  misc_feature (310)..(310): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacngggtccatcaagttcagtggaagtggctgtggacagtattttactttcacctatcgccagactgcagcctagaagattattgacaactatattactgtacaactagtatgaataactccttcccgtctactacgtttcggcggagggaccgtaagggtgaagatcgagacgacgtgtcggctggctaaccg

SEQ ID NO: 11937 - DNA, 538 bp, Homo sapiens
  misc_feature: GYAE6OF02GHM98.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaactcctagactcctcgatgcatccaatttggaaactgggtccatcaaggttcagtggaagtggctcgtgggactagtattttacttcacctatcgccagactgcagcctagaatatattgacaactattattactgtacaacagttatagtaataagtcctacccgtcttacctacgtttcggacgggtacgggaaccgtaagggtcggaagtaacgtacgaaggtaccgtaacggttggtacgggcttacgacctaaccg

SEQ ID NO: 11938 - DNA, 558 bp, Homo sapiens
  misc_feature: GYAE6OF02HD1GA.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcaagaaaccagggaaacgacccctaaactcctagactcctacgatgcatcctaagtttcggaaacgacgggtccatacgaaggttcagtcggaagtggctcgtgggactaggtacttttactttcactatcgccaagtactgcagcctagaaagtattagttagacctaaactattaacttactagtaccaaatagttatagaattaactcctacccgtctactacgtttccggagggtacggtaccgaagggttcgaagtactacgaagtaacggtacgttggtacggcgttacgacctaaccg

SEQ ID NO: 11939 - DNA, 541 bp, Homo sapiens
  misc_feature: GYAE6OF02IQPDQ.52.2.A02.1.454.CMB.1.raw
  modified_base (388)..(388): a, c, t, g, unknown or other
  misc_feature (388)..(388): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccgggcagtcaggacattaacatgtatctgaattggtatcagcagaaaccagggaaagcccctaaactcctgatcctcgatgcatccaatttggaaacagggtccatcaaggttcagtggaagtggctgtgggactagtattttactttcacctatccgacagactgctagcctgaagntattgcaacatattactgtacaacagttaactgtaattaactccttacccgcttacctacgttttcgggacgggtaacggggaccctaaaggggtcggaaggtaacgtacgaacggtaacgtaacgttggtacgggcttacggacctaacccg

SEQ ID NO: 11940 - DNA, 656 bp, Homo sapiens
  misc_feature: GYAE6OF02IM46B.52.2.A02.1.454.CMB.1.raw
  modified_base (189)..(189): a, c, t, g, unknown or other
  misc_feature (189)..(189): n is a, c, g, or t
  modified_base (229)..(229): a, c, t, g, unknown or other
  misc_feature (229)..(229): n is a, c, g, or t
  modified_base (504)..(504): a, c, t, g, unknown or other
  misc_feature (504)..(504): n is a, c, g, or t
tcagcgcagtacgacacgaccggtgctcgatttagactcatctacagggggagtcgagtcccaaccaggacacagcatggacatgagggtccctgctcagctcctggggctcctgctgctctggctctcaggtgccagatgtatcatccagatgacccagtctcatcctcctgtctgcatctatagganacagaactcaccatcacttgccgggcagtcagacataacntgtatctgattggtatcagcagaaacaggaaacgccctaaactcctgactacctcgactcgctactacctaagtttacgggaaaactcgggggtaccctaagtaccgtaaaggtttcgaaggttagggtaagtcggtacttacggttggggaacctaggttaacttttttaacgttcctaacctacgttcccgacgtaacgtaaccgtttgacccgtaaggtccctaaggtaaacgtacttagtttacgacctaaactaatttacgttttaaacngttaccgaaactcggttaaatacggttaaactaactttcccgttacccggtctaaccgttaccgtttacgggacggggttaaccggaacggtaagggttacgggaatacggttcaaacggacgtaacgtggtacggtcgtacgccctaaccg

SEQ ID NO: 11941 - DNA, 568 bp, Homo sapiens
  misc_feature: GYAE6OF02JUCXR.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtattcagcagaaaccagggaaacgacccctaaactcctagactcctcgatcgcatcctaatttggaaacaggggtacccatcaagttcagtaggaagtggcgtcgtaggactagtatttactttcgacctagtcgaccagtactcgcacgacctgaagatattagacaactataacttactagtacaagtagttactagtaattactacctcccgtactacgttacgtttacgggacgggtacggtaaccgtaacgggttaggtacggtaagtacgtaacggaacgtaacgttacggttcggtacttacggactaacccgg

SEQ ID NO: 11942 - DNA, 522 bp, Homo sapiens
  misc_feature: GYAE6OF02IB6QW.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcaagaaaccagggaaacacccctaaactcctagaactcctcgatcgcatccaatttaggaaacagggtccatcgaaggttcaggtggaagtggctcgtagggactaggtattttactttcacctatcgacagactgacagcctagaatatattcgacaatatattacagttacaactagtatagtaataactcctcccgcttactacgtttcggacgggtacgggacgaaggtcggagtatacgagacgaactgtcggctcgactaccg

SEQ ID NO: 11943 - DNA, 517 bp, Homo sapiens
  misc_feature: GYAE6OF02HTQYT.52.2.A02.1.454.CMB.1.raw
  modified_base (267)..(267): a, c, t, g, unknown or other
  misc_feature (267)..(267): n is a, c, g, or t
  modified_base (405)..(405): a, c, t, g, unknown or other
  misc_feature (405)..(405): n is a, c, g, or t
  modified_base (437)..(437): a, c, t, g, unknown or other
  misc_feature (437)..(437): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaancccctaaactcctgactcctacgatgcatccaatttggaaacagggtcccatcaagttcagtggaagtgctctggactagtattttacttcacatcgccagactgcagcctagaacgtatattgacaatattattacngtacaaacagttatgaattaactcctacccgntacctacgtttcgggacggtaacgggaccgaagggtagagtagtaccgaagacgtaacgtcgtacggctggacctaaccg

SEQ ID NO: 11944 - DNA, 534 bp, Homo sapiens
  misc_feature: GYAE6OF02IJB0V.52.2.A02.1.454.CMB.1.raw
  modified_base (314)..(314): a, c, t, g, unknown or other
  misc_feature (314)..(314): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcaagaaaccagggaaacgccccctaaactcctagactcctcgatgcatcaatttggaaacngggtccatcaagtcagtgaagtggctcgtgggacagtattttacttcaccatcgccagtactgcagcctggaagtattattgactaactattattactagtacaaactagttatagtataatcctccgcttcacgtttccggacgggtaacgggaccgtaagggtcggagtaacgtacgaaggtaccgtaacgttcggttcgggacttcggacctaaccg

SEQ ID NO: 11945 - DNA, 564 bp, Homo sapiens
  misc_feature: GYAE6OF02H2FK5.52.2.A02.1.454.CMB.1.raw
  modified_base (189)..(189): a, c, t, g, unknown or other
  misc_feature (189)..(189): n is a, c, g, or t
  modified_base (483)..(483): a, c, t, g, unknown or other
  misc_feature (483)..(483): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctcctgtctgcatctatagganacagaatcaccatcacttcgccgggcagtcaggactaattaacatgtatctagtaattggtatcagacaaggaaaccagggaaactacccctaaactccgtagactccctcgatgacatctaaattggaaacgtacgggtaccatacgaaggttcaggtaggtaagtggtactcgtagggactacgttagttttactttcacgtatccggtaccagtactgcgagtccgtagaatattattacgcaaactattacttacattacaacgtagtatagtaataacgttctacccgnttaccgtacgttcggacggtaggaccagggttagacgtgtaacccgtaggaccgtaacgttgtacgggcttagacctaacg

SEQ ID NO: 11946 - DNA, 523 bp, Homo sapiens
  misc_feature: GYAE6OF02GFF3C.52.2.A02.1.454.CMB.1.raw
  modified_base (370)..(370): a, c, t, g, unknown or other
  misc_feature (370)..(370): n is a, c, g, or t
  modified_base (410)..(410): a, c, t, g, unknown or other
  misc_feature (410)..(410): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggcagtcaggacattaacatgtatctgaattggtaatcagcagaaaccagggaaacgcccctaaaactcctagatcctcgaatgcatccaatttggaaacagggtccatcaaggttcagtaggaagtggctcgtgggactaggtattttactttcaccntacgcagactgcagctagaagatattgcaacatacttacngtacaacagttatagtattaatcctacccgtctaccgtacttttcggcggtaacggacccgtaagggtggaagactacgagacgtaacgttagtcggccttaggcctaacccg

SEQ ID NO: 11947 - DNA, 553 bp, Homo sapiens
  misc_feature: GYAE6OF02FQVN3.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgactcctcgatgcatccaatttggaaacaggggtcccatcaaggtttcagtggaagtggctcgtgggactagtattttactttcacctatcgccagactgcagcctagaagattattagacaacattattaactgtacaactagtatgtaataattcctcccgacttcctacgtttccgggacgggtaagggacccgtaaaggggttggaacggtagttaccgaaggtaaccggtaaacgttgggtacggtaccgttacggacctaacccg

SEQ ID NO: 11948 - DNA, 600 bp, Homo sapiens
  misc_feature: GYAE6OF02GAM6V.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaacgcccctaaactcctagactcctgatgcatccaatttggaaacagggtcccaatcaaggttcaggtaggaagtggctcgtgggactagtactttttacttcacctatccgccaggactggccagtcctagaagtattattgacctaaagtattaactttactagtaacaaactagttaactaggtaattaaaccgttccttaccccgtactttaccgtaacgttttccggggaccgggtaagggacccgttaaagggggtcggtaagggtaacttacggaaccgggtaaccgtaacggttagggttacgggtaccgttacggacccaacccgg

SEQ ID NO: 11949 - DNA, 491 bp, Homo sapiens
  misc_feature: GYAE6OF02FT2AH.52.2.A02.1.454.CMB.1.raw
  modified_base (314)..(314): a, c, t, g, unknown or other
  misc_feature (314)..(314): n is a, c, g, or t
  modified_base (408)..(408): a, c, t, g, unknown or other
  misc_feature (408)..(408): n is a, c, g, or t
  modified_base (415)..(415): a, c, t, g, unknown or other
  misc_feature (415)..(415): n is a, c, g, or t
  modified_base (434)..(434): a, c, t, g, unknown or other
  misc_feature (434)..(434): n is a, c, g, or t
  modified_base (464)..(464): a, c, t, g, unknown or other
  misc_feature (464)..(464): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaaactcctagactcctcgatgcatccaatttggaaacngggtccatcaaggttcagtggaagtggctcgtgggacagtattttacttcacatcgccagactgcagcctgaagatattgacaactatattacngtacaanagttatgataatctcccgntctactttcggcgacggacctaaggtgganagtcgagacgaactggtggctgctacg

SEQ ID NO: 11950 - DNA, 571 bp, Homo sapiens
  misc_feature: GYAE6OF02JH3R9.52.2.A02.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (432)..(432): a, c, t, g, unknown or other
  misc_feature (432)..(432): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctatagganacagaatcaccatcacttgccgggnagtcaggacattaacatgtatctgaattggtatcagcaagaaaccaagggaaacgacccctaaactcctagactcctacgatgacataccgtaatttggaaacacggggtaccatacgaaggttacaggtggaagtcggctcgtagggactagtattttacttcacatcgacagactgcagtctagaagtatattgacaactataactttacgtntacaacgtagtatagaacttaacgtccgttacccgtacttaccgtaccgtttaccgggacgggtaaccggggaccgtaaagggtcggaacgtagtacggaacgtaccgtaacgttcgtacgggtactcggacctaaccg

SEQ ID NO: 11951 - DNA, 695 bp, Homo sapiens
  misc_feature: GYAE6OF02I3LPO.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccgggcgagtcaggacattaacatgtatctagaattggtatcagacaaggaaaccagggaaacgtaccccctaaatccctagactcctacgatcgacactaccgtaaagtttagggaaaaccgtcggggtaccccaagtaccgtaaagggttcaggttagggaagtgggacttcggtagggtaactaaggttacttttttaccgtttacaaccgtagttaccggacccgtaagtaccttcgaccgtacggtccgttaaggaagtaattacgtttacgaaccttaaacttaactttaacgtttacctacggttaaccaaacgttagttaagttacgtaaacttaccgttacccgttcccgtacttaccgtaaccggttttccggggaccggggtaaacggggtaacccggtaaggggttacggaacggtacgttaccgaggtaaccggtacgttcggggacgtaccgttaccggacctaacccgg

SEQ ID NO: 11952 - DNA, 560 bp, Homo sapiens
  misc_feature: GYAE6OF02HG746.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgtaattggtatcagcaagaaaccagggaaacgcccctaaactcctagactcctcgatgcatcctaagtttagaaacgagggtcccatacgaagttcagtaggaagtggctcgtggactagtattttacttcacctagtccgactagactgctacgccgtagaagtatagttagactaaactattaattactagtacaacgtagtatagtaataactcctaccgtccttacgtacgtttaccgggacggtaacgggaccgtaagggtacggaagtaacgtacgaggaaccggtaacgtggtacggcgtacggacctaacccg

SEQ ID NO: 11953 - DNA, 482 bp, Homo sapiens
  misc_feature: GYAE6OF02GX4N6.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaagcccctaaactcctgactcctcgatgcatccaatttggaaacaggggtcccatcaagttcagtgaagtgctctgggacagattttactttcaccatcgccagactgcagcctgaagatattgcaacatattactgtcaacagtatgataatctcccgctcactttcggcggaggaccgaaggtggagactcaagacgaactgtggctggctaaccg

SEQ ID NO: 11954 - DNA, 582 bp, Homo sapiens
  misc_feature: GYAE6OF02IEW7G.52.2.A02.1.454.CMB.1.raw
  modified_base (216)..(216): a, c, t, g, unknown or other
  misc_feature (216)..(216): n is a, c, g, or t
  modified_base (467)..(467): a, c, t, g, unknown or other
  misc_feature (467)..(467): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattaacatgtatctgaattggtatcagcaagaaaccaagggaacgacccctaaaactcctagactcctcgatgcatacctaagtttacggaaacgtacggggtacccaatccgtaaggttcaggtgaagtggctcgtaggactagtattttactttcactatcgaccagactgcagcctagagtattattgacaactattatactacgtacaactaagtatagaacttaactcctccccgtntaccgtaccgttttcgggaccgggtaacggggtacccgaaaggggttcggaaggtaacgttaccgaacggtaacggaaacgttgggttacggaccgttacggacccttaacccgg

SEQ ID NO: 11955 - DNA, 545 bp, Homo sapiens
  misc_feature: GYAE6OF02G8MC8.52.2.A02.1.454.CMB.1.raw
  modified_base (215)..(215): a, c, t, g, unknown or other
  misc_feature (215)..(215): n is a, c, g, or t
  modified_base (308)..(308): a, c, t, g, unknown or other
  misc_feature (308)..(308): n is a, c, g, or t
  modified_base (344)..(344): a, c, t, g, unknown or other
  misc_feature (344)..(344): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattaacatgtatctgaattggtatcagcaagaaaccagggaaagcccctaaatcctagactcctcgatgcatccaattggaacngggtccatcaagttcagtgagtgctgtgggacagtnttttacttcacctatcgaccagactgcacgcctagaagtattattgacctaaacgtattaattaccgtgtaccaaacgtagttaatgtaattaactccttacccgcttactacgtttccgggaccggtaacgggtaaccctaagggttggaacgtacgttaccgaaggtaccgaacgttggtacggcgtagaccctaaccg

SEQ ID NO: 11956 - DNA, 729 bp, Homo sapiens
  misc_feature: GYAE6OF02I17SB.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccgggcagtcaggacattaacatgtatctgaattggtatcagtcaagaaaccagggaaacaccccgtaaactcctagactcctacgatgacacttaccgtaaagtttacggaaaacgtacggggtaccccaagttaccgaaagggttttccaaggttagggtaaacggttcgggtaccttacggtagggggtaactaaggttaacgttttttaaccttttaaccaaccgtaacgtaccggtacccgtaacggtaaccttcggtacctaacggtcccgttaaggtaaacggtaagttaacgtttaggaacctaaactaagttaaactttaacttacggtaacaaacgtaagttactaacggtaattaaacgttcccttacccggtacttaccgtaaccgttttccggggaaccgggtacggggtaaacccgtaaaggggttacgggaacggtaaccgttaccgaaacggtaaccggtaaccgtttacggggtacggttacggtaccggacccgtaaacccg

SEQ ID NO: 11957 - DNA, 842 bp, Homo sapiens
  misc_feature: GYAE6OF02G6CYP.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgccgggcgagtcaggacattaacatgtatctgaattggtatcagcaagaaaccagggaaacgacccctaaactcctgactcctacgatcgcacttaccaaatttacgggaaaaccgtacgggggtacccctaagttaccgtaaacggggtttaccgtaagggttaggggtaaacggttcggggtaccgttacggttacgggggtaaaccgtaaagggttttaacctttttttaaacccgttttacccgtaacccgtaacgtttaccccggtaccccgtaaacggtaaccctttacggaacccggtaacggtaccccgttaaagggtaaaccggtaactttaaacgttttacggaacccttaaaaccgttaactttaaacgtttttaaacccgtacgggtttaaccctaaaaaccgttaagggtttaactttaacggtaaaacttttaacctttaaccccgtttaacccccgggttacttaacccggtttaacccggttttccggggacccgggggttaaacgggggtaaccccggttaaagggggttaccgggaaacgggttacttaaccgggtaaacggtaaccggtaaccggttacgggtaccgggtacggttacggacccgtaaacccg

SEQ ID NO: 11958 - DNA, 319 bp, Homo sapiens
  misc_feature: GYAE6OF02FQ5XZ.52.2.A02.1.454.CMB.1.raw
  modified_base (315)..(319): a, c, t, g, unknown or other
  misc_feature (315)..(319): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaactgtggctgcaccatctgtcttcatcttcccgccatctgatatacgatcgctgagcgggctgggcaaggcgcatagnnnnn

SEQ ID NO: 11959 - DNA, 518 bp, Homo sapiens
  misc_feature: GYAE6OF02GQEG7.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaaccagggaaacgcccctaaactcctgactcttcgatgcatccaatttggaaacagggtcccatcaaggttcagtggaagtggctcgtgggactagtattttacttcacatcgccagactgcagcctagaagatattgacaacattattactgtacaacagtatgaataatcctccgctacgtacgtttcgggcggtacgggaccgtaagggtggaagactacgaaggtaacgtaacgttggtacggctaggcctaaccg

SEQ ID NO: 11960 - DNA, 806 bp, Homo sapiens
  misc_feature: GYAE6OF02IPNT0.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcaagaaaccagggaaacgccccctaaaactcctagactcctacgactgacacttacctaaagttttacgggaaaaccgtacgggggtacccaagttaccgaaaggggtttcaagggttgggaaaacggtttcggggacctttaccggtaggggggaacctaagggtttaaactttttttaacccgttttaccaaccccgttaagttaccccgggaccctaaagggtaccttacggacccgtaacggtcccgttagggaaaacgtactttaaacggtttcgaaccctaaaacgttaagttaaacgttttaacctaggttaaaccctaaaacgtaaggtttaacctttaaggtaaactttaaaccttcccccgtttaacccccggtaccttttaacccgttaacccgggtttttacccggggggtaccgggggaaaccgggggttaaacccgtaaaggggggtttaaccgggaaaggttaccttaaccgggtaaacgggtaaacccggttaaccggttcgggttaccggggacctttacgggaacccctaacccgg

SEQ ID NO: 11961 - DNA, 795 bp, Homo sapiens
  misc_feature: GYAE6OF02I4XKP.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccactcctccctgtctgcatctataggagacagaatcaccatcacttggccgggcgagtcgaggaactaattaacatgtatctagaattggtatcgagactaaggaaacccgagggtaaaccgacccctaaactccgtagacttcctacggatcgacactacctaaagtttacggaaacgtacggggtaccctaagtacgtaaacgggtttacgaaggttagggaaacggttggtccgttacggtagggggaaccttaaggttaacttttttaacctttacccgaaccgtaacgttcccggacccttaaaggtacgttaccggctaaccggtacccgttagggaaaacgtattttaacggttacgaaccgaaaaccttaagtttacgtttaaccctagggttaacctaaaaccgtagtttaaagttaagtaaacgtttaaccgttacccgttacccccggtacgtttaaccgtaacccggggttttacccggggaccggggtaacccgggggaaacccgttaaagggggttaccggggtaaacgttaacgttaaccccgggtaaagggttaaccccgggtaaaccggtttgggaaccggggtttacccgttacccggggacccttaaccccg

SEQ ID NO: 11962 - DNA, 667 bp, Homo sapiens
  misc_feature: GYAE6OF02HF1UX.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcgaggacattaacatgtatctgtaattggtatcagcaagaaaccgagggaaacgacccctaaactcctgaactcctacgatcgactactacctaagtttacggaaacgtacggggtacccacgttacgaaacggtttcgaaggttagggtaaaggtcggtacgttcggttaggggaacctaaggtttaacttttttaccttttaccgaacctacgttaccggacccgtaacggtacgttcgaccgacgtaccctaggaaacgtattaacgtttacggaacctaaatacttaactttaactcggtaactaaacgtaagttaatagtaaacttaccgttaccttaccccggtactaccgttaccgtttaccgggacgggtacgggtaacgaagggttacggaggtaactacgaacgtacggtaacttggtcggacgtcggacctaaccg

SEQ ID NO: 11963 - DNA, 533 bp, Homo sapiens
  misc_feature: GYAE6OF02I0LV0.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaactcctagactcctacgatcgcatccaatttaggaaacagggtccatcaaggttcagtggaagtggctctgggacagtattttacttcacctatcgccagactgcagctagaagtactattcgacaacattattactgtacaaacagttatagtaataactcctcccgcttacctacgtttcgggacggtacgggaccgtaagggtcggaagaactacgaaggtaccgtaacgtggtacggcgtacggactaaccg

SEQ ID NO: 11964 - DNA, 613 bp, Homo sapiens
  misc_feature: GYAE6OF02JRVXM.52.2.A02.1.454.CMB.1.raw
  modified_base (317)..(317): a, c, t, g, unknown or other
  misc_feature (317)..(317): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggcgagtcaggacattaacatgtatctgaatttggtatcagcaagaaaccagggaaacgcccctaaactcctagactcctcgatgcatacctaatttaggaaacncgggtaccatacgtaaggttcagtaggaagtggctcgtagggatagtagttttactttcgacctaagtccgaccgagtacgtgacacgtaccgtagaagtatattggacaactattacttactgtactaacaagttactagtaacgttaactaccttacccgtacgttaccgttaccgtttaccggggacgggtaaccgggttaaccggaaacggggttacgggaagtaaccgttaccggaacgttaaaccgggacgtttacgggtacgggtaccgtaccggtacctaaaccccgg

SEQ ID NO: 11965 - DNA, 522 bp, Homo sapiens
  misc_feature: GYAE6OF02FV4PW.52.2.A02.1.454.CMB.1.raw
  modified_base (410)..(410): a, c, t, g, unknown or other
  misc_feature (410)..(410): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaacgcccctaaactcctgactcctcgatcgcatcccaatttcggaaactacggggtaccagtacaaggttcagtaggaagtggctcgtagggacaggtattttactttcacctatcgccagtactgcagcctagaagtatagttnacaactattattactgtactaacagtatagtaatactactcccgtctctacgttcgggcgaacgggacctaaggtacggagtagtcgaggacacgtagtcggctcgctaccg

SEQ ID NO: 11966 - DNA, 523 bp, Homo sapiens
  misc_feature: GYAE6OF02FRX78.52.2.A02.1.454.CMB.1.raw
  modified_base (314)..(314): a, c, t, g, unknown or other
  misc_feature (314)..(314): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagccccctaaaactcctgaactcctcgatgcatccaatttggaaacnggggtcccatcaaggttcagtggaagtggctgtgggacaggtatttttacctttcacctatcgccagactgcagcctaggaagattattgacaaactattaatttactgtacaaactagtatagattacgtcctcccgcttcctaccgtttcgggacgggggtaccagggtggagatacgaagcgtaactggtaggctacggcacctac

SEQ ID NO: 11967 - DNA, 731 bp, Homo sapiens
  misc_feature: GYAE6OF02IEZ2M.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgaccccagtcctccatccctccctgtctgcatctataggagacagaatcaccatcacgttcggccgggcgagtcaggacattaacatgtatctgtaattggtatcagacaagaaaaccgaagggaaacgacccctaaaactcctagactcctacgatcgactactacctaaagttttacggaaaacgtacggggttaccccaagttaccgtaaaggttcgaagggttacgggtaaacgggttgggtaccttacgggtacggggtaactaggtttaacttttttaccgttttccaaaccgttagttacccggtaccctaacgggtaaccgttacggaccgtaacggtacccgttaaggaaacggttaacttaacgtttacgaaccctaaaaccttagtttaaactttaacgtaccggttaactaaaaccgtagttaacgtaagtaacttaacgttacccttccccggtacttccgttaaccgttttccggggaccgggtaacggggaccctaaaggggttcggaacggtaacgttacgaaacggtacggaacgttggtacggtacgtcgaccctaaccg

SEQ ID NO: 11968 - DNA, 679 bp, Homo sapiens
  misc_feature: GYAE6OF02IB3JS.52.2.A02.1.454.CMB.1.raw
  modified_base (237)..(237): a, c, t, g, unknown or other
  misc_feature (237)..(237): n is a, c, g, or t
  modified_base (323)..(323): a, c, t, g, unknown or other
  misc_feature (323)..(323): n is a, c, g, or t
tcagcgcagtacgacacgaccggtgctcgatttagactcatctacagggggagtcaggtcccaaccaggacacagcatggacatgagggtccctgctcagcgtccgtcggggctcctgctgctcgtggctctcaggtcgccaggattcgtatcagtccagtatgacccagtcctccatccctccctgtctcgactactctagtaggagacagaatccgacctatcacgttcgccggngagtcgagggacattaacgataggtatactagtaattggtatcagacaagaaacgacggaacaccctaaagtcctagactcctagntcgctacgtacctaagttacggaaacgtacgggttacaacgttacgtacggttacgagtacggtaagtcggtctacgtaggaactagttacgtttacgtttcgactagtacgacgtacgtctcgacgtacgccgtagaagtacgtagttcgactaacgtacttaacttagaaccgttacgaaacgttagtacgtacgttaaacttaaccgtttaccgttcccgtaacgtttaccgttaaccgggttaccgggtacggggtaaccgggttaaccgtaacgggttaacggttccgtaaacggttaccgaacggtaacccggttaggtacggtttccggaacttaccggtctaaccggg

SEQ ID NO: 11969 - DNA, 725 bp, Homo sapiens
  misc_feature: GYAE6OF02H3IGN.52.2.A02.1.454.CMB.1.raw
  modified_base (215)..(215): a, c, t, g, unknown or other
  misc_feature (215)..(215): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctcctgtctgctatctataggagacagaatcaccatcattcgccgggnagtcaggacattaacatgtatctgtaattggatcagcaagaaaccagggaaacgcccctaaactccgtagactcctcgatcgcaatacctaaagttttacggaaacgacggggttacccaacgtacgtaaacggtttactaggtacgggtaaaggtcgggtaccttacggtggggaacctaagggtttacctttttttaccgtttacctaacccgtaacgttaccgtaccgtaaccggtaaccgttaccggtacgtaacggtacccgttaaggtaaacggtaagtttaacgtttacggtaacctaaaccgtaatttaactttaccgttacgttaactaaaccgtaagttaaccgttaagtaattaacctttaccgtaccccgttccgttaaaaacccgttcgtttacccgggtaccggggtaaccgggtaccgggtaaacgggtacggtaacggtaacgtacgtaacggtaacggtaaccggttaggtcggtacgtcgtacctaacccgg

SEQ ID NO: 11970 - DNA, 535 bp, Homo sapiens
  misc_feature: GYAE6OF02HESS9.52.2.A02.1.454.CMB.1.raw
  modified_base (311)..(311): a, c, t, g, unknown or other
  misc_feature (311)..(311): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcagaaaccagggaaacgcccctaaactcctgactcctcgatgcatccaatttggaaacngggtcccatcgaaggttcaggtggaagtggctcgtgggactagtattttacttacacctatccgacagactgacagcctagaagtatattgactaacattattacagttacaagtagtatagtaattaactccttacccgcttacgtacgtttcgggacggtacgggaccctaagggtcgaagtactacgaagaccgtaacgtggtaggcttaggacctaaccg

SEQ ID NO: 11971 - DNA, 814 bp, Homo sapiens
  misc_feature: GYAE6OF02GT3TS.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacgttgccgggcgagtcaggacattaacatgtatctagtaattggtatcagacaagaaaccgagggaaacgacccctaaactcctagactcctacgatcgactactacctaaagtttacggaaaacgtacggggtacccaagttaccgtaaacgggtttaccgaagggttagggtaaacggttcggtaccgttacggtacgggggtaaaccttaacggtttaacgtttttttaaccgtttacccgtaacccgtacgttacccggtaacccgtaacggtaaccgttacggaccgtaaccggtacccgttaagggtaaaacgtaagtttaacgttacggaaacccttaaaacttaacgtttaaacttttaacctttaccgggttaaacctaaaaaccgttaaaggttttaacgtttaacggttaaacctttaaaccgttaccccgttcccccggtaacctttacccggtttaacccgggtttttaccgggacccggggttaaaccggggtaaccgtaaacgggggtttaacggggaacgttaacgtaacccggtaagggtaacccgttaacgggttagggtacccggtacgttaccggaccctaacccgg

SEQ ID NO: 11972 - DNA, 811 bp, Homo sapiens
  misc_feature: GYAE6OF02IQ3E0.52.2.A02.1.454.CMB.1.raw
  modified_base (142)..(142): a, c, t, g, unknown or other
  misc_feature (142)..(142): n is a, c, g, or t
  modified_base (367)..(367): a, c, t, g, unknown or other
  misc_feature (367)..(367): n is a, c, g, or t
tcagcgcagtacgacacgaccggtgctcgattagactcatctacagggggaggtcgagtcccaaccacggacacagcatggacgatgagggtcccgtcgctcgtcctgggcctccgtggcctcgcgtctgctcgtcagttcncgtaggtctcgtagtctatccagtactacgacctagtacctaccatccctacctcgtccctcgtctacctctacgtacgtacgtacgaacgtacaccgacctactaccgtacgtacgtaccggtaccggtacggaccgtacggtaccgtactaacgtaactacgtagtactacgtacgttacggttaagtacgtacgggacaaggtaacccgaacgggtaaaacnccccggttaaaacgccccttaacgaacgttcctaaggtacctacggtcctacgtaaccgttaagtaaccccggaagtttcggaaaaccctggggttaaccctaagttcgaaagggtttcaacggtcgtacgtacgggtactacgtaaggtttacctagtacccgtttacacgtacctacgtccgaccgtacgtaccgtacggtaccgtaagtacctaaggttaacgtacgttaagttaaccgttacttaaaccgttactaccgttaaactaacggttacgttaactaggttaaaccttaacgttccttaaccgttccgttaaccggtaccgttaccggtacggttaaccgggaccgttaagggttaccggaaggtttacgaacggtaacgttaccgaacggttcggtaaccgtcgttacggtaaccttacggtaccttacccgg

SEQ ID NO: 11973 - DNA, 655 bp, Homo sapiens
  misc_feature: GYAE6OF02IPWM5.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagatcaccatcacttgccgggcagtcaggacattaacatgtatctgaattggtatcagcaagaaaccgagggaaacgacccctaaactcctagagtcctacgatgctaattcctaatttcgggaaactacggggtcccatccgaaaggtttcaggtgggtaaggtcggtcgtcgtagggactaggttactttttactttcgaccctatccgacctagactgacacgtcctaggaacgtattattacgactaaacgtattaactttaacctacgttaacaaacttaagttaactacgttaaattaacttacccgttaccccggtacttaccgttaccgggttttccgggaccggggtaaccggggtaaccccgtaaagggggttacgggtaacgaaccgtttaccggaaacggtaaccggtaaccgttcggttacgggtaccgttccggaacccttaacccg

SEQ ID NO: 11974 - DNA, 603 bp, Homo sapiens
  misc_feature: GYAE6OF02H869R.52.2.A02.1.454.CMB.1.raw
  modified_base (216)..(216): a, c, t, g, unknown or other
  misc_feature (216)..(216): n is a, c, g, or t
  modified_base (293)..(293): a, c, t, g, unknown or other
  misc_feature (293)..(293): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggngagtcaggacaattaacattgtatctgaattggtatcagcaagaaaccagggaaacacccctaaatcctagactccncgatcgcactcctaaagtttacggaaacgacggggtacccatacgtaaggtttacaggtacggtaaggtcggacttcggtagggactaggttaactttttacctttaccacctagttaccgccctaaggtctagtcacgtccgtagtaacgtaattacgttacgaccaaagtactttaattactacgttacaaaccgtagttacgtagtaattaacgttcctcccggtactacgttaccgttcgggacggtacggtaccaaggggtagacgaacgttcgaacggacgtacgtgtacggctacgctaaccg

SEQ ID NO: 11975 - DNA, 404 bp, Homo sapiens
  misc_feature: GYAE6OF02ISY7J.52.2.A02.1.454.CMB.1.raw
  modified_base (198)..(198): a, c, t, g, unknown or other
  misc_feature (198)..(198): n is a, c, g, or t
  modified_base (316)..(316): a, c, t, g, unknown or other
  misc_feature (316)..(316): n is a, c, g, or t
  modified_base (347)..(347): a, c, t, g, unknown or other
  misc_feature (347)..(347): n is a, c, g, or t
  modified_base (356)..(356): a, c, t, g, unknown or other
  misc_feature (356)..(356): n is a, c, g, or t
  modified_base (359)..(362): a, c, t, g, unknown or other
  misc_feature (359)..(362): n is a, c, g, or t
  modified_base (364)..(404): a, c, t, g, unknown or other
  misc_feature (364)..(404): n is a, c, g, or t
tcagcgcagtacgacacgaccggtgctcgatttagactcatctacagggggcacgaccggtgcctcgatttagactcatctacaggggtcccatcaacggttcagtggaagtcggtctctgggacaggattttactttccaccgagtcgcccagtactggcagcctgaagatattggcaaccatacttactgtcaacngtatgataatctcccgctcacgtttcggacggagggaccaagggtcgagatacgagacgaactgtaggctgcaaccatctgtcttcatccttcccgccatctgatacgacgagtccgntggtaggtcgggcgtgggccgaaggggtcanactaacggnagnnnnannnnnnnnnnnnnnnnnnnnnnnnnnnnnnnnnnnnnnnnn

SEQ ID NO: 11976 - DNA, 494 bp, Homo sapiens
  misc_feature: GYAE6OF02GHSO4.52.2.A02.1.454.CMB.1.raw
  modified_base (415)..(415): a, c, t, g, unknown or other
  misc_feature (415)..(415): n is a, c, g, or t
  modified_base (419)..(419): a, c, t, g, unknown or other
  misc_feature (419)..(419): n is a, c, g, or t
  modified_base (431)..(431): a, c, t, g, unknown or other
  misc_feature (431)..(431): n is a, c, g, or t
  modified_base (434)..(434): a, c, t, g, unknown or other
  misc_feature (434)..(434): n is a, c, g, or t
  modified_base (457)..(457): a, c, t, g, unknown or other
  misc_feature (457)..(457): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgaccgggcgagtcaggacattaacatgtatctgaattggtatcagcagaaaccagggaaacgcccctaaactcctgatcctcgatgcatccaatttaggaacagggtccatcaaggttcagtggagtggctgtgggacagtattttacttcacatcgccagactgcagcctagaagtatagttcgacaacatattactgtacaacngtangtaatatctccnctnacgttgcggtaggaccgtaaggnggacgatcaaggacgaactggttggcgtagctaaccg

SEQ ID NO: 11977 - DNA, 572 bp, Homo sapiens
  misc_feature: GYAE6OF02HU0VF.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccttgtctgcatctataggagacagaatcaccatcattcgccgggcgagtcaggacattaacatgtatctgaattggtatcagcaagaaaaccaagggaaacgaccccctaaactcctgactcctcgatgcataccaatttaggaaacacggggtccatcaaggttcagtaggaagtggctcgtaggactagtattttactttcacctatccgaccagactcgcagcctagaacgatattgacaactattaattactagtacaactaggtatagtataactccttcccgactcgtacgtttcgggaccgggtacgggaacccgaagggttacgggaacgtacgttaaccaagggtaaaccggtaacgttgggttacgggtacccgttacggacctaaccccg

SEQ ID NO: 11978 - DNA, 828 bp, Homo sapiens
  misc_feature: GYAE6OF02HBO2F.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttcggccgggcgagtcaggacaattaacatgtatctgaattggtatcagacaagaaaccgagggaaacgacccccgtaaactccgtgactcctacggtactcgacctactaccgtaagtttacggaaaaccgtacggggtaccccaagttaccgaaagggtttaccgaaggttacggggtaaaggttcgggtaccgttacggtacggggtaaccgttaagggtttaaccttttttaacccgttttaccgtaaaccctaacggtttacccggaccccgttaaagtaacccggtttcggaaccctaacggtacccgttaagggtaaaacggtacttaacgtttacggaacccttaaaacttaatttaacgtttaaccttacggttaaccaaaacggtaggtttaaactaacgttaaacgtttaaacctttcccgttacccccggttacccttaaccgttaacccgggtttttacccggggaaccgggggttaaaccgggtaaaccccggggttaaaggggggttaaccgggtaaacggtaaccgttaccggaaacgggttaaacccggttaaacgggttccggggttaacgggttacccggtcggtaaccccgttaaccccgg

SEQ ID NO: 11979 - DNA, 726 bp, Homo sapiens
  misc_feature: GYAE6OF02G3BSL.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgccggcgagtcaggacattaacatgtatctagaattggtatcagacaagaaaaccgaagggaaacgacccctaaaactcctagaactcctacgatcgactaacttacctaaagttttacggaaaaccgtacggggtaccctaagttaccgtaaagggtttccgaaggttacgggtaaaggttcgggtaccttcggtacggggtaaactaaggtttaaccgttttttactttaccctaaccgtacgttacccgggacccctaaagggtacccgttaggacctaacggtacccgttaaggaaacgtaagttaacgttacgaaccttaaactaagttaaactttaccgtagttaaccctaaacgtaacgttattagtaacttaaacgttcccgttacccgtaccttaccgttaccgtttaccgggaccgggtaacggggtaaccgtaacggggttaggaacgtacgtaaccgaaggtaaccgtaaccggttgtaccgggtacttaggaccctaacccgg

SEQ ID NO: 11980 - DNA, 740 bp, Homo sapiens
  misc_feature: GYAE6OF02HT4OL.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgtctgctcgtggctctcgaggtcgaccgagatagtatcactccgagtataccgaccctagttcctacctacttcccctcccttgtctcgctacttctaagtaggacgaacaagtaactccaacctactacctacgttcgggcccgggagtacgtacgacggaactaattaactagttagtacttcgtagtaagtttaggttactacgacgaacgaaacggaaaaccggaaacgggaaaccccgtaaccccctaaacttccgtagtaccttccgtacgtatcgactactacttaagttaacggaacggtacgggtaccatacgtaagttcgaggtaggagtcgtcgtaggtacggactagtttacttttacctaccacgtactcccgacgtacgtacgtcgacgacgtacctaggaacgttattagttacgaactaaacttattaactttacgtacgtaaactaacgtaagttagtaacgtaacttaaccttcccgttaccccgtacttaccgttaccggtttaccggggacgggtaacgggtaaccggtaaggggtacggtaacgtacgtaacggtaacggtaaccgttacggttcgggtacggtaccgtacggtaccctaaccgg

SEQ ID NO: 11981 - DNA, 719 bp, Homo sapiens
  misc_feature: GYAE6OF02H58OY.52.2.A02.1.454.CMB.1.raw
  modified_base (222)..(222): a, c, t, g, unknown or other
  misc_feature (222)..(222): n is a, c, g, or t
tcagcgcagtacgacacgaccggtgctcgatttagactcatctacagggggggagtcagtcccaaccaggacacagcatggacatgagggtccctgctcagctcctgggctcctgctgctctggctctcaggtgccagatgtatcatccagatgacccagtctccatcctccctgtctgctatctataggagacaagaatcaaccatcacgttcggccgggnagtcaggacaatacatgtaatctgtaattggtaatcagacaagaaaccgaaggaaaccgaccctaaactcctagactcctcgatcgctatacctaagttacggaacgtacgggttacccagtaccgtaaggttacgaaggtaggtaaaggtcggtacgttacggtacgggtaacgtaacgttttacttttaaaccgttttcctaaccgttaacgtccggtacccaaacggtttaaccgtcgtacgaacgtacccgtaaggtaaacggttatttaacgtttacggaaaccaaccgtttaatttaaacttaaccgtaccggtttaaacaaaccgttaaagggttcctaaaggtaacgttaaacctttcccgtaaccccgttcgtttacccgttaaccggtttccggggacgggtaaacccgggtaaccggtaaggggtaccggtaagtaacgttaccggaacgtacgtaacggttcggtaccggtagtccgaactaccg

SEQ ID NO: 11982 - DNA, 665 bp, Homo sapiens
  misc_feature: GYAE6OF02IT6OG.52.2.A02.1.454.CMB.1.raw
  modified_base (195)..(195): a, c, t, g, unknown or other
  misc_feature (195)..(195): n is a, c, g, or t
  modified_base (228)..(228): a, c, t, g, unknown or other
  misc_feature (228)..(228): n is a, c, g, or t
  modified_base (484)..(484): a, c, t, g, unknown or other
  misc_feature (484)..(484): n is a, c, g, or t
  modified_base (515)..(515): a, c, t, g, unknown or other
  misc_feature (515)..(515): n is a, c, g, or t
  modified_base (646)..(646): a, c, t, g, unknown or other
  misc_feature (646)..(646): n is a, c, g, or t
tcagcgcagtacgacacgaccggtgctcgatttagactcatctacagggggaggtcgagtcccaaccaggacacagcatggacatgaggtccctgctcagctcctgggctcctgctgctctggctctcaggtgccagatgtatcatccagatcgacccagtctccatccctccctgtctcgacatctagtagganacagtactcaccatctacttggccggcgagtanacggaacattaacatgtatctagtaattggatcagactaagaaacgaggaaccgccctaaacgtcctagtacaccgtacagtctacgataccctaagttacggaacgacgggttaccaattcgaaacggttcgaaggtacgggtaagtacggtacttacggtgggtaaactcggtttaacgttttaccgtttacgaaccttaacgtccggtaaccgaaggtacgttacgaccgtaacggtaccttaggaaacgttnttaacgttgactaaacgtactaagtttaccntaaaccgatacgtatagtaatacttccgtccctaacttcgttaaccgttacgggacggttaaacgggaccgttaaacggtggggtaactaacgttaccgaacggttaaccggcgttaaggttacccgggtntttaccggaccctaaacgg

SEQ ID NO: 11983 - DNA, 480 bp, Homo sapiens
  misc_feature: GYAE6OF02GRLFD.52.2.A02.1.454.CMB.1.raw
  modified_base (305)..(305): a, c, t, g, unknown or other
  misc_feature (305)..(305): n is a, c, g, or t
  modified_base (332)..(332): a, c, t, g, unknown or other
  misc_feature (332)..(332): n is a, c, g, or t
  modified_base (350)..(350): a, c, t, g, unknown or other
  misc_feature (350)..(350): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccgggcagtcaggacattaacatgtatctgaattggtatcagcagaaaccaggaaacgcccctaaactctgatcctagatgcatccaattggaaacngggtccatcaaggttcagtgagtgctnggacagattttactcacntcgcagctgcagctagaagatattgacaacatattactgacaatagtactgtataatcctccgctctacgtttcggacggtaggtaccaagggttgaagtagtcgaagacgacgtgtcggcttagctaac

SEQ ID NO: 11984 - DNA, 571 bp, Homo sapiens
  misc_feature: GYAE6OF02FI60Q.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgattggtatcagcagaaccagggaaacgccctaaactcctagatcctacgatgcactacctaattttacggaaacgtacgggggtacccaagtaccgtaaacggtttcgaggtagggaacgtggtcgtcgtgggtactacggttactttttaacctttacacctactcgaccagactagcacgcctagaacgattacttagactaacattacttactagtactaactacgtatagtaacttaactcctaccgtccttactaccgtttcggacgggacggaccgtaagggtgaacgactacgaacgacgtaacgtggtacgctcggactaaccg

SEQ ID NO: 11985 - DNA, 681 bp, Homo sapiens
  misc_feature: GYAE6OF02IX6YS.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctagaattggtatcagcaagaaaccagggaaacgcccctaaactcctagactcctacgatgactacttacctaatttacgggaaaaccgtacggggtaccccaagttacgtaaagggtttaccgaaggttagggaaggtcggtacttacggtagggggaacctaaggttaacttttttacccgtttacaaccgtacgttcccggtacccaaggtaacccttcggtacctacggtacccttaggaaacgtacgttaagttacgacctaaacctatttaacgttacgtacgtaacaaacgtaggttactagtaactttaactcccgttacccgtacttacgtaccgtttccgggaccgggtaacggtaacccggtaagggttacggaacgtaacgtacggaaggtaaccgttacgttacggtacggtccgttaggaccctaaccg

SEQ ID NO: 11986 - DNA, 699 bp, Homo sapiens
  misc_feature: GYAE6OF02IEW58.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctagtaggagacagaatcaacccatacctacgttcggcccggggtacgaacgtcgacggactaatttaaccattggttaatcgttagtaaagttggttaacttcgaagacgaacggaaaaaccgtaacggggaaaacctacccccttaaaactcccgttagaacctcctacgatcgactaacttaccgtaaagtttacggaaacggtacgggtacccaagttaccgaaggtttacaaggtggaaggttcggcgtcgtaggactaggttacttttacgttcaaactgtccgacacgtactgcgtacgtcctaaggacgtaatttacgttacgaacctaaacttacttaactttacgtacgtacaaacgttagtagtataacgttacctaccctcccgtaattccgttaccgggtttaccgggacgggttaaccgggtaccggtaaaggggttcgaacggtaacgttaccggaaggtaaccgttaacggtcggtacgggtcctaccggacccttaaccgg

SEQ ID NO: 11987 - DNA, 528 bp, Homo sapiens
  misc_feature: GYAE6OF02IEINX.52.2.A02.1.454.CMB.1.raw
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
  modified_base (349)..(349): a, c, t, g, unknown or other
  misc_feature (349)..(349): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaacgcccctaaaactcctagactcctacgatgcatccaatttggaaacngggtccatcaagttcagtggaagtgctcgnggangtattttactttcactatcgccagactgcagcctagaagtatagttagactaaacattaacttactagtacaataacgtatagattaaactcctacccgcttacctacgtttcgggacgggtaacgggaccaagggtggaagatacgaaggacgtaacgtgtcgggctcgacctaaccg

SEQ ID NO: 11988 - DNA, 685 bp, Homo sapiens
  misc_feature: GYAE6OF02JQXBR.52.2.A02.1.454.CMB.1.raw
tcagcgcagtacgacacgaccggtgctcgatttagactcatctacaggggggaggtcagtcccaaccaggacacagcatggacatgagggtccctgctcagctcctggggctcctgctgctctggctctcaggtgccagatgtatcatccagatgaccagtctccactcctccctgtctgctatctagtaggagacagaactcaccatcacgttcgccgggcgagtacaggactaattaacatagtatctagtaattggtatcagacaagaaaccgaagggaaaccacccctaaactcctgaactcctacgatcgactactacctaagttacggaaacgtcgggttacccagttacggtaacgttacgaaggttacggtaaggtggtaaccgtcgtaggggtaactaggtttaacttttacctttacgaccttacgtaccgacctaacgtactcggacctacgtaccgtaagtaaacgtacgttagttacgaacgtaaacttacgttaactttaccgtagtaacgtaaaccttaggtaaactttacgttaaaccttaccgttacccgttaccccgtattacccgttacggtttaccgggaccgggtaacgggtaccgtaacggggtacggaagtaccgtacgaacggtaccgttaacgtgggtacgacggttacaccgttaaccg

SEQ ID NO: 11989 - DNA, 535 bp, Homo sapiens
  misc_feature: GYAE6OF02JDO1G.52.2.A02.1.454.CMB.1.raw
  modified_base (438)..(438): a, c, t, g, unknown or other
  misc_feature (438)..(438): n is a, c, g, or t
  modified_base (455)..(455): a, c, t, g, unknown or other
  misc_feature (455)..(455): n is a, c, g, or t
  modified_base (460)..(460): a, c, t, g, unknown or other
  misc_feature (460)..(460): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaatcaccatcacttgtcgggcgagtcaggacattaacatgtatctagaattggtatcagcaagaaaccagggaaacgacccctaactcctgactcctacgatgacatccaatttaggaaacgtcgggtacccagtcctaaggttcaggtggaagtggctcgtgggactagtattttacttcacctatcgccaagacctgctagcctagaaagtctattgacaacgtattatactgtaacaanagttactgaataactcnccgtntctacgttggaccgagggaccgtaagggtcgagacgttacgaacgtacggtagtggttcggactacgactaaccc

SEQ ID NO: 11990 - DNA, 887 bp, Homo sapiens
  misc_feature: GYAE6OF02JLELR.52.2.A02.1.454.CMB.1.raw
tcagcgcagtacgacacgaccggtgctcgatttagactcatctacagggggagtcagtcccaaccaggacacagcatggacatgagggtccctgctcagctcctgggctcctgctgctctggctctcaggtgccagatgtatcatccagatgacccagtcctccatcctccctgtcctgcatctataggagacagaatcacatcacttgccgggcagtcaggacattaacatgtatctagaattggtatcagacaagaaccaacgggaaacgacccctaaacgtaccctagactacctaccgtatgaccgacttacctaagttttacgggaaaaccgtacgggggtacccctaacgtacgtaaacgggttttacgaacggttacgggtaaacggtcggtaccgtaccggttacggggaaacgtaagtttaacggttttttaacctttaccgtaacccgtacgttaccggtacccgtaacggtaacccgtcggttacccgaacggttcccctaagggtaaaccggtaagtttaaaccgtttacggtaacccttaaaaccggtattttaaccgtttaaacccgttcgttaaacccgttaaacgttaacggttaaaccgtttaagggttaaaacctttaacccggttttacccgttacccccccggtttaaccgtttacccggtttaacccgggtttttaccccgggggacccggggttaaaaccgggggggttaaccccccgttaaaaggggggtttaccggggtaaacgggtttaaacccggtacccggtttaaaacccggggtaaacccgggtttaaacccggtttaccggggggtttaacgggtacccccgggttttagggaaccccccgtttaaaacccccgggg

SEQ ID NO: 11991 - DNA, 703 bp, Homo sapiens
  misc_feature: GYAE6OF02I9LXC.52.2.A02.1.454.CMB.1.raw
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcatccagatgacccagtctccatcctccctgtctgcatctataggagacagaatcaccatcacgttcggccgggcagtacaggaacaattaaacagtgtatactagaatttggtaatccagacgaacgaaaacaacgggaaagtaccccctaaaactcctagtacgtacctacgaatcggctaacttaccgaaatttagggaaaccgtaaggggttccccaagttacgtaaaggtttacgaacggttagggaaacgtcgggtacttacggtaggggtaacctaacgttaattttttaccgttttaccaaccctaagtttacccgacccgtaacgtaaccgttacggtaacgaacgtcccgttaaagggtaaactactagtttaggacctaaaactaatttaacttactaacggtacaaacgtagttaagtagtaaattaacctccttacccgacctttacaccggtttaccggacggggtaacggaccgtaaaggggtcggtaaagtaaccgagtaaacggacgtaacggttcggaacggtcttacggacctaacccg

SEQ ID NO: 11992 - DNA, 500 bp, Homo sapiens
  misc_feature: GYAE6OF02HRCDW.52.2.A02.1.454.CMB.1.raw
  modified_base (214)..(214): a, c, t, g, unknown or other
  misc_feature (214)..(214): n is a, c, g, or t
  modified_base (267)..(267): a, c, t, g, unknown or other
  misc_feature (267)..(267): n is a, c, g, or t
  modified_base (289)..(289): a, c, t, g, unknown or other
  misc_feature (289)..(289): n is a, c, g, or t
  modified_base (304)..(304): a, c, t, g, unknown or other
  misc_feature (304)..(304): n is a, c, g, or t
  modified_base (329)..(329): a, c, t, g, unknown or other
  misc_feature (329)..(329): n is a, c, g, or t
  modified_base (350)..(350): a, c, t, g, unknown or other
  misc_feature (350)..(350): n is a, c, g, or t
  modified_base (360)..(360): a, c, t, g, unknown or other
  misc_feature (360)..(360): n is a, c, g, or t
  modified_base (400)..(400): a, c, t, g, unknown or other
  misc_feature (400)..(400): n is a, c, g, or t
  modified_base (460)..(460): a, c, t, g, unknown or other
  misc_feature (460)..(460): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggnagtcaggacattaacatgtatctgaattggtatcagcagaaaccagggaaacncccctaaatcctgatcctcgangcatcaattggaacngggtccatcagttcagtgagtgctntggacagtattttacttcacntcgtcagacngcagcctagaagtatattgacaatattaattactacgtanaactagtaatgaatactcctaccgctactacgttcggcggtaaggaccgaagggtggaanacgtacgaaggtacgaacgtggtcggacttgacctaaccg

SEQ ID NO: 11993 - DNA, 756 bp, Homo sapiens
  misc_feature: GYAE6OF02H22Q3.52.2.A02.1.454.CMB.1.raw
  modified_base (184)..(184): a, c, t, g, unknown or other
  misc_feature (184)..(184): n is a, c, g, or t
  modified_base (217)..(217): a, c, t, g, unknown or other
  misc_feature (217)..(217): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatntataggagacagaatcacatcacttcgccgggnagtcaggactattaacatgtaatctgtaattggtatcagacaagaaaaccgaggaaaccgtacccctaaactcctagactcctcgatcgctactaccgtaaagtttacggaaaaccgtacggggtaccctagtacgtaaacgggttactaaggtgggaaacggttggtaccgttacgtaggggtaactaaggtttacttttttaacctttaccgtaacctacgttaccgacctaagtaaccggttcggaacttaccggaccgttaaggaaagttagttaactttacggaaaccttaaactacgtttaaacttttaaccgagtttaaacccgtaaacttaagggttttaaaccgtagtaaaccgtttaacctttaccccgtaccccggttacccttaaccgttacccgggttttaaccggggacccggggtaaaccgggtaccgggtaaaaggggttacggtaacggaactttacccggaaaggggtaaccgtttaacggtaccggtttaccgggacgtttaccccggactaaaccccgg

SEQ ID NO: 11994 - DNA, 606 bp, Homo sapiens
  misc_feature: GYAE6OF02IONQP.52.2.A02.1.454.CMB.1.raw
  modified_base (194)..(194): a, c, t, g, unknown or other
  misc_feature (194)..(194): n is a, c, g, or t
  modified_base (218)..(218): a, c, t, g, unknown or other
  misc_feature (218)..(218): n is a, c, g, or t
  modified_base (222)..(222): a, c, t, g, unknown or other
  misc_feature (222)..(222): n is a, c, g, or t
  modified_base (236)..(236): a, c, t, g, unknown or other
  misc_feature (236)..(236): n is a, c, g, or t
  modified_base (331)..(331): a, c, t, g, unknown or other
  misc_feature (331)..(331): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtcctccatcctccctgtctgctatctatagganacagaatcaccatcacttgccggnagtnaggacattaacatntatctgtaattggtatcagcagaaaccaagggaacacccctaactacctgactcctcgatcgctatacctaattaggaaacgcgggtaaaaaccntacgaaacggtttcgaaggtacggtaaggtcggtcgtacgtacggggtactaaggtttacttttacgttttaccaccgtaagttcccgaccaagtaccgtcggactacggtacctaggaagtattaattcgaacaactaattaacttagtactacaacgtagttaatagtaattaacttccctcccgtcttaaccgtacgtttccgggacggtacgggtaacggtaaggtacggagtacgtacgagtaacggacgttggagcgtacgacctaccg

SEQ ID NO: 11995 - DNA, 700 bp, Homo sapiens
  misc_feature: GYAE6OF02HQ8XL.52.2.A02.1.454.CMB.1.raw
  modified_base (214)..(214): a, c, t, g, unknown or other
  misc_feature (214)..(214): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggnagtcaggacattaacatgtatctagtaattggtatcagcaaggaaacccagggaaacgcccctaaactcctagatcctcgatgctatccaaatttacggaaacgacggggtacccaagttaccgaaaggttttacgaggttagggaaacgttgggaccttcggttaggggaacttaggtaacttttttaccttttaccgaaccctattacccggcctaacggtaaccgttggaccaacggtacccgttaggtaaagtaattaacgtttacgaccttaaaactacgtttaacgtttaaccttacgggttaacctaaaccgtaaggttaagttacgaaattaaaccgttcccgttaccccggttaccttaaccgttacccgttttaccgggaccggggtaacgggtaacccgtaaaggggttacggaaggttaaccgtacgaaacggtaccggtaaacgttcgggttacggcgttaggaccctaaccg

SEQ ID NO: 11996 - DNA, 743 bp, Homo sapiens
  misc_feature: GYAE6OF02JDIH0.52.2.A02.1.454.CMB.1.raw
  modified_base (215)..(215): a, c, t, g, unknown or other
  misc_feature (215)..(215): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggngagtcaggacattaacatgtatctgaattggtatcagacagaaaccgaagggaacgacccctaaactcctagactcctacgactcgactaatcctaaagttttacgggaaaaccgtacgggggtaccccaagttaccgtaaagggtttacgaaggtttacgggaaaggttcgggtacgttaccggttagggggtaacctaacgggtttaactttttttaacccgttttaaccgaacccgttaacgttcccggtaacccgtaacggtaaacccggtttcggaacccgtacgggtaccccttaagggaaaacgttacgttaacgtttaggaaccctaaacgtaactttaaacttaacgttcggttaactaaaccgtaaggttatagtaacttaaacgttcccttaacccgtaccttaccgttacgtttacccggggacgggtaacgggtacccgtaaagggggttacgaaggtaccgttacggaacgacggtaacgttcgggtacggtacgttacggtaccctaacccgg

SEQ ID NO: 11997 - DNA, 628 bp, Homo sapiens
  misc_feature: GYAE6OF02JTEZ0.52.2.A02.1.454.CMB.1.raw
  modified_base (198)..(198): a, c, t, g, unknown or other
  misc_feature (198)..(198): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (497)..(497): a, c, t, g, unknown or other
  misc_feature (497)..(497): n is a, c, g, or t
tcagcgcagtacgacacgaccggtgctcgatttagactcatctacagggggagtcgagtcccaaccaggacacagcatggacatgagggtccctgctcagctcctgggctcctgctgctctggctctcaggtgccagatgtatcatccagatcgaccctagtcctaccatccctccctgtactgacatctagtagganacagaactcaaccatcacgttcggcccgggacgagtacgaacggtaacctaagtttaaacattacggtacttacctaggtaaatttcgggtacttacgacgtacgaaacggaaaaccgtaacggggaaactaccccctaaactccgtagaactcccgtaccgatcgtacaaccttacctaagtttaacggaacgacgggtacccagtacgtaaggttcgagtacggagtcgctcgtaggactgtacttttactccacactcgacctagacgtanctatccgtanaacgtatatgacaanttattcagttaccaagtatacgtataattacgtaccctcgtactactacggttacggacgtaagggacccgtaaaggtgaacggtactacgaaggaaccgttggtacgttcgggacttaccgacttaaccg

SEQ ID NO: 11998 - DNA, 672 bp, Homo sapiens
  misc_feature: GYAE6OF02JW9OG.52.2.A02.1.454.CMB.1.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (236)..(236): a, c, t, g, unknown or other
  misc_feature (236)..(236): n is a, c, g, or t
tcagcgcagtacgacacgaccggtgctcgatttagactcatctacagggggaggtcagtcccaaccaggacacagcatggacatggagggtccctgctcagctccgtgggctcctgctgctctggctctcgaggtcgccagatgtatcatccagatcgacccagtctccactccctccctgtcctncatctagtaggganacagaatccaaccgatctacgttcggcccggggtanacgtcgaaggaacctattaactgtagtactactagtaagttgtactcagacgaacgaaacggtaacggaaccacccctaactcctagactcctacgatcgacatactaagttacgaacgccggtaccagttacgagtttcgaggtaggacgtgcgttacgaggatacgttatttaccgtccactacgtccgtactacgtacgtacgtacaccgtactaagtaacgtattacgtaactacgtaacgtaacttacttacggtactaacgtaaccgtagttaacgtagtaaccttaaccgttccgttacccgtacgttccgttaaccgggttaccgggtaacggacgggttaaccggtaacgggggttactaacggtaccgtaacgtaacgtaaccgttaacggtacggtaccggtaccgaccggtaacccgttacccg

SEQ ID NO: 11999 - DNA, 849 bp, Homo sapiens
  misc_feature: GYAE6OF02G0Y8Z.52.2.A02.1.454.CMB.1.raw
  modified_base (193)..(193): a, c, t, g, unknown or other
  misc_feature (193)..(193): n is a, c, g, or t
  modified_base (219)..(219): a, c, t, g, unknown or other
  misc_feature (219)..(219): n is a, c, g, or t
tcagcgcagtacgacacgaccggtgctcgatttagactcatctacgaggggggagtcagtcccaaccaggacacagcatggacatgagggtccctgctcagctccgtggggctcctgctgctctggctctcaggtgccagatgtatcatccagatgacccagtctccatcctccctgtctgcatctatagganacagaatcaccatcacgttgccgggnagtcaggacataacatgtatctagaattggtatcagacaagaaaaccgagggaaaaccacccctaaactcctagactccctacggatcgacacttacctaaagtttacgggaaaacgtcggggtaccctaagtacgtaaagggtttccaaggttaacggggtaaaggttcgggtacctttacgggtaacggggaacttaagggtttaacctttttttaaccctttaccgtaaacccgtaacgtttcccggaaccctaaagggtacccttacggaccgttaaacggacccttaaaggggaaaactttaccgtttaaagttttacggaaacccttaaaaaccttaagtttaaaaccttttaccgtaaccgtttaaaccgaaaaccgtttaaggtttaaacgttaaccggtaaaacgttttaaacccttcccgttttaacccccggtaaccgtttaacccgttaacccggggtttttacccgggggaaacccggggttaaccgggggtaaacccgtaaaagggggggtttcgaaaaccggggtttaacaaccccgggaaaagggttaaaccccggtttaaccgggttaggggttaacccgggtacccgttaaccgggaacccttaaaccccgg

SEQ ID NO: 12000 - DNA, 764 bp, Homo sapiens
  misc_feature: GYAE6OF02HYHJG.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctatacggagacagaatccaaccatcacttcgaccgggcgagtcaggactagttaacatgtatctagtaattggtatcagcaagaaaccagggaaacaccctaaactccagtatcctacgattcgactactcctaagttggaaacgtacgggtccaagtacgtaaggttacgaggtaggaaggtcggcgtacgtagggactaaggttacttttacgtttaccactacgttccgaccctaaaggtaccttggacctaacggtacccgtaagtaaacgggttaactttaacgtttacggtttaaaaccctaatttaaccgttttaaccgtacgttaaacccgtaaaacgtttaaccgtttaaagaggtttaaaaccttaaaccgtttacccccgttaacccgggtttacccttaaccggttaaacccgggttttttccgggggacccggggtaaacggggggttaacccctaaaggggggttaacgggtaacccgtaacggtttaacccggaagggaaaaccccggtttaacggtccgggtttaccgggtaaccgtttccgaaccccggttacctttaaaccggg

SEQ ID NO: 12001 - DNA, 588 bp, Homo sapiens
  misc_feature: GYAE6OF02G88SP.52.2.A02.1.454.CMB.1.raw
  modified_base (322)..(322): a, c, t, g, unknown or other
  misc_feature (322)..(322): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacattgtatctagaattggtatcagcaagaaaccagggaaacgcccctaaactcctagatcctagatgacatacctaagtttacggaaaacncggggtacccaagtacgaaaggttcaaggtaggaagtggcttcgtggactagtacttttacttcaacctatccgacagactgacagtacctagaagtacttattacgactaaactattactttacgtagtaacaactagttatacgaattaactccgttccctactaccgttacgtttaccgggacgggtaacgggtaccgtaaggggtacggtaacgagttaccgaaggtaaccgtacgttcggtacggtctacggacctaaccg

SEQ ID NO: 12002 - DNA, 813 bp, Homo sapiens
  misc_feature: GYAE6OF02I0FYN.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctagtaggagacagaatccaccatcacttgccgggcgagtcaggacattaacatgtatctagtaattggtatcagacaagaaaccgaggaaacgacccctaaactccgtagactcctcgatcgactactacctaagtttacggaaacgtacgggtaccctaagtaccgtaaggtttacgaaggttacgggtaaaggtcggtaccgttacggtacggggtaacctaaggtttaacgtttttttaaccctttaccgtaacccgtaagttcccgtaacccgtaacggttacccgtacggtaccctacggtcccgttaaaggaaacgttaacgtttaacgttacggaacccttaaaccgttaacgtttaaacgtttaactaaccggtttaaccgtaaaaccggttaggtttaaacgttaacgttaaacgtttaacccgttacccccgtttaaccccgtacctttaacccggtttaccccgggtttttaccgggggacccggggtaaaccgggggttaaacccgggtaaacgggggttacggggtaaaccggtaacgttaacccggaaacgggttaacccggtaaccggtttccggggtaacgggtacccgttacccggaccctttaaaccccggg

SEQ ID NO: 12003 - DNA, 814 bp, Homo sapiens
  misc_feature: GYAE6OF02JHT0G.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctagtaggagacagaatcaccatcacttgccgggcagtcaggacattaacatgtatctgaattggtatcagcagaaaccagggaaacgtacccctaaaactccgtagactaccgtcggactcgactactacctaaagttttacgggaaaaccgtagggggtacccctaagttaccgtaaaacggggtttaccgtaaggttacggggtaaaacggttcggggtacctttaccgggtacgggggtaacgtaacggtttaaacgtttttttaaccgtttttaccctaaacccgtaacggttcccgtaccccggaacgttaacccgtttacggaaccgtaaccggtaccccgttaagggtaaaacggttaacgtttaacgtttacgggaacccttaaaaccgtaacgttttaaacttttaacccggttacgttaaccgtaaaacttaacggtttaaattaccgggtaaactttaaaccgttaccccgtttaccccgtaaccgtttaccttaaccgggttttacccggggtaccggggtaaaggggaaccccgttaaaggggttagggtaaacggtaacgttaaccgaacgggtaaccgaaccggtttcggacggtcccgtagggtacccctaaccgg

SEQ ID NO: 12004 - DNA, 597 bp, Homo sapiens
  misc_feature: GYAE6OF02HWB10.52.2.A02.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatccctcctgtctgcatctatagganacagaatcacatcacttggccggnagtcagacattaacatgtatctagtaattggtatcagacaacgaaacgaacggaaccacccctaaactcctagactcctacgatgacctactactaagttacggaaacgtcgggtaccagtacgtaaggttcaggtagggtaggtcgtcgtggtaggtacttagttactttttactacacctacgtccgacagtactgactacggctaagtaagtattagttacgactaaacttagttaactttacgtctaacaagttaagtactataacttacttcccgtccgtactccgttaccgggtcgggaccgggtaaggtaacccggtagggtcggaagtactacggaacggaacgtcgttggaccggtactacggaccttaccg

SEQ ID NO: 12005 - DNA, 759 bp, Homo sapiens
  misc_feature: GYAE6OF02G411O.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcagtcaggacattaacatgtatctgaattggtatcagcaagaaaccagggaaacgcccctaaactcctgactcctcgatcgactactacctaagtttacggaaaaccgtcgggggtaccccaagttaccggtaaagggtttcgaaggttacggggaaacgggtttcgggtccgttacggtacgggggtaactaagggtttaactttttttaaccgtttacccgtaaccgtaccgttacccggaccctaagggtacccttaggacctaacgggtacccgttaagggaaaccgttaattaagtttacgaacccgtaaaccttatttaaacgttttaccgtacggttaaccaaaacgttacggttaattaacggtaaactttaaacgtttccccgttaaccccgtaccttaccgtttaaccgggtttccggggtaccggggaaccggggtaaccggtaaagggggttcgggaaacgttaacggtaccggtaacgggtaacccggttaaccggttagggttacgggacccgttacggacccctaccgg

SEQ ID NO: 12006 - DNA, 626 bp, Homo sapiens
  misc_feature: GYAE6OF02H4VBD.52.2.A02.1.454.CMB.1.raw
  modified_base (214)..(214): a, c, t, g, unknown or other
  misc_feature (214)..(214): n is a, c, g, or t
  modified_base (269)..(269): a, c, t, g, unknown or other
  misc_feature (269)..(269): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccggnagtcaggacattaacatgtatctagaattggtatcagcaagaaaccagggaaacnccctaaatcctgatcctcgatgacactcctaatttcggaaacgcgggtcccaagtcgaaggtttcagtaggaagttggcttcgagggactaggttaatttttacctttacgaacctagtccggacctaaggtaccgttgaccgtaggtaccctaagggaaacgtaattagtttacggaaccaaactaatttaacgttaccgttagtacctaaaacgtagttaagtaaggtaacttaacttcccgttaaccccgtcttaaccgttaccgttttaccggggaccgggaacggtaaccgtaaggggtaggacggaacttaccgaggtaaccgtaaggtcgttgggaccttgacctaaccg

SEQ ID NO: 12007 - DNA, 709 bp, Homo sapiens
  misc_feature: GYAE6OF02IZOYX.52.2.A02.1.454.CMB.1.raw
  modified_base (278)..(278): a, c, t, g, unknown or other
  misc_feature (278)..(278): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccggcgagtcaggacattaacattgtatctagtaattggtatcagacaacgaaaccgagggaaacnccccctaaactccgtgactcctcgatcgacctactacctaaagtttgggaaaaccgtaggggtaccccaagttaccgtaaacggttttcgaagggttaggggtaaggttcgggtaccgttaccggtagggggaaaccttaagggttaacctttttttacctttaccgaccgtaacgttcccgaccgtagtaccgtcggacctaggacccttaggaaagtcttaagttacgaactaactaattaacttaacctgtaacctaaacgtagtttaacttaagtaatttaaccgtccccgttacccgtaccttaccgggtttaccgtttaccggggggacggtaaacggggtacccgaagggttaacgggtaaacgacgttacgaaaccgggtaaccggtaacggttcgggacggtccctacggtaccctaaccgg

SEQ ID NO: 12008 - DNA, 658 bp, Homo sapiens
  misc_feature: GYAE6OF02HLQBW.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaaccatcacttcggccgggcgagtcaggactaataacatgtatacgtagtaagttgtatgacgacgaacgaaaccggaaggaaacctacccctaaactcctagtacctccgtacgtatcgactactacctaagttaggaacgtacgggtacctagtacgtagtacgtaggtaggaagtcgtcgtacggtaggtaacgtagtttacgttttacctacctactacgtaccgaccgtagtacctgacgtacgtaccgtaagtaacgtatacgttacgaactaacgtaattaacttacgtacgtaacaacttagttagtacgtaacttaccgttcccgtacccgttaacgttacgttacccgggtttaccgggaacggggtaaccggtaacggtaaggggtacgaacggtaactaccggaaggttaccgtacgggtaggtacggtaccgtacgacccgtaacg

SEQ ID NO: 12009 - DNA, 599 bp, Homo sapiens
  misc_feature: GYAE6OF02IDL4X.52.2.A02.1.454.CMB.1.raw
  modified_base (216)..(216): a, c, t, g, unknown or other
  misc_feature (216)..(216): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatccctccctgtctgcatctataggagacagatcaccatcactgccgggnagtcaggacaattaacatgtatctagaattggtatcagcaagaaaccgaagggaaaccacccctaaaactcctagacttcctacgatcgactactacctaaagtttacggaaacgtacggggtacccaagtaccgtaaaggtttccgaaggttcggaaaggttcggacgttacgtagggaacctaggtttactttttaacttccaaccgtatccgaccaagtctcgactacgaccgtagaaagtatattagaacctaataatttatactgtaacctaatagtatagaattaactcctcctctaccttacgttcgggacggtaacgggtaccgaagggtcggagactagaacggtacgtaacgtggtacggactcggctaaccg

SEQ ID NO: 12010 - DNA, 667 bp, Homo sapiens
  misc_feature: GYAE6OF02H62ZV.52.2.A02.1.454.CMB.1.raw
  modified_base (459)..(459): a, c, t, g, unknown or other
  misc_feature (459)..(459): n is a, c, g, or t
  modified_base (466)..(466): a, c, t, g, unknown or other
  misc_feature (466)..(466): n is a, c, g, or t
  modified_base (490)..(490): a, c, t, g, unknown or other
  misc_feature (490)..(490): n is a, c, g, or t
  modified_base (530)..(530): a, c, t, g, unknown or other
  misc_feature (530)..(530): n is a, c, g, or t
tcagcgcagtacgacacgaccggtgctcgatttagactcatctacagggggaggtcagtcccaaccaggacacagcatggacatgagggtccctgctcagctcctggggctcctgctgctctggctctcaggtgccagatgtatcatccagatgacccagtctccatccctccctgtctgcatctagtagagacagtaatcaccatcgacgttcggccgggactagtacaaggactaatttaaccaattggtaatcgttaggtaaaatttgggtaacttccgaagacgaaacgaaaaaccggaaacggggaaaaacgtacccccttaaaaacttcccgagtaactcccgttacgaattcggactaactacctaaagtttacggaaaacgacgggttacccagtaaccgtaagttcgaggtgaaagtcggactgtacgactagtattttacttcgactancgtaccngtactcgcagacgtagaagtactntagtaccaagattaacgttacagttacgaaactagttaanaagtaactaaccttccgtacctacgtaccgttaccggttacgggaacgggtaaccgggaaccgtaagggtacgtaaacgttaaccgtacgtaaggaacccgttaagtcggtaaccggtacgtaccggacctaacccg

SEQ ID NO: 12011 - DNA, 721 bp, Homo sapiens
  misc_feature: GYAE6OF02JWNSB.52.2.A02.1.454.CMB.1.raw
tcagcgcagtacgacacgaccggtgctcgatttagactcatctacagggggaggtcgagtcccaaccaggacacagcatggacatgagggtccctgctcagctcctggggctcctgctgctctggctctcaggtcgccagatgtatcaatccagatgacccagtctccactcctcctgtctgacatactagtaggagacagtaactcaccatacacgttcgccgggacagtcgaggaactactaacatgtatacgtagtaagttcgatgagtacgaacgaacgaacggaacgtaccctaaccgtcctacgacttaccgtacgtagtcgacctactaccgtaaagtttacgggaaaaccgacggggttaccaacgttaccgtaaagggtttacgtaacgggtggtaaacggttcgggtcgttaacggtacgggtaaacgtaaggtttacgttttaaccgttttaccgaccgtacgttacccgtacgtaacgtacggtacgttacgaaccgtccgtaaggtaattaacgttattacgtacgtaaactacgttacgttaacttacgattaaacgagttacgtaagtacgttaaccgtcctaccggttacttaccgtaaccgggttttcggaccgggtaagggttaacccgaagggttcgggtaaactggttaaccgacggttaaccgtacggtaggttaccgggtactcgggtaccctaaccgg

SEQ ID NO: 12012 - DNA, 619 bp, Homo sapiens
  misc_feature: GYAE6OF02FRIK7.52.2.A02.1.454.CMB.1.raw
  modified_base (215)..(215): a, c, t, g, unknown or other
  misc_feature (215)..(215): n is a, c, g, or t
  modified_base (269)..(269): a, c, t, g, unknown or other
  misc_feature (269)..(269): n is a, c, g, or t
  modified_base (423)..(423): a, c, t, g, unknown or other
  misc_feature (423)..(423): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctataggagacagaatcaccatcacttgccgggngagtcaggacattaacatgtatctgaattggtatcagacagaaaccagggaaancccccgtaaactcctagactacctcgatcgcacttccaaattttggaaaccgtacggggtacccagtacgtaaggttacaggtggaagtggctcgtagggactaagtactttttactcacctagtcgaccagacctgacgacgtacctagtaanatattagctaaacattattactgtaccaaactaggttatgtaattaagtcccttacccgtcgttaccttaaccggttttcggggaccgggtaacggggaacccgttaaacggggttacggggaacggtaacgttaccggtaacgggtaaccggttaaccggttagggttccgggtacttacgggtacccgtaaccc

SEQ ID NO: 12013 - DNA, 703 bp, Homo sapiens
  misc_feature: GYAE6OF02IO4F9.52.2.A02.1.454.CMB.1.raw
  modified_base (239)..(239): a, c, t, g, unknown or other
  misc_feature (239)..(239): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtcctccatccctccctgtctgcatctataggagacagaatcaccatcacgttcggccgggcagtcacggactattaacntgtatctgtaattggtatcgagacaacggaaaccgagggaaaccaccccttaaacgtctacgactccgtagactcgactactacctaagtttacggaaacgtcgggtacctaacgtacgtaacggtttcgaaggttagggaaacgtcggtaccgtacggtaggggaaaccttaaggtttaccgttttttaaccttttacccaaccgttaccgtacccggtaaccgtaacggtaaccttcgggacctacggtacccgtaaggtaaacgttagtttaacttacgaacctaaaccttatttaaacctttacgtcgttaaactaaactaggtttaactacgttaaacttaccttcccgtaaccccgttcttaacccgttaaccggttacgggaccggtaaccgggtaacggtaacgggtaggtaacgtactacgaaggtacgacgttcggcgtcgtacgtacctaccg

SEQ ID NO: 12014 - DNA, 709 bp, Homo sapiens
  misc_feature: GYAE6OF02I29OU.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctagtaggagacagatcacgatcacttcggccgggcgagtaccaggactattaacagttgtatcgtagtaactttggatcaggtacaaggaaaccgaacgggtaaacgacccccttaaactcctacggtaacttccgtacgactacggacaccttaccgtaagttttacggggaaaccggtgggggtaccccctagttaaccggtaaaggggtttccgaagggtttaggggaaacgttggggtaccttacgggttaggggtaacttaacggttttaacttttttacctttaccgaacctacgtacccggtacctacggtacttggacgtacgtacccgttagaagtattacgttacacgtaaactagttaactcgttagtaccaacggttattacgtagtaataccgttccgtacccgtagtccgtacgtttccggacgggtaacgggtaccggtaagggttacggaacgtacgtaaccggacgtaacggtacggtttaggcgggtacttaccggacctaacccgg

SEQ ID NO: 12015 - DNA, 765 bp, Homo sapiens
  misc_feature: GYAE6OF02HMXP9.52.2.A02.1.454.CMB.1.raw
  modified_base (216)..(216): a, c, t, g, unknown or other
  misc_feature (216)..(216): n is a, c, g, or t
  modified_base (271)..(271): a, c, t, g, unknown or other
  misc_feature (271)..(271): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttggccggngagtcaggacattaacatgtatctgaattggtatcagcaagaaaccagggaaacncccctaaatcctagactcctgatcgcatacctaaagtttacggaaaaccgtaggggtaccccaagttaccgtaaacggggtttccaagggttacggggtaaacgttcggggtaccttacggtacgggggtaactacggtttaacttttttaccgttttacccgaaccgttacgttccccggacccgtaaggtacccttggacccgtaacgcccgttaaggaaaacggttcttaaacgtttcggaacctaaacgtaagttttaacttaaccgttacggttaacctaaaaccgttaaggtttaagttaacggtaaatttaaccgttccccgttaacccccggttacttaacccgtttacccgggttttacccggggaccgggggtaaacgggttaacccggtaaaggggtccgggtaaacgtaaaccggtaccgggtaaccggtaaaccggttaaccggttacgggttacgggtaccttacggacccgtaacccgg

SEQ ID NO: 12016 - DNA, 769 bp, Homo sapiens
  misc_feature: GYAE6OF02F3TZZ.52.2.A02.1.454.CMB.1.raw
  modified_base (215)..(215): a, c, t, g, unknown or other
  misc_feature (215)..(215): n is a, c, g, or t
  modified_base (270)..(270): a, c, t, g, unknown or other
  misc_feature (270)..(270): n is a, c, g, or t
  modified_base (295)..(295): a, c, t, g, unknown or other
  misc_feature (295)..(295): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatcgacccagtctccatcctccctgtctgcatctataggagacagaatcaccatcacttgccggnagtcaggacattaacatgtatctagaattggtatcagacagaaaccagggaaacncccctaaactcctagactcccgtanaatcgactactaccctaaagtttacgggaaaccgtcggggttacccaagttacgaaacgggtttcgaaggtagggtaacggtcggtcgttacggtacggggaaaccttaggtttaactttttttaacccgtttacccgaacccgttaaccgttacccggtacccgtaaacggtaaccgtttacggaccgtaaccgggtacccgttaaacggtaaacggtaaagtttaaccgttttaaccggaacccttaaaacttaaactttaaacggttttaacccttacggttaaacctaaaaccggtaagtttaacgttagtaaacttaaacgtttcccgttaccccgtaccgttaccgttaacccggttttccggggacgggtaacgggtaaccggtaacggggttacgggaacggtaaccgtacggaacggtaaccgtaaaccggttcgggttacgggacctacggtaccttaacccgg

SEQ ID NO: 12017 - DNA, 663 bp, Homo sapiens
  misc_feature: GYAE6OF02HDQ7Z.52.2.A02.1.454.CMB.1.raw
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggngagtcaggacattaacatgtatctgaattggtatcagacaagaaaccagggaaacgacccctaaactcctgatcctcgactgactactacctaagtttacggaaacgtacggggtacccaacgtacgtaacgggtttacaggtagggtaaggttcgggtcttacggtaggggaacaaggtaactttcgaccttactaccgaccctactcccaacctacgttacgtcgacgagggtaccgttaggtaggttacgttttacgtaccgttaaacctttactttccgtacgtacctaacgtacggtacgtttaccgtaccgtttcccttaccgttacccgttttacccggacccgttaccgggtacctacgttacggtacggtaacgttaacgtaaccgtaaaccgtaacgttacggtcggtaccgtcgtacctaaccgtcgttcttaccg

SEQ ID NO: 12018 - DNA, 763 bp, Homo sapiens
  misc_feature: GYAE6OF02HEB4X.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggactattaacatgtatctgaattggtatcagcagaaaccgagggaaacgcccctaaactcctagactccgtacgatcgacataccgtaaagttttacgggaaaaccgtacggggtaccccaagttacccgtaaagggtttccaaaggttacgggtaaacggttgggtaccgtttacgttagggggaaactaagggttactttttttaaccttttacccgaaccgttaacgttacccgtacccgtaaagtaacccgttaggaccctaacgggtaccccttagggaaaacgttaagttacgtttacggaacctaaaccgtaatttaaaccttttaaccgtaggttaaccctaaaacgttaaacgttaattaacggtaaactttaaacttccccttaccccggtacttacccgtaaccgtttttaccggggaccggggtaacggggtaacccggtaaaggggttacgggaaacgttaacgtacggtaaacggaacccggttaaacggtacgggttacgggtacgttaccggtaccctaaacccg

SEQ ID NO: 12019 - DNA, 331 bp, Homo sapiens
  misc_feature: GYAE6OF02IKGP7.52.2.A02.1.454.CMB.1.raw
  modified_base (272)..(272): a, c, t, g, unknown or other
  misc_feature (272)..(272): n is a, c, g, or t
  modified_base (318)..(331): a, c, t, g, unknown or other
  misc_feature (318)..(331): n is a, c, g, or t
tcagcgcagtacgacacgaccggtgctcgatttagactcatctacagggcacgaccggtgctcgatttagactcatctacagggtcccatcaaggttcagtggaagtggctctgggacagattttacttcaccatcgccagactgcagcctgaagatattgcaacatattactgtcaacagtatgataatctcccgctcactttcggcggagggaccaaggtggagatcagacgaactgtgctgcaccatctgtctcatcctcccgccatcngatatacgtatcggctggacggacggcgtggacgaaggcgcatagnnnnnnnnnnnnnn

SEQ ID NO: 12020 - DNA, 346 bp, Homo sapiens
  misc_feature: GYAE6OF02IJ0QZ.52.2.A02.1.454.CMB.1.raw
  modified_base (290)..(290): a, c, t, g, unknown or other
  misc_feature (290)..(290): n is a, c, g, or t
  modified_base (320)..(320): a, c, t, g, unknown or other
  misc_feature (320)..(320): n is a, c, g, or t
  modified_base (322)..(346): a, c, t, g, unknown or other
  misc_feature (322)..(346): n is a, c, g, or t
tcagcgcagtacgacacgaccggtgctcgatttagactcatctacaggggcacgaccggtgctcgatttagactcatctacaggggtcccatcaaggttcagtggaagtggctctgggacagattttacttcaccatcgccagactgcagcctgaagatattgcaacatattactgtcaacagtatgataatctcccgctcactttcggcggagggaccaaggtggagatcagacgaactgtggctgcaccatctgtcttcatccttcccgccatctgatatacgatcgntggagcggctggcaaacggcgtaccatagnannnnnnnnnnnnnnnnnnnnnnnnn

SEQ ID NO: 12021 - DNA, 536 bp, Homo sapiens
  misc_feature: GYAE6OF02INW0D.52.2.A02.1.454.CMB.1.raw
  modified_base (430)..(430): a, c, t, g, unknown or other
  misc_feature (430)..(430): n is a, c, g, or t
  modified_base (443)..(443): a, c, t, g, unknown or other
  misc_feature (443)..(443): n is a, c, g, or t
  modified_base (450)..(450): a, c, t, g, unknown or other
  misc_feature (450)..(450): n is a, c, g, or t
  modified_base (457)..(457): a, c, t, g, unknown or other
  misc_feature (457)..(457): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgaccctagtctccatcctccctgtctgcatctataggagacagaatcaccatcacttgccgggcgagtcaggacattaacatgtatctgaattggtatcagacaagaaaccgaagggaaacgccccctaaactctcgatcctcgatgacataccaatttaggaaaccgagggtcccatctaaaggttcagtggaagtggctcgtgggacagtatttttaccgttacacctatccgacagactgcagacctgaactattattgaccatactattacntaccatagtatanattaacncctcctntacgtcgttcgggacggaaggtaccgaagggttacggatagacgaaggctaacgttggttacggacttggaccctaccg

SEQ ID NO: 12022 - DNA, 754 bp, Homo sapiens
  misc_feature: GYAE6OF02G51DT.52.2.A02.1.454.CMB.1.raw
  modified_base (134)..(134): a, c, t, g, unknown or other
  misc_feature (134)..(134): n is a, c, g, or t
  modified_base (204)..(204): a, c, t, g, unknown or other
  misc_feature (204)..(204): n is a, c, g, or t
  modified_base (221)..(221): a, c, t, g, unknown or other
  misc_feature (221)..(221): n is a, c, g, or t
tcagcgcagtacgacacgaccggtgctcgatttagactcatctacagggggagtcagtcccaaccaggacaaagcatggacatgagggtccctgctcagcctcctggggctcctgctgctctggctctcaggtnccagatgtatcactccagatcgaccctagtcctaccacttcccctcccgtgttctgctatctagtagganaccagaacttccaaccnttacctaccgttgggcccgggtacgtacggtaccgaacggtaacctaatttaacctagttagtattacgtaggtaatttaggtactacaacgtacgaacgaaaccggaacgggaaaccgtacccctaaaccgttacctacgacttaccgtacgtacgtagactactacgttaaacgttaaccgggaaacgtaccggggtacctactaacggtaacggttacgtaaggtacggtaagggtcgtcgtaggtacggacgttaagttaactttttaccgtactaccttagtccgacgtccggtaagcgtacgactacgaccgtaggaattagtatacggataaacgttattatttactaagtacctaaacgtagttacgaacgtttaacgtaccttaccgttacccgtacctttaccggtaccgggttaccggggaaccgggggtactaacggggtaacggtacggtaacctaacgggaaaccgttacgggtacccgtttaaggccggtttacggaccgtaccgtaacgttacccgg

SEQ ID NO: 12023 - DNA, 530 bp, Homo sapiens
  misc_feature: GYAE6OF02F4SSU.52.2.A02.1.454.CMB.1.raw
  modified_base (497)..(497): a, c, t, g, unknown or other
  misc_feature (497)..(497): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaactcaccatcacttgccgggcgagtcaggacattaacatgtatctagaattggtatcagcacgaaacgagggaaacgacccctaaactcctagtactcctcgatgcatacctaagtttacggaaacgacggggtaccatcgaacgttcagtaggaagtcggctacgtggacagttattttacttacaccatccgacagactgcacgtacctagaatattattgacaacgtattattactgtaacaatagtatatatatcctccgtctctaccgttcggaggacggtacggtaaggtggagntacgagacgtacgtggtaggctacgactaaccg

SEQ ID NO: 12024 - DNA, 554 bp, Homo sapiens
  misc_feature: GYAE6OF02I5FTT.52.2.A02.1.454.CMB.1.raw
  modified_base (223)..(223): a, c, t, g, unknown or other
  misc_feature (223)..(223): n is a, c, g, or t
  modified_base (297)..(297): a, c, t, g, unknown or other
  misc_feature (297)..(297): n is a, c, g, or t
  modified_base (403)..(403): a, c, t, g, unknown or other
  misc_feature (403)..(403): n is a, c, g, or t
  modified_base (453)..(453): a, c, t, g, unknown or other
  misc_feature (453)..(453): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccatctccactcctccctgtctgctatctataggagacagaatccaccatcacgttcggaccgggngaggtacgagactattagctatgtatactagtaattggtatcaagacaaaaccgaggacacgaccctaactctntactcacgatgctactacctacgttaggaacgcggtaccatacgtaacgtcgagtaggagtgtcgtgtaggactagttattttacttcacctatacgagacgtgcncgacacgcccgtagaacactgttacaactatattaattctatacactatntataactcgtcctaccgcttacgtaccggttacgggggaccggggttaaagtgggtaaccgagtacgaacggtaacgcggtaagtcggtcgacgtgtaccc

SEQ ID NO: 12025 - DNA, 572 bp, Homo sapiens
  misc_feature: GYAE6OF02GH9XH.52.2.A02.1.454.CMB.1.raw
  modified_base (191)..(191): a, c, t, g, unknown or other
  misc_feature (191)..(191): n is a, c, g, or t
  modified_base (268)..(268): a, c, t, g, unknown or other
  misc_feature (268)..(268): n is a, c, g, or t
  modified_base (281)..(281): a, c, t, g, unknown or other
  misc_feature (281)..(281): n is a, c, g, or t
  modified_base (287)..(287): a, c, t, g, unknown or other
  misc_feature (287)..(287): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacttgccggcagtcaggacattaacatgtatctgaattggtatcagcagaaaccagggaaacncccctaaactccngatccncgatcgcatcctaattggaaactacgggtcccatacgaagttcagtggaagtggtctcgtgggactagtacttttacttacacctagtcgaccaagactgacacgtcctaagaacgtattatagacaacgtattacttactgtaactaacgtaagttatacggtaatttaacctccgttcccgtacttaccgttacgtttcccggggacgggaacgggtacccgaaaggggttacgaagtacgttaccgaaggtaacgtaacgtggtacgtcgtacgcctaaccg

SEQ ID NO: 12026 - DNA, 646 bp, Homo sapiens
  misc_feature: GYAE6OF02I608D.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagatcacatcactgccggcgagtcaggacattaacatagtatactgaattggtatacagacaacgaaaccgacgggaaaccacccctaaactcctagactacctacgatcgactaactacctaacgtttaggaacgtacggggtacccaacgtacgtaaagggttcaggtagggtaagtgggacttacggtacgggtaactaggttaactttttacctttaccaccttagtacccgaccgtaagtaccgtgacccgaagtccggtaagaaacgtattagttacgaacctaatacttacttactcgtaacctaagtagttagtagtaacttaacttcccgtaccgtacgttcgtaccggtttccgggacgggtaacgggtaaccgtaagggggttacgacggtaacgtacggtaacgaacggtacggttgggacggccttacggaccctaacg

SEQ ID NO: 12027 - DNA, 672 bp, Homo sapiens
  misc_feature: GYAE6OF02JJNKF.52.2.A02.1.454.CMB.1.raw
  modified_base (182)..(182): a, c, t, g, unknown or other
  misc_feature (182)..(182): n is a, c, g, or t
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (282)..(282): a, c, t, g, unknown or other
  misc_feature (282)..(282): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcgaggtgccagatgtatcatccagatcgaaccctagttctccactcccttcccngttctagctatcgtaataggagaccagaatccaacctatctacgttggcccgggnagtcgaacgtaactacttaacgnttagtatctagtaattggtatnagcaagaaccaggaacaccctaactacctcgatccacgatcgacactactaaggttacgaaaccggtacgggtaccacgtacgtaacggttcgaggtacgtaggtcgtcgtacggaagggtacgttaagttacttttacgtaccacgtactcgaccgtagtacgtcgacgtagccgttaagacgtagtttagtacgtaccaaattaccgttatttaaccggtcgtaactaaacgtagtaagttacgtaaattaaccgtcccgttacccgtaaccgtttgttaacccgttcgggggaacccgggttaagggacccggttaagggtaacggtacggtaactacgtaacggtaaccgtacggttacgggtcggtaccgtacgacggtaacccg

SEQ ID NO: 12028 - DNA, 748 bp, Homo sapiens
  misc_feature: GYAE6OF02H900C.52.2.A02.1.454.CMB.1.raw
  modified_base (198)..(198): a, c, t, g, unknown or other
  misc_feature (198)..(198): n is a, c, g, or t
  modified_base (205)..(205): a, c, t, g, unknown or other
  misc_feature (205)..(205): n is a, c, g, or t
  modified_base (226)..(226): a, c, t, g, unknown or other
  misc_feature (226)..(226): n is a, c, g, or t
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcatccagatcgacccagtcctccactccctccctgtctgacatctagaggganacaaganccactatcacgtcggccgggngagcacggataactaacatgtatcgtagtaattgtatcgagacaacggaaaaccgaaggaacccgacccccttaaactccgtagacctcctcgacgttcgactaacttaccttaaaggtttaacggaaaaccggtaccgggtacctaacgttaccgtaaagggttacgtaagggtacggtaaggtcggtccgttacggtaggtaacgttaacgtttatttttaccgttaacctaccgtacgtaccgtaccgtacgtaccgtaacgtcgtacgtacccgtaaagaacggttaaacgttaacgttacgtaaactaaaccgttaactttaaacttccgtaacgtaaacgttaaaacgtacggttaataacgaaactttaaccgtaccccgttcccggtaacccttcccggtttaacccggggttcggaacccggggtaaccgggttaacggaaggtaaggaacgtaacgtaaccggaacggtaccgttaacggtcgggtaaccggcgttaacccggacctaaccg

SEQ ID NO: 12029 - DNA, 740 bp, Homo sapiens
  misc_feature: GYAE6OF02H3QZO.52.2.A02.1.454.CMB.1.raw
  modified_base (180)..(180): a, c, t, g, unknown or other
  misc_feature (180)..(180): n is a, c, g, or t
  modified_base (219)..(219): a, c, t, g, unknown or other
  misc_feature (219)..(219): n is a, c, g, or t
  modified_base (242)..(242): a, c, t, g, unknown or other
  misc_feature (242)..(242): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtcctccatccctcctgtcngcatctagagagacagaatcacctatcacttcggccggngtacgtcgaaggactaattaacntgtatctagtaattgtatcgagacgaagaaaccgaaggaaacctacccctaatcccgtagacctacgtacgtatacgtactaacgtaccgttaaagttacgggaaacgtaccgggtacctaacgttacggttaaacggtcgtaaggtacggtagtacgggtaccgtaccggtaagggtaacttaaggtttaccttttaaccgttacgaacccgtagtcccggtacaacgggttcacggcgtaacgtccgtaaggaactattaacgtacgaaactaacgttaactttaacgttacgtaacggttaacaaaccggttagtaaacttacggtaaacctttaacctcccgttacccgtactaccggttttaaccgggttcgggaaccgggtttaacgggaaccggtttaagggaaccggtaacgttaccgtaaaccggtaacggttaaccggtaccggtttagggtaacccggggtactttaccgggaccctttaacccggg

SEQ ID NO: 12030 - DNA, 562 bp, Homo sapiens
  misc_feature: GYAE6OF02HUH1K.52.2.A02.1.454.CMB.1.raw
  modified_base (255)..(255): a, c, t, g, unknown or other
  misc_feature (255)..(255): n is a, c, g, or t
  modified_base (360)..(360): a, c, t, g, unknown or other
  misc_feature (360)..(360): n is a, c, g, or t
  modified_base (389)..(389): a, c, t, g, unknown or other
  misc_feature (389)..(389): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatccaccatcattcgccgggcagtcaggacattaacatagtatctgaatggtatcagnagaaaccgaggaaacgacccctaaactcctagactcctacgatgcactccaatttacggaaacgacggggtaccataccaagtttcgagtggtaagtgccgttgngggactagtacttttacttcacagtcacngactgactagacctgaagtatattagacaactaataacttactacgtacaaacgtagttaatagtaactattaccgtacccgtcttaacttacgttcgggacggtaacgggtaaccgaagggtcggaatagtaccgaaggtaccgtaacgtcggtacggcgtacgctaacccg

SEQ ID NO: 12031 - DNA, 652 bp, Homo sapiens
  misc_feature: GYAE6OF02HK85N.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccactccctcctgtctgcatctagtaggagacagaatcaccatcacttcggccgggcgagtacgaggactaattaacatagtatctagtaattggtatcgagacaaggaaaccgaacgggaaaaccacccctaaaccgtcccgtaacttccgtacgactcgactactactaagttacggaaacgtcgggtaccctagtacgtaaggttcgaaggtagggtacgtggtactacgggtacgggtacgttaagtttaacttttaccgttaaccaccgtacgttaccgaccgtaacgtcgtcggacgacgtacgtaggtaatagttactacggaactaacttaagtttactacgtataacctaagtagttaatagtacttaacctccgtaccgtcttaccgtaccggttccgggaacggtacggaaccgtagggtagaacgtacgtacgtaacggaacgtcggttcggcggtacctacggtacctcgtaccg

SEQ ID NO: 12032 - DNA, 734 bp, Homo sapiens
  misc_feature: GYAE6OF02H3Y26.52.2.A02.1.454.CMB.1.raw
  modified_base (202)..(202): a, c, t, g, unknown or other
  misc_feature (202)..(202): n is a, c, g, or t
  modified_base (229)..(229): a, c, t, g, unknown or other
  misc_feature (229)..(229): n is a, c, g, or t
  modified_base (524)..(524): a, c, t, g, unknown or other
  misc_feature (524)..(524): n is a, c, g, or t
tcagcgcagtacgacacgaccggtgctcgatttagactcatctacagggggggagtcagtcccaaccaggacacagcatggacatggagggtccctgctcagctccgtggggcctcctgctgctctggctctcgaggtgccaggatgtactcatccagatcgacccagtctccactccctccctgtctgcatctagtagganacagatcaccatcacgttcggccgggngagtccgagactaattaacattcgtatctagtaattggtactcgagacaacggaaacgaacgggaaccctaccctaaacgtcctagtacctacctacgatcgtactactacccgttaagttacggggaaaccggtacgggtccctaagtaccggtaagttacggtaaggtagggtaagtcggtacgtacgggttaacgggtacttaaggtttaactttttaccctttaccgaccgtttaacgccccggtaccgtaacggttaccgtcggacccgtaacggtcaagggtaaacgtntttaacggtacgaaactaactactttaacgtttacaacggtaactaaacggttagttaacgtacgttaaacttacccttccgttaccccgtcgttaccggttaacgggtttcccgggaacgggttaacgggtaacgggtaaggggttaaccgattacggtaaccggaacggtaccgggttagttcggaccgggtacctacgtaccctacg

SEQ ID NO: 12033 - DNA, 696 bp, Homo sapiens
  misc_feature: GYAE6OF02HOFRI.52.2.A02.1.454.CMB.1.raw
  modified_base (643)..(643): a, c, t, g, unknown or other
  misc_feature (643)..(643): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgctatctagtaggagacagaatcaccatctaacgttcggccgggacgacgtacgaggaactaagttaacattggtaattctagtaagttggtattcgagaccgaaagaaaacccgaagggtaaacccaccccttaaactccgaggaccttaccgtacggtactcggacctagtaccgtaagtttaacggggaaaaccgtacggggtacccctaagtacggtaagggtttaccgaagggttagggtaacggtcggcgttaccgggaggggtaactacggttaactttttaccgttaccaccgtaacgttccgaccgagtacgtcgaactacggtacctaaggaaattcgttaagtaggacaaacttattaccttagtacggttacaaagtagttaactgaaacttacgttccccgtaccggtattaccgggtttaccgttcggggaacgggtccgttaaaccggngggtagtacaacggtcgaacggtactaggtagtccgggactcggaaccctacg

SEQ ID NO: 12034 - DNA, 666 bp, Homo sapiens
  misc_feature: GYAE6OF02GDT0P.52.2.A02.1.454.CMB.1.raw
  modified_base (191)..(191): a, c, t, g, unknown or other
  misc_feature (191)..(191): n is a, c, g, or t
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctatagganacagaatcaccatcacgttgccggnagtcaggacaattaacatgtatactagaattggtatcgagactaacgaaaccgtaagggaaacgacccctaaactcctagactcctacgatcgcactaccgtaattacggaaacgacgggtacccagtacgaacggttacgaggtaggtaagtcggtcgtcgtacggtaactagttacttttactttaccacctacgtaccgtccgagtactcgaccgacgtaccgtagaacgtacttattaacggactaaacgtattaacttaaccgttacgtaccgtaaacgttaagttagttaacgtaacgttaacttacccgtacccgttaccgttaccgttaccggtttaccggggaccgggtaacgggaacccggtaaaggggtccggtaaaggtacgtacgaacggtaccgttaacggttaccgggtacggtccgttacggacccttaacccg

SEQ ID NO: 12035 - DNA, 659 bp, Homo sapiens
  misc_feature: GYAE6OF02G50DD.52.2.A02.1.454.CMB.1.raw
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctcctgtctgcatctataggagacagaatcaccatcacttcgccggnagtcaggacataacatgtatctagaattggtatcagacaacgaaaccgagggaaaccgtacccctaaactcctagaccttccgtacgacgtcgactactacctaagtttacggaaaccgtacggggtacccaagttaccgtaaaggtttcgaaggttagggtaagtacggtcgtacggtagggtaactaggtttacttttaccgttacaccgtacgtaccgacctaagtaccgtgaccgtacgtaccgtaagtaacgtattacgttacgaactaacttaattaactttacgtacgtactaaacgtagttatagtaaacttaccttacccgttccctacttaccgttaccggtttaccggggaccggtaagggtaaccggtaaggtcggtaacgtacgtacggaacgacggttaacggttcggacggtacgtacgacctaccgg

SEQ ID NO: 12036 - DNA, 641 bp, Homo sapiens
  misc_feature: GYAE6OF02IE3EO.52.2.A02.1.454.CMB.1.raw
  modified_base (496)..(496): a, c, t, g, unknown or other
  misc_feature (496)..(496): n is a, c, g, or t
  modified_base (628)..(628): a, c, t, g, unknown or other
  misc_feature (628)..(628): n is a, c, g, or t
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcatccagatgacccagtcctccatccctccctgtctcgcatctagtaggagacagaatccaccatctacttcggccgggcgacgtcaggtaactattaacatgtatctagtaattggtactgagacaagaaaccgaaggaaccgaccctaactccgtagactcctgactgtcactacctaagttacggaacgtacgggacctagtacgtaaggtctaggtaggtaagtcggacgtcgtacggtatacgtttacttttacttccgacctacgtccgactagactcgatacgcctagaatattaagttacgactaacttacttaacgttactacgtacaaacgttacgttaanacgttaattaaccgttccctaacccgtacttaccggttaccggtttaccggggacggtaacggggtaacccgtaaggggttacggagttaaccgtaaccgaagggtacccgtaaggttcgggtacggttacnccgtaccgtaccg

SEQ ID NO: 12037 - DNA, 622 bp, Homo sapiens
  misc_feature: GYAE6OF02HK7F0.52.2.A02.1.454.CMB.1.raw
  modified_base (220)..(220): a, c, t, g, unknown or other
  misc_feature (220)..(220): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtcctccatccctccctgtctgcatctagtaggagacagaatcaccatcacttggccgggnagtcgaggactattaacatgtatctgtaattggtatcagacaagaaaccgaagggaaacacccctaaactcctagactcctcgtatcgctataccgtaaagtttacggaaacggtacggggttaccctaagtacgtaacggtttcgaaggtagggtaaaggttcggcgttacggtagggtaactaggtttaactttttactttaccgacctacgtcccgaccgtaagtacgttcggaccgtaacgtaccgttaggaaagttacttaagttacgactaaactattacttactgtaacaacgtaatatagtaacttactcctccgtactacgtacgttcgggacggtacggaccgtaagggtcgagtacacgaagaacgtacgtggtacggactcgactaaccg

SEQ ID NO: 12038 - DNA, 698 bp, Homo sapiens
  misc_feature: GYAE6OF02GQRI6.52.2.A02.1.454.CMB.1.raw
  modified_base (190)..(190): a, c, t, g, unknown or other
  misc_feature (190)..(190): n is a, c, g, or t
tcagcgcagtacgacacgaccggtgctcgatttagactcatctacagggggagtcagtcccaaccaggacacagcatggacatgagggtccctgctcagctcctggggctcctgctgctcttgctctcaggtgccagatgtatcatccagatgacccagtctccatcctccctgtctgcatctatagganacagatcaccatcacttgccggcgagtcaggacattaacatgtatctagtaagttggtatcgagacaagaaaccgaagggaaacgaccccctaaactcctagactcctacgatcgacactaccgtaagtttacggaaacgtaccgggtacccataaccgtaaggttacgaggttaggaacgtcggtctacgtagggacttaaggttactttttaccttactaaccgacttcccgggtacctaagtacgtcgactacggtacctaaggtaaactattaagttacgacctaaacttaattaacgtttacctagtaccaaacggtagttaacgttaagtaacttaaccttaccctcccgtaccgttttaaccgtaaccgggtttaccggggtaccggggtaacgggtaaacccggttaaacggggtaggttaaacgtaaccgttaacggaaacccgggttaacgtaacccggtttggggtaccggtacccttacgggtacccctaaaccgg

SEQ ID NO: 12039 - DNA, 815 bp, Homo sapiens
  misc_feature: GYAE6OF02FTTVC.52.2.A02.1.454.CMB.1.raw
  modified_base (245)..(245): a, c, t, g, unknown or other
  misc_feature (245)..(245): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatccaccatccacgttgccgggcgagtcaggacattaacatgtatctanaattggtatcagacacgaaaccagggaaacgcccctaaactcctagacttcccgcgtatcgactacgttacctaaagttttagggaaaaccgtaacggggttccccaaagttacgttaaacgggtttcgaacggttacgggaaaggttcgggccgttaccggttaagggggaaccttaggttaaccgtttttttaaccctttaccggtaaaccctagtttcccgacccgtaacggtaccgttacggtaccgacggtacccgttaagggaaacggtaacgttttaacgttttaccggaaaccttaaaaccgttaaacgtttaaaacttttaccgtttaaccggttaaaccgttaaaaaacggttaacggttttaaacgttacggtttaaaaccgttaaaaccgtttcccccgttaacccccgttacgtttaccccgtaaccgggtttttacccggggaccgggggtaaacggggtaacccggttaaaggggtaacgggttaacgacggttaaccgtaacgggttaaccgaacggtttaccggtaggggccttaccggacccttaaacccgg

SEQ ID NO: 12040 - DNA, 682 bp, Homo sapiens
  misc_feature: GYAE6OF02F5ZZ4.52.2.A02.1.454.CMB.1.raw
  modified_base (192)..(192): a, c, t, g, unknown or other
  misc_feature (192)..(192): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctatagganacagtaatcaccagtcacgttggccggcgtagtcgaggactattaacatgtatcgtagtaagttggtatcgagacgaacgaaaccgaacgggaaaccgtaccccctaaaccttccgtacgtaccgtcctaacgtactcgacctacgtacccgttaagttacgggaaacccggtacgggtacccctaagttacgtaaacggttcgtaaggtacggtaaggttacggtaccgttacgtacggggtacttaaggtttacttttacgtacctactacgtaccgacacgtactcgcacgtcgtagtagtatatcgtactacgtattacttacgtactacgtaagacttataggtaaacttcgttaccctcccgtacttaccgttaccgttaccgggtaccggtaccgggtaacccggtaagggtacggtaacgttacggtaacgtacggtaaaccgtacggttaccggtcggtaacccgtcggaacccttaaccg

SEQ ID NO: 12041 - DNA, 772 bp, Homo sapiens
  misc_feature: GYAE6OF02G5KC5.52.2.A02.1.454.CMB.1.raw
  modified_base (218)..(218): a, c, t, g, unknown or other
  misc_feature (218)..(218): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccactcctccctgtctgcatctataggagacagaactcaccatcacttcgccgggngagtcagacattaacatgtatactagtaattggtatcagacaacggaaaccgaagggtaaaccgacccctaaaacttccgagtaacgtcctacgtagtcgacctaactaccgtaagtttacggaaaacgtaccggggtaccaacgtacgtaacggttacgaacggtagggtaacggttggtaccgttacggtaaggggtaaccgtaagtttaacgttttttaccgtttacctaacccgttaccgtacccggtaccgtaaccggtacgttaccggaaccgtacggtacccgttaagaaacggttaactttaacgttacgtaaaccgttaaaacgttaacgtttaaacgtttacgttaacgtaaccgttaaaacgtaacggtttaagtaaacgttaacttaacccgttcccgttaacccgtctttaaccggtttaaccggtttaccgggggaccggggtaaccggggtaaaccggtaagggttacggtaaacggtacgtaacgtaacggtaaccgtaaccggttagggtaccggttacgtaccggtacctaacccg

SEQ ID NO: 12042 - DNA, 628 bp, Homo sapiens
  misc_feature: GYAE6OF02HPXCV.52.2.A02.1.454.CMB.1.raw
  modified_base (220)..(220): a, c, t, g, unknown or other
  misc_feature (220)..(220): n is a, c, g, or t
  modified_base (283)..(283): a, c, t, g, unknown or other
  misc_feature (283)..(283): n is a, c, g, or t
  modified_base (500)..(500): a, c, t, g, unknown or other
  misc_feature (500)..(500): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctataggagacagaactcaccatcacttcggccgggnagtcaggactattaacatgtatctagtaattggtatcagacaacgaaaaccgacgggaaaccnccccctaaaactccgtagactcctcgatgcactactaagtttacggaacgtacgggtaccagtacgaaggtttcaggtaggaagtggacgttcgtagggtaactagttactttttaccttacctacctagtcccgactaacggtactcgacgacgcgttagaagtattagtacgaacctaacttacttaacttacgtacgtactaaacgtaagttanacgtaattaaccttccctacccgtacttaccgtaccggtttccgggacgggtacggaccggtaagggttcgaagtacgtaccgtaacggtaacgttacgtacgggtcggtaccgttcgaccctaacgg

SEQ ID NO: 12043 - DNA, 702 bp, Homo sapiens
  misc_feature: GYAE6OF02IVFYZ.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtcctcactcctcctgtctgcatctataggagacagaatcacatacacgttcggccgggcagtcgaggactataacatagtatctagtaattggtactacgacgtacgaacggaaaccgtaacggggaaacctaccccttaaaccgtcgtacgtacctacctagtagtctactacgttaactaaggttacggaaacggtcggtacctacgtacgtacgtacgtaggtacggtacggtggtacgtaggtacgggtactaacggttttacttttacgtaccaaccgtttaccgcgtaaccggtaggcttacgaccgtacggttacgttaaggtaaatattaggtaaccaacgttaactaatttaacgtacgtaactaacctaaacggttgtaaacttacgtaaacttacccgtcccgtttacctacggtttaaccccgtagggttccgggaccggggaacggtacccgggttaaggaacggtaacgttactacgggaaaccgttacggtcgggtacggttaccgacgttcccgaccttaaccgg

SEQ ID NO: 12044 - DNA, 745 bp, Homo sapiens
  misc_feature: GYAE6OF02HXJA7.52.2.A02.1.454.CMB.1.raw
  modified_base (131)..(131): a, c, t, g, unknown or other
  misc_feature (131)..(131): n is a, c, g, or t
  modified_base (194)..(194): a, c, t, g, unknown or other
  misc_feature (194)..(194): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcnggtgccagatgtatcatccagatgacccagtctccatcctccctgtctgctatctagtagganaacagaactccaacctatcctacgttcggccggggactacggtacgaggactaattaactagtcgttagtctaggtaatttggtaactacgaagccaaacggtaaaccggaacgggaaaccctaccccgttaaactccgtagtacctccgtacggtaatcgaccttaactacctttaagttaacgggaaacgtaccggggtacctagtacggtaaggttacgaggtacggtaacggtcggtaccttacggtagggtaactaaggttttactttttaccgttaccactagtaccggtaccctagtacctcggactacggtcctaagaacgtatacttacgaacctaaattacttaacttacgacgttaacaacgttaaggttacgtaaactaacgtttacttcccgtaccccggttattaccccgttacgggttaccggggtaacggggtaaccgggtaacccggttaaggggaccggttaacggtaaccgtacggaaaccggttaccggtaacggtttgggtacggtaccccgttagaccccgttaaccgg

SEQ ID NO: 12045 - DNA, 671 bp, Homo sapiens
  misc_feature: GYAE6OF02FSC46.52.2.A02.1.454.CMB.1.raw
  modified_base (193)..(193): a, c, t, g, unknown or other
  misc_feature (193)..(193): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatcgacccagtctccatcctcctgtctgcatctagtagganacagaatcacctatcacttggccgggcagtcaggacaattaacatgtatctgaattgtatcagcaacgaaaccgaggaaaccgacccctaaacgtctacgactccgtacgatcgactactactaagtttacggaacgtacgggtacctagtacgtaacggttgaaggtaggaaggtcggtacgtcgtaggggtactaggttactttttaccgttacgtaccgtacgtaccggaccctagtaccgtacggaccgtaacggtacccttaaggaaacggttacgttaacgttaacggaaccttaaacttaacgtttaacctttacggttaccgtaacgtaaaccgtaaggttaaccgttagtaaaccgttaacttcccgtacccgtacttacgttaccggttacgggacgggtacgggtaacgtagggtacgtaacgccgtagaaccgtaacggtactcgggtacgtcttaccgctaaccg

SEQ ID NO: 12046 - DNA, 624 bp, Homo sapiens
  misc_feature: GYAE6OF02FYAIB.52.2.A02.1.454.CMB.1.raw
  modified_base (215)..(215): a, c, t, g, unknown or other
  misc_feature (215)..(215): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggnagtcagacattaacatgtatctagaatttggtatcagacaacgaaaccgagggaaactccccctaaaactcctagaactcctacgatcgacattacctaaagtttacggaaaccgtacggggttacccaagttaccgtaaaggtttccgaaggtagggtaacgttcgggccttacggtacgggtaactaacggtttaacttttttaaccgttacctaaccgttactcccgaccgtaacgacttcgactacgcccgttaagaaagtacttattacgacctaaatattaacttactcgtaacaacgtagttactagtaatacttcctacctcttctacggttcgacggtacggacggtaaggtgaacgtactacgaacgtacgtaacgtggacgtaccgtagacctaaccg

SEQ ID NO: 12047 - DNA, 766 bp, Homo sapiens
  misc_feature: GYAE6OF02FXFC7.52.2.A02.1.454.CMB.1.raw
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggnagtcaggacattaacatgtatctgaattggtatcagcaagaaaccgagggaaacgacccctaaactcctagactcctacgatcgacacttacctaaagttttacggaaaccgtacgggggtcccctaagttaccgtaaacgggtttcctaagggtagggtaaggtcgggtacgttacgtacggggtaactaacggttaacgttttttaacctttaccgtaaccctagttacccggacccgtaaggtaaccgttcggacctaacggtaccctagggtaaacgtacttaacgtttacggaacctaaaacgttaactttaaacttttaaccgtacggtttaaccctaaaccgttaaaggtttaacgtttaacgggttaaactttaaaccgtttccccttaaccccggtaccgtttacccgtttaacccgggttttacccgggggacccgggtaacgggggtaaacccggtaaaggggtacgggtaacggtaacgttaccgtaacggtaaccggtaaccgttgggtaccggtcgttacggtacccgtaacccgg

SEQ ID NO: 12048 - DNA, 682 bp, Homo sapiens
  misc_feature: GYAE6OF02HOXFA.52.2.A02.1.454.CMB.1.raw
  modified_base (194)..(194): a, c, t, g, unknown or other
  misc_feature (194)..(194): n is a, c, g, or t
  modified_base (668)..(668): a, c, t, g, unknown or other
  misc_feature (668)..(668): n is a, c, g, or t
tcagcgcagtacgacacgaccggtgctcgatttagactcatctacaggggggagtcagtcccaaccaggacacagcatggacatgagggtccctgctcagctccgtggggctcctgcctgctctggctctcaggtgccagatgtatcatccagatgacccagtctccatccctccctgtctgcatctatagganacagaatcaccatacgacttcggccgggcaagtcaggtacattaacatgtatctagtaattcggtatcgaagacgtaaggaaaacccgaaggggaaacctacccccttaaaactccgtacggtaacctcccgttacgacgttacgacctaacgtacccgttaaagtttaaccgggaaaacggtccgggtacccaacttaccggtaaggtttaccgaagggttagggtaaacggtcggaccttcgggtacgggtaactaaggtttactttttacttacccaccgttacgccgtaaccaggtaccctgacccgtagtacctagaacgtattacttagacctaactattacttaccgggtatactaaacgtattagtagtaacttacgtccctcccgttataccgttaccgttacgggcgggaacgggaccttaaggggacgttacgacgtaacgacggtacgacgttcggccggtnaccggtactaccgg

SEQ ID NO: 12049 - DNA, 665 bp, Homo sapiens
  misc_feature: GYAE6OF02GDS7Q.52.2.A02.1.454.CMB.1.raw
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcatccagatgacccagtcctccatccctccctgtctagcatctaataggagacagaactcaaccatccacgttcggccggggacgagtaccgaggaactaatttaaacagttagtatctagtaatttggtaatcgaagacaacggaaaaccgaacgggaaaacgacccccttaaactcctagactcctacgatcgcaacttactaaagtttacgggaaaccgacgggttacccaagttacgaacggttcgaggtagggagtggtctacgtaggactagttactttttaccgtacacctagtccgacgacgtacgtcgacgtacgtacctaggaaactattagttacgactaaactattaacttacttaggtaacaaagtacggtatagtaaacttaacctccgttccccgtactttacgtaacccggtttacggggacgggtaacggtaaccgggtaagggtaggaacgtacgacggaagtaaccggtagttaccgggtagtcgttaccggacttaaccg

SEQ ID NO: 12050 - DNA, 806 bp, Homo sapiens
  misc_feature: GYAE6OF02IT0UB.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtcctccattccctccctgtctgctatctagtaggagacaagaactccaccatcacgttcggccgggtcgagtcaggactaattaacatagtatctagtaattggtatcagacaacggaaacgaagggaaaccgacccctaaactcctagacttcctacgagtcgctaactacctaaagttacgggaaaccgtaacggggtcctaagtaccgtaaggtttccgaaggtaggtaaggttcggtaccttcggtacgggaacttaagtttacttttttaccgttaccaaccgttacgtaccgaccgtaacgttaccgtacggtaccgtaccgtacccgtaagaaacggttactttaacggtactaaaccgtaaacgttaacgttaaactttacgtacgttaaccgtaaacgttaaacggtttatttaaacgaacgtttaaccgtttcccccgttaacccggttaccgtttaacccgggttaccgggtttttacccgggggaaccggggttaacccggggttaaccggttaaacggggttaccggggtttaacggggaaaccgtttaaccgggttaaccgggtaaaccggttaaaccggttaaaccgggttttccggggttacgggtaccccggttcgtaaacccccggg

SEQ ID NO: 12051 - DNA, 663 bp, Homo sapiens
  misc_feature: GYAE6OF02IX0U4.52.2.A02.1.454.CMB.1.raw
  modified_base (208)..(208): a, c, t, g, unknown or other
  misc_feature (208)..(208): n is a, c, g, or t
  modified_base (432)..(432): a, c, t, g, unknown or other
  misc_feature (432)..(432): n is a, c, g, or t
  modified_base (459)..(459): a, c, t, g, unknown or other
  misc_feature (459)..(459): n is a, c, g, or t
  modified_base (481)..(481): a, c, t, g, unknown or other
  misc_feature (481)..(481): n is a, c, g, or t
  modified_base (546)..(546): a, c, t, g, unknown or other
  misc_feature (546)..(546): n is a, c, g, or t
  modified_base (569)..(569): a, c, t, g, unknown or other
  misc_feature (569)..(569): n is a, c, g, or t
  modified_base (631)..(631): a, c, t, g, unknown or other
  misc_feature (631)..(631): n is a, c, g, or t
  modified_base (640)..(640): a, c, t, g, unknown or other
  misc_feature (640)..(640): n is a, c, g, or t
tcagcgcagtacgacacgaccggtgctcgatttagactcatctacgagggggggagtcgagtccaaccaggacacagcatggacatcggagggtccctgctcagctccgtggggctccgtgctgctcctggctctcgaggtgcctagatgtatcactccagatcgacccagtctccagtccctacctgtctgtcattcgtatacgganactaagactcaacctatccgtacgttcggccggacgtacgtcgaggtacctaattaacgtatcgtaatctaggtaacttggactccgtagacgaaagtaaaccggtaacgggaaaacccgttccccttaaacgtccgtcggaaccttcccgtaaggacttcgaacctacttaaccgtaaggttacgaaaccgggttccggacacgtacgagttgacgttaggcngtctgttagcttagttactttcctacnttaccgtccgtacgaacgttcncgaccgtgtaccgtaaggagtaacttcggtaacacgtactagttacgtcccgtagtaacaaaccnggtttaacccagtttacctaacnccctttagacccgttaatccggttacgggacgaaggtaccggtagttcggaactcgtaacgnggtaaccgngttcggattccgggataccctag

SEQ ID NO: 12052 - DNA, 727 bp, Homo sapiens
  misc_feature: GYAE6OF02IKY7D.52.2.A02.1.454.CMB.1.raw
  modified_base (193)..(193): a, c, t, g, unknown or other
  misc_feature (193)..(193): n is a, c, g, or t
tcagcgcagtacgacacgaccggtgctcgatttagactcatctacagggggagtccaagtcccaaccaggacacagcatggaccatgagggtccctgctcagctcctggggctcctgctgctctggctctcaggtgccagatgtatcatccagatgacccagtctaccatcctcctgtctgcatctatagganacagaatcaccatcacgttcggccgggcgacgtcgaggactaattaacgaagtgtagtacttggtaactttggtattacagtacgaacggtaaaaccgtaggggaaacgtaccccctaaaaccttcccgtacggtaccctacgactcgacctacgttacctaaggttttacggaaaccgtaccgggtacccaagttaccgaaaggttcaaggtacggaaaggtcggacttcggtagggtaacttagttacttttaccgttacacctatcgacagtacctagacccgagtaccgtagtaagtacttagtacgtaaccgtaaacgttaattactttaacctcggtaacctaaacgttacggttaatacgttaacttaacgttccctacccggttacctacggttaaccgtttaccggggaacgggttaccgggaaccggtttaacggggtacgtaaccggtacgtaaccgtaaaccggttaccggttaaaccgtcggggttaccgtaccgttacggtaccccgtaaccccgttagg

SEQ ID NO: 12053 - DNA, 692 bp, Homo sapiens
  misc_feature: GYAE6OF02INA8D.52.2.A02.1.454.CMB.1.raw
  modified_base (259)..(259): a, c, t, g, unknown or other
  misc_feature (259)..(259): n is a, c, g, or t
  modified_base (311)..(311): a, c, t, g, unknown or other
  misc_feature (311)..(311): n is a, c, g, or t
  modified_base (562)..(562): a, c, t, g, unknown or other
  misc_feature (562)..(562): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccatcctcctgtctgcatctataggagacagaatcaccatcacttcggccgggcgagtcaggacaattaacagtgtatctaggaacttggtactnagacaagaaaccaagggaaacgacccctaaactctcgacttcctcgtacgtnactactcctaaatttacggaaaacgtacggggtccaagtacgtaaaggtttccaaggtacgggtaacggtggtccgttgtacggggactaacggttactttttaccgtttacctaaccgtacgtacccgtaccgaacgtacttcgaccgtaagcccgttaggaaatcgttaattacgaacaaacgttaattaactttacgtacgttaacgaaactaaggttactaagttaaacgttaacctcccgttaccnccgtttaacccgtacggttttacggacgggtaacggtaaccggtaagggttacggtaacggtaacttccggtaaacggtaaccggttaacgttaccggggtaggttacccgtaggtaaccccgttaaccg

SEQ ID NO: 12054 - DNA, 758 bp, Homo sapiens
  misc_feature: GYAE6OF02GO1RJ.52.2.A02.1.454.CMB.1.raw
  modified_base (192)..(192): a, c, t, g, unknown or other
  misc_feature (192)..(192): n is a, c, g, or t
  modified_base (216)..(216): a, c, t, g, unknown or other
  misc_feature (216)..(216): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgccatctatagganacagaatcacatcacttgccgggnagtcaggacattaacatgtatctagaattggtatctagctaagaaaccaggggtaaacgcccctaaacgtcctagaactcctacgaatgacctactaccctaagtttaggaaaccgtagggggtacccctaagtaccggtaaagggttttaccacggttaggggaaagttcgggtccgtacggttacgggggaactacgggttaattttttaccgtttaacctacccgtacgttacccggacccgtaaggtaccttacggaccctacggtacccgtaaggtaaacggtactttaacgtttacggaaccttaaacgtaaagtttaacttttaaccggaggttaaccctaaacggaaacgttttaagtacgtaaactttaacgttacccggttaccccgtacgtttaacgttaccccgggttttacggggtacccgggtaacggggtaaccccgggttaaagggttaccggggaacgttaacgttcccggaaacggtaacccgttaaccggtttcgggtagtacccggtacgacccgtaacccg

SEQ ID NO: 12055 - DNA, 344 bp, Homo sapiens
  misc_feature: GYAE6OF02I571R.52.2.A02.1.454.CMB.1.raw
  modified_base (317)..(317): a, c, t, g, unknown or other
  misc_feature (317)..(317): n is a, c, g, or t
  modified_base (322)..(344): a, c, t, g, unknown or other
  misc_feature (322)..(344): n is a, c, g, or t
tcagcgcagtacgacacgaccggtgctcgatttagactcatctacagggcacgaccggtgctcgatttagactcatctacagggtcccatcaaggttcagtggaagtggctctgggacagattttactttcaccatcgccagactgcagcctgaagatattgcaacatattactgtcaacagtatgataatctcccgcttcactttcggcggtaggaccaaggtcggagatcagacgaactgtggctgcacatctgtcttcatcttcccgcatcgtgatatacgatcgcctgacggcggctaggcgaaggcgtacanagcgnnnnnnnnnnnnnnnnnnnnnnn

SEQ ID NO: 12056 - DNA, 789 bp, Homo sapiens
  misc_feature: GYAE6OF02IUQKI.52.2.A02.1.454.CMB.1.raw
  modified_base (187)..(187): a, c, t, g, unknown or other
  misc_feature (187)..(187): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgaccctagtctccatccctcctgtctgcatctanaggacgacagaatcacatcacgttcgccggacgagtcaggacaattaacattgtatcgtagtaacgttggtatcgagacaacgaaaaccgaggaaacgtacccctaaactcccgtagactcctacgatcgtctaactaccgttaagttacggaaaccgtacggggtccctaagtacctaaacggggtttacaagggttacgggtaaggtcggaccgttaggtaagggggtaactaacggttttaacttttttaccgttttacccgaacccgtacgttaaccgaccgtaacgaaccggttacgtacgtaacgtacccggtaagttaaaacggtatttacgtttacgtaaccgttaaaactagttttaaaaccgttaccgtacgtttaaacccgtaaaagttaaccgttaaggtaaactaaccgttaaccgttaccccgttaccccgttcgtttaacccgttaacgggtttaccccgggggtacggggtaaaccggggtacccggttaaaaggggttacggggtaacgtaacgttaaccgtaacggtaaacccgggttaaccgtttaggggttacccgggactaccgggacccttaaacccggg

SEQ ID NO: 12057 - DNA, 705 bp, Homo sapiens
  misc_feature: GYAE6OF02HCW3R.52.2.A02.1.454.CMB.1.raw
  modified_base (335)..(335): a, c, t, g, unknown or other
  misc_feature (335)..(335): n is a, c, g, or t
  modified_base (352)..(352): a, c, t, g, unknown or other
  misc_feature (352)..(352): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcagtccagatgaccctagtcctccactcccttccctgtctcgactatactaagtaggagaacaagtaactccgaacctatcacgttcggccgggacgacgtcgaaggactaagttaacagttacgtaatcgtagtaaacttggtactacgagacgaaacgaaaccgaacgggaaaccgaccccttaaacnccgtagaactcccgtanagtcgactaacttaccgtaagttacggaaacgtcgggtacctagtacgaacgttcgaaggtaggagtcggcgtgtaggactagtttactttacttacactagtccgacagctagcaacgtcgtaagtagtaacgttatacggtactaaacgttattaacgtttacgtataacgaaagttaaggtattaaacgtaacttaaccttcccgtacccgttacttaccggttaaccggtttaccgggggacggtaacggggtaacccgtaaggggttaacggtaacggaaaccttcgggtaaacgtaaccgggttaaccggtttcgggtaacggtcccggtaacgtaccctaacccgg

SEQ ID NO: 12058 - DNA, 749 bp, Homo sapiens
  misc_feature: GYAE6OF02FGOGB.52.2.A02.1.454.CMB.1.raw
  modified_base (214)..(214): a, c, t, g, unknown or other
  misc_feature (214)..(214): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctcctgtctgcatctataggagacagaatcacatcacttgccggnagtcaggactattaacatgtatctagaatttggtatcgagacaagaaaccaagggaaacgacccctaaaactcctagactacctcgtatcgactacttacctaaagtttacggaaaacgtacggggtacccctaagttaaccgtaaagggtttaccaagggttacgggaaacggttcgggtaccgttaccggtagggggtaaacctaaggtttaacttttttaaccgttttaccaaacccttaacgttaacgacccggtaagaacccgttacggaccgtaacgtacccgttaaggaaaacgtattttaacgtacgtaaccgtaaaacttagttaaactttaccttacgggttaacctaaagtaacggtttattaacgtaaacttaacttccccgttaacccgttaccgttaaccgttaccggttttaccggggacccgggtaacgggtacccggtaaaaggggttcggaaggtaaccgtacgtaaaccggtaaccgtaacggtttacggtacggtaccgttacgtacgtaacccg

SEQ ID NO: 12059 - DNA, 756 bp, Homo sapiens
  misc_feature: GYAE6OF02FFVUC.52.2.A02.1.454.CMB.1.raw
  modified_base (195)..(195): a, c, t, g, unknown or other
  misc_feature (195)..(195): n is a, c, g, or t
  modified_base (223)..(223): a, c, t, g, unknown or other
  misc_feature (223)..(223): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccatccctccctgtcctgcatctagtagganacagaactcaccatcacgttggccgggnacgtacgaggacattaacatagtatcgtagaatttggtatcgacgtacaacggaaaccgaacgggggaaaaccacccccgttaaaacctccgttaccgtacgtacccgtacgtacgtacgactacttaccgtaaacggttttaacgggaaaaccggtaccggggtacccctagttaacggtaaccgggtttacgaacgggttacgggaaacggttcgggtaccgttacgggtacggggtaaacttagggtttaaccttttttaaccgttacccgtaaccgttaacgtaccgtaccaacggtaccgttaacgccgtaaccgtccgtaaagtaaactagttaacgttacgtaacctaaagttaaccttaagtttactaccgggtaactaaaggtacgttaacgtacgttaaactaccgtttacccgtccccgtacgttaccgttaccggttccgggtacggaaccggtaccggtaagggtacgaacgtacgtacgaaggtacccgtaacggtcggtgtccgtacgaccgtaaccg

SEQ ID NO: 12060 - DNA, 662 bp, Homo sapiens
  misc_feature: GYAE6OF02IWM5P.52.2.A02.1.454.CMB.1.raw
  modified_base (284)..(284): a, c, t, g, unknown or other
  misc_feature (284)..(284): n is a, c, g, or t
  modified_base (455)..(455): a, c, t, g, unknown or other
  misc_feature (455)..(455): n is a, c, g, or t
tcagcgcagtacgacacgaccggtgctcgatttagactcatctacagggggagtcagtcccaaccaggacacagcatggacatgagggtccctgctcagctcctgggctcctgctgctctggctctcaggtgccagatgtatcatccagatgacccagtactcatcctcctgtctgcatctatagagacagaatcaccatcactgccggtcgagtcagacattaacagtagtactcttagaattgtatcagtcaagaaaccaggtaaacgccctaagtacctanagtcctacgaatcgcaacttacaactttaggaaacacgggtaccaattaccaaaggtttaccaagttagggaaacgttacggcttacggtaagggtaccaaggttaatttttaaccttacgaaccctaagtacctacgtaacgaacttacgtactacgtaccgtaggtaanaacggttaagttacacgaaactataaaactttacttacgaacttaaaccgtaagtaattaacgtaagttaaactccgtttaaccccgactttaacgtaacccgttacggtaccgggtaacgggtacggaaaacccggttggtaaacgtaacggttacccgaaagttaaacggaaccctagggtttcgaaacgggttctaaggaaccc

SEQ ID NO: 12061 - DNA, 595 bp, Homo sapiens
  misc_feature: GYAE6OF02GI000.52.2.A02.1.454.CMB.1.raw
  modified_base (215)..(215): a, c, t, g, unknown or other
  misc_feature (215)..(215): n is a, c, g, or t
  modified_base (312)..(312): a, c, t, g, unknown or other
  misc_feature (312)..(312): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccggnagtcaggacattaacatgtatctgaattggtatcagcagaaaccagggaaacgcccctaaactcctgactcctcgatgcataccaatttaggaaacngggtccatcgaagttcaggtggaagtggctcgtagggactagtacttttactttcacctatccgctagactgcacgtcctagaatattagttgacctaacgtaattaattacgtgtaaccaaacgtaagttaactaggtaacttaaccttccgttacccgtacgttaccgtaaccggttttaccggggaccgggtaacggggtaaccggtaaaggggttacggaaacggtaacgttaccgaaggtaccggtaacgttcgggtaggccgttagaccctaacccg

SEQ ID NO: 12062 - DNA, 790 bp, Homo sapiens
  misc_feature: GYAE6OF02G4TP1.52.2.A02.1.454.CMB.1.raw
  modified_base (134)..(134): a, c, t, g, unknown or other
  misc_feature (134)..(134): n is a, c, g, or t
  modified_base (377)..(377): a, c, t, g, unknown or other
  misc_feature (377)..(377): n is a, c, g, or t
  modified_base (715)..(715): a, c, t, g, unknown or other
  misc_feature (715)..(715): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtnccagatgtatcatccagatcgacccatctccatcctccctgtctgctatctagtacggagacaagaactaccacctaatccacgttcgggccggggtacgaaggtccgaaggtaactaattaaacgagttaggttaacttactaggtaaatttgggttaactccgaacgacgaaacgaaaaccggaacggggaaaaccctaacccccgttaaacctccgtacgtacgtacccgtacgacgtanactacgttaacctaacggttttaaggaaaccggtacgggtacctaacgttacggtaaacggttaggacggttagggtaaggtacggtacggttacgtaacggggtaacttaagtttatttttacccgtactaaccgtcttacccggactagtaccgtgtaccgacgtacgtaagaacggtacttaacggtactaacgttaaactaagtttaactacgtttaacgtacgtaaacgtaggtttaacaacgttaacttaacccgttccgtacccgtccttaacggttacccggttacgggggtaccgggtaaacggttaacccggggtagggttaaacggnggttaaccgttaaccgggtacggtaaacggttaccgggtacgggtccggtaacccgttcggaaccctttaaccgg

SEQ ID NO: 12063 - DNA, 683 bp, Homo sapiens
  misc_feature: GYAE6OF02JK6JO.52.2.A02.1.454.CMB.1.raw
  modified_base (188)..(188): a, c, t, g, unknown or other
  misc_feature (188)..(188): n is a, c, g, or t
  modified_base (214)..(214): a, c, t, g, unknown or other
  misc_feature (214)..(214): n is a, c, g, or t
  modified_base (293)..(293): a, c, t, g, unknown or other
  misc_feature (293)..(293): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgaccagtcctcatccctcctgtctgcatctatgganacagaactcaccatcacttggccggnagtcaggactaattaacatgtatctagtaattggtactcagacaacgtaaccgaaggtaacgtacccctaactccgtanactccgtacgatcgctatacctagttacggaaccgtacgggtacccagtacgtaacggttcgaacggtagggtacgtacggtcttacggtacgggaactaggtttacctttttaccgtacgtaccgtacgtaccggacctaaggtacctcgtacctacggtaccttaaggaaacgtagttacttacggaactaacgtacttacgttacctagttaaccgaacgtagttataacggttaacttaccgtacccgttcccgttaccgttacgttaaccggttccgggaccgggttaacggggtaccggtaaggggttacgtaacgggtaccttaacccgtaaagggtaacccttacggttcggtaccggttacccgtacggttaaccctacgg

SEQ ID NO: 12064 - DNA, 707 bp, Homo sapiens
  misc_feature: GYAE6OF02HSJQE.52.2.A02.1.454.CMB.1.raw
  modified_base (213)..(213): a, c, t, g, unknown or other
  misc_feature (213)..(213): n is a, c, g, or t
tcagcgcagtacgacacgaccggtgctcgatttagactcatctacagggggggagtcagtcccaaccaggacacagcatggacatgagggtccctgctcagctccgtggggcctcctgctgctcgtggctactcaggtgccagatgtatcatccagatgacccagtctccactccctcctgtctagctatcttagaggacaacagatcaccanctactcgccgggatacgcgaggaactattaacatgtactctagtaattggtactcagacaacggtaaaccgaaggaaaccgacccctaaacttcccgtagaccgtaccgtacgtatcgacctatacctaagtttacggaaaacgacgggttacccagtacgtaacgtttagaggtacggaagtcggcttacgtgggaaacctaggttactttttaaccttcgaaccgtatacccgacctaaggtacgtacgttacggactaccgtagtaacgtaactaatttacggaacctaaattaagttaacttaacgttacggtaacctaaacggtaagttaacgttacgtaaacgttaccctacccgttacccgaccttaccgtttaacggtttcccgggacggggttaacccgggtaaccggtaaagggttaacggaacccgttagtaaccgtaacggtacggtaaacaccggttacgggaacttccgaaccctaaccg

SEQ ID NO: 12065 - DNA, 876 bp, Homo sapiens
  misc_feature: GYAE6OF02IHXFZ.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctcctgtctgctatctagtaggagacagtaatcaaccatacacttcggccgggacgagtcgaggaactaattaacattagtacttacgttagtaagtttggtattacaaggaccaaacggaaaacccggaaacggggaaaacccgtaacccccgttaaaaccgttacccgttacggaaccttacccgttacgtaacgtacgaccgtaacttaccgttaaacgtttacggggaaaccgtacgggggtacccctaacgttaccgtaacgggtttccgaaggttacgggtaacggttcggtaccggtttcggtaacggggtaacgttaacggttttaccgtttttttaaccgtttacccgtaacccgttacgttacccggtacccgaacgttaccggtccggtaccgtaaccggtacccgtaacggtaaacgttaacgttaaccgtttacggaaccttaaaccttaacgtttaaccgttttaaccgtaacgttaaccgtaaaaccgttaaggtttaacgtaacgttaaactttaacccgttaccccgttaaccccggttacctttacccgggttaacccgggttttccgggggaacccggggttaaccggggtaaccgggtaaacggggttacgggaacggttacccgttaacggaaccggttaaccggtacggtttcggggtaccggtaccggtaccgtacctacccgg

SEQ ID NO: 12066 - DNA, 649 bp, Homo sapiens
  misc_feature: GYAE6OF02IYSQP.52.2.A02.1.454.CMB.1.raw
  modified_base (217)..(217): a, c, t, g, unknown or other
  misc_feature (217)..(217): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgctatctagtaggagacagaatcaccatcacttggccggngagtcaggacattaacatgtatctagaattggtatcagacgaagaaaccaagggaaacgacccctaaactccgtagactcctacgactgactactacctaagtttaggaaaccgacgggtacccaagtactaaggttcgaaggtggtaagtcggtactcgtacgggactaggttaacttttaccgtttaacaccctaagtcccgtacaacgtactcgacgtacgtcctaagtaacgtaattacgttagacgaaactaattacgtttaacctagtaactaaacgtagttatagttaaccttaacgttccccttaacccgtcttaacccgttacggtttaccgggacggggtaacgggtaaccgtaaggggttacgaacggtaactacgaacgtaacggtaacgtcggtacggtaccgtacggtacctaacccg

SEQ ID NO: 12067 - DNA, 735 bp, Homo sapiens
  misc_feature: GYAE6OF02HX7Q7.52.2.A02.1.454.CMB.1.raw
  modified_base (166)..(166): a, c, t, g, unknown or other
  misc_feature (166)..(166): n is a, c, g, or t
  modified_base (553)..(553): a, c, t, g, unknown or other
  misc_feature (553)..(553): n is a, c, g, or t
tcagcgcagtacgacacgaccggtgctcgatttagactcatctacgaggggggagtcagtcccaaccaggacacagcatggacatgagggtccctgctcagctccgtggggctcctgctgctctggctctcgaggtcgccagatgtatcagtccagatcgaacccngtctcccatccctcctgctgactatctataggatacagatccactatcacgttgcccgggtagacgtcgaacggaactaattaaccagttagttactactaggttaaagttggtaacgttcgaagaccgaaaacggaaaaacccggttaagggaaaccccgtaccctaaaacgtcctaaggtaccttaccgtacgacgtacactaacctaccgttaagttaacggaaacgacgggtaccaagtccgtaaaggttccgtaggtacgtaaggtcgtacggttacgtaacggtaccgttaggttaaacttttactttaacccgaaccggttacttcccggtaacgaacgtaacctacgtacgaacgtcgtaacgtaagtagttacgttanaacccgtaatacttaagtcctactacgaaacgtaacgttataacgttaacttacgttaccctcccggttattaaccgttaccggttaggaacccgggttaacggaacggtcgggtaagtacggtaacgtaaccgtacggtacggtaacgtttaggacccggtttacgagttacccgtaaccg

SEQ ID NO: 12068 - DNA, 830 bp, Homo sapiens
  misc_feature: GYAE6OF02HVTSK.52.2.A02.1.454.CMB.1.raw
tcagcgcagtacgacacgaccggtgctcgatttagactcatctacagggggagtcagtccccaaccaggacacagcatggacatgagggtcccctgctcagctccgtggggcctccgtgcctgctcgtggctctcgaggtcgccagatgtatcactccagactcgaccctacgtcctcccacttccctcccgtgttcctgctaattacgtaagtacggaagaccgtaagaactacccaaccgtactactaccggttccgggcccgggaggtaacggtaccgaacggtaaccttaattaaacgtcgttacgttaattccggttaaggttacttaggtaacttaccgaacggaacccgtaacggaaaaaccggtaacggggtaaaccccctaaaccccctaaacccgttacgtacgtaaaccgttccctacgtacgaccgtacctaacgttaaccgtttaacggttaaacgggaaccggtaacccgggtaccctaagtacgggttaaacgttaggtaaggtacgggtacggttcggtaccggttcggacgggttaactttaaccgttttactttaacccgtttaccgaccgtaaccgtccggtacctaaacgtccgtacgacgttacggtaccgtaagggtaatacgtaactagtaaacctagtttaacttacctacgtacaacgttaaaccgaagttacgtaacgttaaacttaccttccccgttacggttacctacccgggtttaccggtaccgggtacgggtaacggaaccgggtaggttcggaagcgttacgacgtaacggtcggtacgaccgtcgtaccgacttacg

SEQ ID NO: 12069 - DNA, 759 bp, Homo sapiens
  misc_feature: GYAE6OF02GMOUO.52.2.A02.1.454.CMB.1.raw
  modified_base (192)..(192): a, c, t, g, unknown or other
  misc_feature (192)..(192): n is a, c, g, or t
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtcctccatcctcctgtctgctatctagtagganacagactccacatacacttcggccgggacgacgtacgaacggtactaatttaaaccagttacggttaacttccgtagtaagttttacggtaacgttacacggaacgaaacggaaaaacccggaacggggaaaaccccggaacccccttaaaacgttcccgtaaggtaaccttacccgtaccgtaacgtcggaccttaaccgttaaccgttaaagttttaacggggaaaacccggtacggggtcccctaagtacggttaaacggtttacgaggttacgggagtacggtccgtagggtacgggaactacggtttaactttttacccgttactaaccgtacgtcccgtacgtaacggtacgttgaccgtacgtaccgtagggtaaacttatacgtttacgacctaaagtttactaacttacgtactaaccaagttagttaactagtaaacttacgttcccgtcccgtacttaccgtacggttaccgggaggttaaccggacggttaagggtacgtagacgttaccggaaggtaccggtaacgttcggacggtaccgttcgacctaaccgg

SEQ ID NO: 12070 - DNA, 621 bp, Homo sapiens
  misc_feature: GYAE6OF02I65XV.52.2.A02.1.454.CMB.1.raw
  modified_base (179)..(179): a, c, t, g, unknown or other
  misc_feature (179)..(179): n is a, c, g, or t
  modified_base (194)..(194): a, c, t, g, unknown or other
  misc_feature (194)..(194): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccatccctcctgtcngcattctagtagganacagatcaccatcacgtcggccggacgagtcgaaggtacaagttaacagtagtatacgtagtaattcggtatacagaacaacgaaacgaacggaaacgaccctaacgtctcgtacgtcctagactcgaccatacgtaacgttaggaaccgacggtaccaatacgtaacgtgagtacggtagtacgtctacggtagaactacgtaattccaacttctacacctactaccgtaacgtacgtacgtcgacgtacgtacgtagtaggttacgttacgtaacgttaacgttacgttactacgtaacgaacgtagtaacgtacgttaccgttaccgttaccgttacgttaccgtaccgtaccgtacgtacgtacgtacgtactaacgtaacgtaacgtacgtacgtacgtacgtacgtaccgtactacgtacg

SEQ ID NO: 12071 - DNA, 689 bp, Homo sapiens
  misc_feature: GYAE6OF02HIGBM.52.2.A02.1.454.CMB.1.raw
tcagcgcagtacgacacgaccggtgctcgatttagactcatctacagggggagtcagtcccaaccaggacacagcatggacatgagggtccctgctcagctcctggggctcctgctgctctggctctcaggtgccagatgtatcatccagatgacccagtctccactcctccctgtctgcatctagtaggagacagaatcaccatcacgttgccgggcgagtcgaggactaattaacatgtatctagtaagttgtatcgagctaaacggaaaccgagggaaacctacccctaaactccgtacgtactccgtcgtactcgactacgtactaagtttaggaaaccgtcgggtaccagtacgtaaggtcgacggtaggtaagtcggtactacggtagggtaactaggttactttttaccgttactacccgtagtcccgacgtaacgtcgtacgaccgtacgtaccgtaagaacgttaacttagttacgtaaccaacgttaattacgtttaacgtacgtaacgtaaagtaacgttagtaagtaaccttaacctacccgttaccccggtacttaccggttaaccgttacgggggaccgggtaaccggtaacccgggtaaagggttacggaacgtaccgtaaccggaaacggtacccgtaacgtgggttacgaacccggtcggaccttaacccgg

SEQ ID NO: 12072 - DNA, 838 bp, Homo sapiens
  misc_feature: GYAE6OF02HG4JP.52.2.A02.1.454.CMB.1.raw
  modified_base (194)..(194): a, c, t, g, unknown or other
  misc_feature (194)..(194): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtcctccactccctcctgtctgcatctatagganacacgactacactactctacgtcggccggtacgacgtcgagactaactaactattacgtattacgtaagtagttacggtactacgtaagacgaaaacggaaaaccggtaaacggaaacccgtaaccccgttaaactccgtaacgtacctaccgtacgtacgtacgacctacgttaaaccgttaacggttaaacgggaaccggtacgggtaccaaacgtacgtaaacggtttacgaaggtacgggtaagtggtacgtacggtaggtaacgttacgttaattttaccgtacaaccgtacgttaccgacgttaacgtacgtacgacgtacgtaacgtacggtaaacttactaacgttacgaaaccttaaacgttaaacgttaacgtttaccgtaaccgttaaacgttaaacggttaagtttaaagtaacgttaaaacctttaacccgttcccgtttaacccggtacccttttaaacccgggttaccggggtttacccggggggtaaccggggtaaacggggtttaaccccgggtaaaaggggttaacccggggtaagttaaaaccgggttaaccggtaaaccgggaaaccggtttaacgggttaccgggttaaccgggtttacgttaacccggtaccttaaacccgg

SEQ ID NO: 12073 - DNA, 794 bp, Homo sapiens
  misc_feature: GYAE6OF02JWML7.52.2.A02.1.454.CMB.1.raw
  modified_base (610)..(610): a, c, t, g, unknown or other
  misc_feature (610)..(610): n is a, c, g, or t
  modified_base (772)..(772): a, c, t, g, unknown or other
  misc_feature (772)..(772): n is a, c, g, or t
tcagcgcagtacgacacgaccggtgctcgatttagactcatctacagggggggagtcagtcccaaccaggacacagcatggacatgagggtccctgctcagctccgtggggctcctgctgctctggctctcaggtgccagatgtatcaatccagtatcgacccagtcctcctacttccctcccttgtcctcgctattccgtaagtaaggacacacgaaacttccaacctacgtcgtacgttcgggacccgggacgtaacgtcgaaggaccttaacttaacgatgttatacgttagtaagttggtaactcgtaagaccgaaaggaaaccgtaacgggaaaccctaccccttaaaccgttccgtacgtaaccgttcccgtacgtacgtcgtacctaactttaacccggtaaaggtttaaccgggaaaacccgggttaccgggtaccctaaacgttaacggtaaacggggttctaagggggtaccgggtaaggttcggtaaccggttacgggtaaccggggttaacgttaaacggtttttacgtttttaacccgtacgtaaacccgtcgtacccgggaaacctacgggtacctcggaaacgtcctacggtaanaacgttactacgttacaacgttaacgtatttaacggttactacggtactaaacggtagttacttaagtactttaccggtactccgttacgtacgtacccggttagggaccgggaaccgtaacggtaacggtaccgagttacgaacggtcgaacgtttccggngtaacgcggtccgaacttccgg

SEQ ID NO: 12074 - DNA, 613 bp, Homo sapiens
  misc_feature: GYAE6OF02GJDB2.52.2.A02.1.454.CMB.1.raw
  modified_base (192)..(192): a, c, t, g, unknown or other
  misc_feature (192)..(192): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (426)..(426): a, c, t, g, unknown or other
  misc_feature (426)..(426): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtctccatccctcctgtctgcatctatagganacagaatcaaccattcgacttggaccggnagtcaggactattaacntagtatcgtagtaattgtatcgagcaagaaacgaggtaaacaccccgtaaactccgtagacgtccctagaactcgacatacctaagtttcggaaaactcggggtacccataccgtaagttcaggtaggtaagtggacgtcgtagggactaagttacttttacttctactatcgactagacttcgacgngtaccttagaacgtattacttcgaaccaagttattaacttacttaggtacaaacgttagtacgtaataactaacggttacctccgtacttacgtacggttccggacgggtaagggacctaagggtacgacggtaacgttaccgaaggtaacctaacggttggtaccggtacttacgggacccttacg

SEQ ID NO: 12075 - DNA, 592 bp, Homo sapiens
  misc_feature: GYAE6OF02HPKEQ.52.2.A02.1.454.CMB.1.raw
  modified_base (216)..(216): a, c, t, g, unknown or other
  misc_feature (216)..(216): n is a, c, g, or t
  modified_base (273)..(273): a, c, t, g, unknown or other
  misc_feature (273)..(273): n is a, c, g, or t
  modified_base (404)..(404): a, c, t, g, unknown or other
  misc_feature (404)..(404): n is a, c, g, or t
tcagcgcagtacgacacgaccggtgctcgatttagactcatctacaggggggagtcagtcccaaccaggacacagcatggacatgagggtccctgctcagctcctgggctcctgctgctctggctctcaggtgccagatgtatcatccagatgacccagtctccatccctccctgtctgcatctataggagacagaatcaccatcacttgccgggnagtcaggacattacatgtatcgtagaattggtatcagacaagaaaccgagggaaacnccctaaatcctagactccgtgatgacatcctaagttcggaaacgtcgggtccatcgaagtcgagtggaagtggactgtcgggactaggttattttaccgtcaacctagtccgacagctgccagcctagatntattgacaatatattactcgtacaacttagtatagtacgttaacttccgtacccgtacttaccgtacggtttccgggacgggttaacgggtaaacccggtaagggttaccgggtaaacgtaacgtaccggtaacggtaaccggttaacggtacggttacgggggacctttacggaaccccgtttccgg

SEQ ID NO: 12076 - DNA, 667 bp, Homo sapiens
  misc_feature: GYAE6OF02F7418.52.2.A02.1.454.CMB.1.raw
  modified_base (179)..(179): a, c, t, g, unknown or other
  misc_feature (179)..(179): n is a, c, g, or t
  modified_base (192)..(192): a, c, t, g, unknown or other
  misc_feature (192)..(192): n is a, c, g, or t
  modified_base (214)..(214): a, c, t, g, unknown or other
  misc_feature (214)..(214): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctcctgtctnacatctatagganacagaatcacatcactgccggnagtcaggacataacatgtatctgtaattggtatcagcgaacgaaaccaggggaaaaccggtacccctaaacctaccgtagactccgtacgtatcgacacttacctaagtttaggaaaccgtacggggtacccaagtacgtaacggttactaaggtaggtaaggtcggtctcgtacggggactaggttacgttttacctttacacctagtcccggcctaggactgaccaggcccttaggaaagtattacgttacgtacctaacgtaattactttacgtacgttaaccaagaccttaagtataacgttaaccttaccgtaccccttaccgttaccgtaccggtttaccgggtacggggaccggtaacgggtaacgggttaggggacgtaaggttaccgaacggtaaccgggtaaccgttcggggttaaccggtcggtacccgttaccggaacccg

SEQ ID NO: 12077 - DNA, 863 bp, Homo sapiens
  misc_feature: GYAE6OF02GHRBC.52.2.A02.1.454.CMB.1.raw
  modified_base (217)..(217): a, c, t, g, unknown or other
  misc_feature (217)..(217): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggagacagaactcaccatcacttgccgggnagtcagacattaacatgtatctgaatttggtatcagcaagaaaccgagggaaacgacccctaaactccgtagacttccgtacgaagtcgactactaccctaaagttttaggaaaaccgtacgggggtaccccaacgttaccgtaaagggttttaccgtaaaggttacggggtaaacggttacggggtaccttacgggtttacgggggaaccttaaacgggtttaaacttttttttaaacccgtttttacccgtaaccccgttaacgttacccggtaaccccgtaaacggggtaacccttaggacccgtaacggtaccccgtttaaagggtaaacccggtaaagttttaaacgtttacgggtaaacccctaaaaccgttaaacgtttaaaacgtttttaaacccgtttacgggttaaacccgtaaaaaccgtttaacggtttaaacgtttaagggttaaacctttaaaaccggtttaccccttaaccccgggttacccttaacccggtttaacccgtttacccggggggtacccgggtaacgggggtaaccccgtaaaagggggttaccgggtaaacgtaaccgttaaccggaaggtaacccggtaaacggttccggtaacgggtccgttaacggaccttaacccgg

SEQ ID NO: 12078 - DNA, 851 bp, Homo sapiens
  misc_feature: GYAE6OF02FM530.52.2.A02.1.454.CMB.1.raw
  modified_base (190)..(190): a, c, t, g, unknown or other
  misc_feature (190)..(190): n is a, c, g, or t
  modified_base (213)..(213): a, c, t, g, unknown or other
  misc_feature (213)..(213): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctcctgtctgcatctatagganacagaatcacatcacttgccggngagtcaggacattaacatgtatctgaatttggatcagcagaaaccgaggaaacgtcccctaaaactcctacgactccgtacgtatcgaccgtactaccctaaaagttttacgggaaaaccgtacgggggtacccctaagttaccgtaaacggtttacgtaagggttacgggaaacggttcggggtaccgttaccggtttaacggggggaaacttaacgggtttaaacctttttttaaccgttttacccgtaaacccgtaacgtttaacccggaaccccgtaaaggttaacccgttacggtaccggtaaacggttaccccgttaaaggtaaaacgggtaaatttaacggtttaacgaacccgttaaaaaccgtaatttaaaactttaaccgtttaacggtaaaccttaaaccggttaacggttaaactttacgggttaaacttaaacgtttccccgtttaaccccggtccctttaaccggtaaccggtttttcccgggggtaaccggggtaaaccggggttaaaccggtaacggggtttacgggtaaaccggtaaaccggtttaccggaaacggtaaaccgggttaaccggttacggggtttaaccgggtccgttaaccgggttaccccgtaaacccgg

SEQ ID NO: 12079 - DNA, 710 bp, Homo sapiens
  misc_feature: GYAE6OF02HC566.52.2.A02.1.454.CMB.1.raw
  modified_base (193)..(193): a, c, t, g, unknown or other
  misc_feature (193)..(193): n is a, c, g, or t
tcagcgcagtacgacacgaccggtgctcgatttagactcatctacaggggggagtcagtcccaaccaggacacagcatggacatgagggtccctgctcagctccgtgggctcctgctgctctggctctcaggtgccagatgtatcatccagatcgacccagtctccatcctccctgtctgcatctagtagganacagactcaccatcacttggccggcgagtcgaggactaacttaacagtgtattctagtaattggattacagacaacgaaaccgaaggaaacctacccctaaaccgtcctacgaactcctacgactcgtacctactacgttaagttaacggtaaaccgtacgggtaccctaagtacggtaacggtttacgacggttagggtaaacggtcggacgttacggtacggaactttaacggttaacttttttaccgtttaacccgtaacctaacgtacccggacctaacggtaccgttccgaacgtccgtacctaaggaacgttaacttaaggttacgaccttaaacggtactttactacgttacgtaactaaacgtaggttataacgtaacttaaccgtcccgttacctccgttaccgtaccgggtttaccgggacgggtaaccggtacggtaagggtaccgtaacgtcggtaacctaggtaaccgttacggtcggtaccgggtcctacgacccgttacccg

SEQ ID NO: 12080 - DNA, 743 bp, Homo sapiens
  misc_feature: GYAE6OF02H16KU.52.2.A02.1.454.CMB.1.raw
  modified_base (637)..(637): a, c, t, g, unknown or other
  misc_feature (637)..(637): n is a, c, g, or t
tcagcgcagtacgacacgaccggtgctcgatttagactcatctacaggggggagtcagtcccaaccaggacacagcatggacatgagggtccctgctcagctccgtggggctcctgctgctctggctctcgaggtgccagatgtatcactccagatcgaccccagtcctcctactcccctcccttgtctcgactatctagtaggaagacagaactcaaccattctacggtcggccgggacgtagtcggaggaacctaatttaacagttaggttactcgttagtaacgtttggtaacgtcgaacggaacctaaaacgggtaaaaccccgaaaggggtaaacccccttaaccccttaaaacctcccgttagtacctttacccgtaggtacgtaccgtactaaacgttaaccgttaaagttaaccggaaacgggtcccggtactacgtaacggtaaaggttcgaaggtacgggttacgtggtaccgtcggaaccggttacgttaaagttttccctttaacgtccaaacgttcaccgacgtacgtacgacgacgtactcgtaaagtactagtactacgactaatacgtttacagtacctaataacgtagtacgtacgtaacttacccgtcctaacccggtnaccgtttaccgggtaccggtacgggtaacggtaccggaacggtagggtaaccgtactaaccggaagttaacccgagggttacgacggtttcgtacgaccctaccgg

SEQ ID NO: 12081 - DNA, 605 bp, Homo sapiens
  misc_feature: GYAE6OF02GWLJH.52.2.A02.1.454.CMB.1.raw
  modified_base (585)..(585): a, c, t, g, unknown or other
  misc_feature (585)..(585): n is a, c, g, or t
tcagcgcagtacgacacgaccggtgctcgatttagactcatctacaggggggagtcagtcccaaccaggacacatcatggacatgagggtccctgctcagctcctggggactcctgctgctctggctctcaggtgccagatgtatcatccagatgacccagtcctccatccctccctgtctgctattctagtaggagacagaatccacatcacttggccgggacgagtcgaggaactattaacatgttatctagtaattggtatacagacgaagtaaaccggaacggaaaccgtaacccctaaactccgtatacctcctacgatcgactactacgtaaaggttaaccggaaacggtaccgggtacctaacgtacgtaacggttcgtaaggtagggaggtcggtcgtcggtaggaacgttagttacttttacctacaacctgtaccgtaccgagtacgacgtcgagtacgtagtaatacttagacgactaaatattaacttgtactactaagtacgtatagtacttacgtcctccgtctaacgtcgtcgggacgaggtacggaggtaggactacgagtaacgacgnggtcggtagcgtctacgtac

SEQ ID NO: 12082 - DNA, 693 bp, Homo sapiens
  misc_feature: GYAE6OF02JOV1I.52.2.A02.1.454.CMB.1.raw
  modified_base (121)..(121): a, c, t, g, unknown or other
  misc_feature (121)..(121): n is a, c, g, or t
  modified_base (194)..(194): a, c, t, g, unknown or other
  misc_feature (194)..(194): n is a, c, g, or t
tcagcgcagtacgacacgaccggtgctcgatttagactcatctacagggggagtcagtcccaaccaggacacagcatggacatgagggtccctgctcagctccgtgggctcctgctgctcnggctctcaggtgccagatgtatcatccgagatcgaaccctagtcctaccacttccctccgacttgcctatctntaacggtaggacacgaaatacctaccgataccacgttagccggggccgtagctacggacgtattaactactagtatagtacgtattagtagtacgtacgtagacgaaccgaacggtaacggaacccgtaccgtacctacgtacgtaccttggacttcgactacgtccaaacttcggaaacttacgggtaaccaacggttccaacgttacgtaaggttacggaacgtaggtacgtcgtacggtactacggtactttacgtacttaccttacgtaccgactacggtacctacggtactagccgtagtaacgtacgtaacgtagttaacctatacgtaataccgtattactactagtactaacgtacttaactacttaccgttaccttccgtaaccgttccgtaaccggttacggtaacccggtaagggtacggtaaccgtaaggtaacctaacggtacccgtaaggttacgtaaccgtcgttacggacctaccggtaaccg

SEQ ID NO: 12083 - DNA, 619 bp, Homo sapiens
  misc_feature: GYAE6OF02I5YOX.52.2.A02.1.454.CMB.1.raw
  modified_base (130)..(130): a, c, t, g, unknown or other
  misc_feature (130)..(130): n is a, c, g, or t
  modified_base (135)..(135): a, c, t, g, unknown or other
  misc_feature (135)..(135): n is a, c, g, or t
  modified_base (228)..(228): a, c, t, g, unknown or other
  misc_feature (228)..(228): n is a, c, g, or t
  modified_base (460)..(460): a, c, t, g, unknown or other
  misc_feature (460)..(460): n is a, c, g, or t
tcagcgcagtacgacacgaccggtgctcgatttagactcatctacaggggggagtcagtcccaaccaggacacagcatggacatggagggtccctgctcagctcctggggctcctgctgctctggctctnaggtnccagatgtatcatccaagatcgacccagtcctccatccctcctgtctgctatctagtaggagactagaactccaccatctacgttcggccggngtacgtacgaggactaattaacatagtatcgtagtattgtatgagacaacgtaaaccgaaggaaacctaccccgtaacgtcgtacgtactccgtacgtagtcgactactacgtaagttacggaaacggtcgggtacctagtacgtagtacgaggtaggtacgtgcgtacgtaggactagttacttttactactacgtactcgacgagactcgacacgctagaatatacgtanactaactagttacttagtactaactaagtatagtacgtattaccgttccgtacctacttacgtacggttccggaacgggtacggtaaccggtaagggtccggtaaagtactaacggacgtaacggtacgttaacgggcgtacgtccgtaaccgttaccg

SEQ ID NO: 12084 - DNA, 576 bp, Homo sapiens
  misc_feature: GYAE6OF02IAR4D.52.2.A02.1.454.CMB.1.raw
  modified_base (166)..(166): a, c, t, g, unknown or other
  misc_feature (166)..(166): n is a, c, g, or t
  modified_base (205)..(205): a, c, t, g, unknown or other
  misc_feature (205)..(205): n is a, c, g, or t
  modified_base (462)..(463): a, c, t, g, unknown or other
  misc_feature (462)..(463): n is a, c, g, or t
  modified_base (465)..(465): a, c, t, g, unknown or other
  misc_feature (465)..(465): n is a, c, g, or t
  modified_base (483)..(483): a, c, t, g, unknown or other
  misc_feature (483)..(483): n is a, c, g, or t
  modified_base (489)..(489): a, c, t, g, unknown or other
  misc_feature (489)..(489): n is a, c, g, or t
  modified_base (491)..(491): a, c, t, g, unknown or other
  misc_feature (491)..(491): n is a, c, g, or t
  modified_base (493)..(493): a, c, t, g, unknown or other
  misc_feature (493)..(493): n is a, c, g, or t
  modified_base (495)..(495): a, c, t, g, unknown or other
  misc_feature (495)..(495): n is a, c, g, or t
  modified_base (504)..(504): a, c, t, g, unknown or other
  misc_feature (504)..(504): n is a, c, g, or t
  modified_base (510)..(511): a, c, t, g, unknown or other
  misc_feature (510)..(511): n is a, c, g, or t
  modified_base (513)..(514): a, c, t, g, unknown or other
  misc_feature (513)..(514): n is a, c, g, or t
  modified_base (516)..(516): a, c, t, g, unknown or other
  misc_feature (516)..(516): n is a, c, g, or t
  modified_base (523)..(523): a, c, t, g, unknown or other
  misc_feature (523)..(523): n is a, c, g, or t
  modified_base (525)..(525): a, c, t, g, unknown or other
  misc_feature (525)..(525): n is a, c, g, or t
  modified_base (532)..(532): a, c, t, g, unknown or other
  misc_feature (532)..(532): n is a, c, g, or t
  modified_base (536)..(536): a, c, t, g, unknown or other
  misc_feature (536)..(536): n is a, c, g, or t
  modified_base (540)..(540): a, c, t, g, unknown or other
  misc_feature (540)..(540): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (548)..(548): a, c, t, g, unknown or other
  misc_feature (548)..(548): n is a, c, g, or t
  modified_base (550)..(550): a, c, t, g, unknown or other
  misc_feature (550)..(550): n is a, c, g, or t
  modified_base (554)..(554): a, c, t, g, unknown or other
  misc_feature (554)..(554): n is a, c, g, or t
  modified_base (556)..(556): a, c, t, g, unknown or other
  misc_feature (556)..(556): n is a, c, g, or t
  modified_base (558)..(558): a, c, t, g, unknown or other
  misc_feature (558)..(558): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (567)..(567): a, c, t, g, unknown or other
  misc_feature (567)..(567): n is a, c, g, or t
  modified_base (570)..(570): a, c, t, g, unknown or other
  misc_feature (570)..(570): n is a, c, g, or t
  modified_base (572)..(572): a, c, t, g, unknown or other
  misc_feature (572)..(572): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
tcagcgcagtacgacacgaccggtgctcgatttagactcatctacagggggagtcagtcccaaccaggacacagcatggacatgagggtccctgctcagctcctggggctcctgctcgctctggctctacaggtgccagatgtatcatccagatgacccagttccncctatcccgtcctgtactcgtacattacttagacggganactaagtaactaccaccgtaatctaacgttcgggccggacgtaagttcacggaactaattaccgaattacgtacttactagtaagtttagtacttacgagtaccaaagaaaccgtaaggggaaaccaacccgtaaacctaccgtaacgtactaccgtacggtactcgactaacgtacccgttaacggtttaacggtaaacggtaccgggttaccgtaaaccgttacgttaaaaccgggttacggtaccggtttaaannanatagacacgacatagacnacacananananacacacganacagannannangagagananacgaganacanacanananacananagtnanancacanananacnananan

SEQ ID NO: 12085 - DNA, 679 bp, Homo sapiens
  misc_feature: GYAE6OF02ISEJ2.52.2.A02.1.454.CMB.1.raw
  modified_base (636)..(636): a, c, t, g, unknown or other
  misc_feature (636)..(636): n is a, c, g, or t
tcagcgcagtacgacacgaccggtgctcgatttagactcatctacaggggggagtcagtcccaaccaggacacagcatggacatgagggtccctgctcagctcctggggcctcctgctgctctggctctcaggtgccagatgtatcatccagatgacccagtctccactccctcctgtctgcatctagtagagacagaatccaccatcacgttcgccggcgagtcgagactaattaacataggttactacgtagtaagttggttacacgaacgaccgaacggaaaaccggtaaggggaaacccctacccccttaaaaccgtccgttaacgacccgttacccgtacgtacgtaccgtacctaccgttaaccttaaggtttaccggaaaacccggtaccggtaccacgttacgaacgggttttacgacggtaggtaggtcgtacgtacggtacggtactagttaccttttactaccgactacgttccgactacgacgtcgacgtcgtacctaggaacgttacgttaagtaccaaagttaccttaacgttacttaccgtacgaacgttaatagttaaccgtagtaaccttcttaccccgtacttacggtccgttaccgtagggaccggagtaaccgggngtaggtacacggactaggacgtaggtcgagtctcgacctacgg

SEQ ID NO: 12086 - DNA, 618 bp, Homo sapiens
  misc_feature: GYAE6OF02HW27Z.52.2.A02.1.454.CMB.1.raw
  modified_base (139)..(139): a, c, t, g, unknown or other
  misc_feature (139)..(139): n is a, c, g, or t
  modified_base (191)..(191): a, c, t, g, unknown or other
  misc_feature (191)..(191): n is a, c, g, or t
  modified_base (196)..(196): a, c, t, g, unknown or other
  misc_feature (196)..(196): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (261)..(261): a, c, t, g, unknown or other
  misc_feature (261)..(261): n is a, c, g, or t
  modified_base (285)..(285): a, c, t, g, unknown or other
  misc_feature (285)..(285): n is a, c, g, or t
  modified_base (458)..(458): a, c, t, g, unknown or other
  misc_feature (458)..(458): n is a, c, g, or t
  modified_base (463)..(463): a, c, t, g, unknown or other
  misc_feature (463)..(463): n is a, c, g, or t
  modified_base (536)..(536): a, c, t, g, unknown or other
  misc_feature (536)..(536): n is a, c, g, or t
tcagcgcagtacgacacgaccggtgctcgatttagactcatctacgagggggggagtcagtcccaaccaggacacagcatggacatggagggtccctgctcagctccgtggggctcctgctgctctggctcacagggtnaccagatgtatcatccagatcgacccagtcctcctactccctcccgtgtctnacctntntagaggganaacagaatccaacgtatcaacggttggcccggagagtacgaggaactataacgngttatacctagtagtaattggacncgaaggcaaacgtaaaaccggaagggaaacccaccccttaaaactcccgtagaacttcctagagccgtactacgttaaccgtaagttacggaaaccggtacggtccaagttacgtacgtagtagaggtacgcgtagacgtagacgtattattactctaacatacgacagtacncgtancgtacgtaagtaagtattatacaacaactacgtaactatacgttaacgaaacaattacgaagttacacttacnccggtactaccgtacggtaccgggacggtaggtaccggaaggtacgtgaacgtacgacgtacgacgtgacgtcagtaccgta

SEQ ID NO: 12087 - DNA, 714 bp, Homo sapiens
  misc_feature: GYAE6OF02GVRWH.52.2.A02.1.454.CMB.1.raw
  modified_base (150)..(150): a, c, t, g, unknown or other
  misc_feature (150)..(150): n is a, c, g, or t
  modified_base (243)..(243): a, c, t, g, unknown or other
  misc_feature (243)..(243): n is a, c, g, or t
tcagcgcagtacgacacgaccggtgctcgatttagactcatctacaggggggagtcagtcccaacaggacacagcatggacatgaggtccctgcgtcagctcgtggggctcctgctgctctggctctcaggtgcagatgtatcatccagntgacccatctccactccctcttgtctgctatctaagacgagacagaatccaccatcacgttggcggcaagtcaggacaagttaacatcgtaangtagtaattgatcgagacgtaagaaaccgaaggaaacgtaccccttaaactacctagtactaccgtcagtacgtacacttaacctaagttacggaaaaccgtcgggttacccaaagttcggtaaacgtcggtaacggtagggttaaacgtggttactcggtaagggggtaacttaaagttttaaccggtttttttaaacctttacggaaacccttacgggttaccctaaccggtaaagccgtttacgaccggttaacggtactaaaaccggggtaaatacggtttaacgttacggaaaacgtaaaactttactttaaacggttcttaaaccggttacaaacgttaagtaattacgaaacgttaacctcgtaaccctgtaaccgttacgttccggggaccggaaggttaacgaaagggttacgacgttaacgacgaacgtcgttaagcggttaagcggttacaccttaacgg

SEQ ID NO: 12088 - DNA, 378 bp, Homo sapiens
  misc_feature: GYAE6OF02I5FZU.52.2.A02.1.454.CMB.1.raw
  modified_base (167)..(167): a, c, t, g, unknown or other
  misc_feature (167)..(167): n is a, c, g, or t
  modified_base (264)..(264): a, c, t, g, unknown or other
  misc_feature (264)..(264): n is a, c, g, or t
  modified_base (343)..(343): a, c, t, g, unknown or other
  misc_feature (343)..(343): n is a, c, g, or t
  modified_base (345)..(345): a, c, t, g, unknown or other
  misc_feature (345)..(345): n is a, c, g, or t
  modified_base (348)..(378): a, c, t, g, unknown or other
  misc_feature (348)..(378): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttacttcaccatcgccagactgcagcctgaagatattgacaanatattactgtcaacagtatgaataactcctcccgtctactacgtttccgggacgggagggaaccaaggtggacgatacagacgactggtgctgcacntctgtctcactccttccccgcatctagatatacgactccgactggaggcgggtcgtggaacgacgggcgacagtagctngntannnnnnnnnnnnnnnnnnnnnnnnnnnnnnn

SEQ ID NO: 12089 - DNA, 883 bp, Homo sapiens
  misc_feature: GYAE6OF02FRFES.52.2.A02.1.454.CMB.1.raw
  modified_base (828)..(828): a, c, t, g, unknown or other
  misc_feature (828)..(828): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcactccagatcgacccagtcctccactcctccctgtctgcctatctagtaggagacagtaactccaacctatcctacgttcggccgggtcgtagtcgaacggtaactaacttaaaccgattagttacgttccgttaggttaaattttagggttaacttcaacggacgtaacggaaaacccggaacggggaaaaccctacccccttaaaaccgtcccgttagaccttccgtacggtacgttacgacctaacgtttaccgtaaacggtttttaaaccgggggaaaacccggtaaccgggggtttacccctaaacgtttaaccgggttaaacggttttaccgtaacggggtttaaaggggtaacgggttaccgggtccgttacgggggtaacggggttaacccttaagggtttttaacccttttttaacccgttaaccctaccgttaaccgttaaccggacccgttaaacgtaccgttacggaacccgtacggttacccgtaaggtaaacgtactttaacggttacaaccttaacgttaattaaccgtttccgttaacgttacaaccgttaaggtttaacgtacgtaaagtttacccgtttaccccgttacccgtacccgtttacggtttacccgggttccggggaccgggtaaccggggttaaacggtacgggtacgggttaaacncggtttaaccggaacggttacgtcggtaggtcggtaccgttacgaccttaacccg

SEQ ID NO: 12090 - DNA, 712 bp, Homo sapiens
  misc_feature: GYAE6OF02FQPI1.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatcgtataggagacagaatccacactcacttcggccgggcgagtcgaggactaattaacatagtatcgtagtaagttgtactacagacgaacgaaaaccgaacgggtaaaccgaccccgtaaacctcctacgtaccttaccgtcggtaatcgactaacttaccgtaaagttaacggaaacggtacggggtaccctaggttacgtaaaggttcgtaacggtaggtaacggtcggtacgtacggtacggggtaacttaacggtttaactttttaccgtttaacgaccgtaccgttaccgacctaacgtacgtccggtacgtaccggtaccgtaagaacgtaacgttaggttaacaaacgtaacttaagtttaaccttaacctaagttaaccgtaaagtaacgttactaagtaactttacctacccgtcccgtactttaccgtaacggtttcggacccgggtaacggtaacggtagggtaggaccgtaaggtaccgtaacgaacggtagttcgggtactcgacgccgtaacccg

SEQ ID NO: 12091 - DNA, 612 bp, Homo sapiens
  misc_feature: GYAE6OF02HN0AD.52.2.A02.1.454.CMB.1.raw
  modified_base (429)..(429): a, c, t, g, unknown or other
  misc_feature (429)..(429): n is a, c, g, or t
  modified_base (490)..(490): a, c, t, g, unknown or other
  misc_feature (490)..(490): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatccctccctgtctgcatctagtaggagacagaatcaccatcacttggccggcgacgtcaggacattaacattgtatcgtagtaagtttggtaatccgagtacaaacggaaaacccaaggggaaaccctaccccctaaactccgtagaacttccgtacgatcgactactaccgtaagtttacggaaaccgtcgggtacccagtacgtaacggttcaggtaggagtcggtctgtaggacagtttctttacttcgacctgtaccgngtacgactgacacgactagaatatacgtagacaattatactacgtacgtaacaacgtatanataattacgtaccttaccgtacttacgtaaccgtttcggggacggaccgggtaacgtaaggggttcgaaataccgtacggtaacgacggtaacgttggacggtccttacggaccttaaccgg

SEQ ID NO: 12092 - DNA, 851 bp, Homo sapiens
  misc_feature: GYAE6OF02GV3DF.52.2.A02.1.454.CMB.1.raw
  modified_base (126)..(126): a, c, t, g, unknown or other
  misc_feature (126)..(126): n is a, c, g, or t
  modified_base (672)..(672): a, c, t, g, unknown or other
  misc_feature (672)..(672): n is a, c, g, or t
tcagcgcagtacgacacgaccggtgctcgatttagactcatctacaggggggagtcagtcccaaccaggacacagcatggacatgagggtccctgctcagctcctggggctcctgctgctctgctntcaggtgccagatgtatcatccagtactcgacccagtcctaccacttccctcctgtctgactatactaagtaggagaacaagtaactccaacctataccgtaccgttcgggcccggggtcgtaacggtacgaacggtaactaacgtttaaacctaagttacggttaactacgttaaggttaaagttttacggtaacgttaccgaaaggaaccgtaaaacccggaaaacccgggtaaaaccgggggtaaaacccctaaccccccgtttaaaaccggtaccccgttacggtaacccgtttacccgtaaccggtacgtaccggtaaccttaaccttaaaccgtttaaacgggtttaaaccggggtaaaacccgggtaccggggttaaccctaacgttaaccgggttaaacggttacgggtaagggttacgggtaaacgggtcggttaccggttacgggtacgggtaacgtttacggtttaacctttttaccgttacccgtaacctacggtaccacccgtagtaccctggacctacgacgtagaaacgtnttacgtacaactaactttaagttacttactacggtaaacctaagttaacgtagttacttaacgttacctccgtacccttaggttaccgttcgggaccgggttagggaaccggtaaggtaagggtacgacgttacgaccgtaaagttcccgaggttaggacggttctaccgtactaaccg

SEQ ID NO: 12093 - DNA, 796 bp, Homo sapiens
  misc_feature: GYAE6OF02G50RB.52.2.A02.1.454.CMB.1.raw
  modified_base (197)..(197): a, c, t, g, unknown or other
  misc_feature (197)..(197): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatcgacccagtcctcactcctcctgtctgactattactagtagganacgagtaactccaacctactctaccgttacgggccgggtagtacggtaccgaaggaacttaaacttaacgtagttacggttaacttacgttaaggttaacgtttaggttaactacgaagaaccgtaaacggaaaaccgaacggggtaaaccctaaccccgtaaacgttccgttacgaccttacccgtacgtagtcgacctaacgttacgttaacggtttaacgggaaaccgtaccgggtacctacgttaaccggtaacggttacgaggtacgggtaagtcggtacgtggtaacggtactagtttacttttacgttaccaacgtacgtaccacgttacgaccgttaggaccaacgttaccgtaaggtaagttacgtttactaacgtaaacctaacgtttatttaaccgttacgttaacgtaactaaacgttacgttaacgtacgttaaacgttacccgttaccttacccgttaccgttaacgtttccgggttaaccgggcgggtaaccggggtaacggttaacggggtacggtaaggttccgtaacgaacgggttaaaccggttggtaccgggtactaccggttacggaccctttaacgg

SEQ ID NO: 12094 - DNA, 761 bp, Homo sapiens
  misc_feature: GYAE6OF02JHTOV.52.2.A02.1.454.CMB.1.raw
tcagcgcagtacgacacgaccggtgctcgatttagactcatctacagggggggagtcagtcccaaccaggacacagcatggacatgagggtccctgctcagctcctggggctcctgctgctctggctctcaggtgccagatgtatcatccagatgacccagtctccatcctcctgtctgctatctaagtaggagaacagaactccacctactacctacgttcggaccgggtcgtagtacgaaggtaactaattaactattacggtaatcgtaaggtaagttcggtagtacgaaggtaccgaaacggtaaaaccggtaacgggtaaacccgtaccccttaaaacgttcccgtacgtaccttacccgtacgtaacgtccgaactaacttaaccgttaaacgtttaacgggaaaccggtaaccggggtaccctaagtaccggtaaacgggtttaccggtaagggttaacgggtacgggtacgggtaccgttacgggtacggggtaacgttaacgtttaacgtttttaccttacgaaccctacgtaccgtacctaaggtaccgtcgtaccgtaccgtacgtaagtacggtaacttcgtactaactaactaattacttagtacgtaactaacgtagtaacgtagtaaccttacgtaccgtacccgtacttaccggtaacgtttccgggaacggtacggtaaccggtagggtaaccggtagtaccgacgtaacggacgttacgtcggtacgtacgttacaccgtacg

SEQ ID NO: 12095 - DNA, 742 bp, Homo sapiens
  misc_feature: GYAE6OF02JYY21.52.2.A02.1.454.CMB.1.raw
tcagcgcagtacgacacgaccggtgctcgatttagactcatctacaggggggagtcagtcccaaccaggacacagcatggacatgagggtccctgctcagctccgtggggctcctgctgctctggctctcaggtgccagatgtatcatccagatcgacccagtctccactcctccctgtctgctagtctagtaggagacgagtaactcacctatccacgttcggccgggacgtacgtacaggactaacttaacagttagtactacgtagtaacgtttacggtactacgtaacgacgaaacggaaaccgtaaggggtaaacccaccccttaaaacgtccgtagtacctaccgtacggagtaccggacttacgtaacgttaaacggttacggaaaccggtacgggtaccctaagttacgggtaaaggttacgtaacgggtagggtaaacgtcggtaccgttacggtaggggtaaccttaaggttttaccttttaccgttaacacccgttacgtaccgtcccgtaagtaccgtacgaccgttacgtaccgtaacggtaattaacgttacgttaccgaaacttaactaacggtttaactacggtactaacgtaaacgtagttaacgtagtaccttaaccgttcctacccgtcggttactaccgggttacgggacggtaaccgtacggaagggttacaacgtagttaaccgagtaaccggtgtacggtgtacggtacaccgtaaccg

SEQ ID NO: 12096 - DNA, 830 bp, Homo sapiens
  misc_feature: GYAE6OF02HIIIW.52.2.A02.1.454.CMB.1.raw
  modified_base (626)..(626): a, c, t, g, unknown or other
  misc_feature (626)..(626): n is a, c, g, or t
tcagcgcagtacgacacgaccggtgctcgatttagactcatctacagggggggagtcagtcccaaccaggacacagcatggacatgagggtccctgctcagctccgtggggctcctgctgctctggctctcaggtgccagatgtatcatccagatcgacccagtcctccatccctcctgtcctgctatctagtaggagaacaagaactccaaccacttaccacgttcgggcccgggtacgtacggtacgacggtaactaattaaacagttaggttaactctaggtaaagtttggttaactgacgaacgtaaacggaaaacccggaaggtaaaacccgtaacccccttaaaccgtcctacggtaaaccttcccgtacgagtcgtaacctaataccgttaaagttaccgggaaaaccggtccggggtaaccctaacgttaaccggtaaagggtttccgtaaggtacgggtaaacggttcggtaccggttacggtaacggggtaaacctacggttttaacgtttttacccttaaccgtaccctaacgttccgaccgttaaacgggaccttaccggggccttaacgacccgttaagaaacggttacttacgttaaccgacttaaaacctnttttaacctaaccggttacgaaaccgtaagggttaaactttactaaggtaacctaacccggttttccgtaaccccgttaccgtttaaccggtacccggttttacggggaacccgggtaacggggtaccgtaaaacgggtccggaaggtaacgttaaccggacggtttaaacggcggttaccgtggtaccgttcgaaccgttccg

SEQ ID NO: 12097 - DNA, 797 bp, Homo sapiens
  misc_feature: GYAE6OF02IIL2X.52.2.A02.1.454.CMB.1.raw
  modified_base (191)..(191): a, c, t, g, unknown or other
  misc_feature (191)..(191): n is a, c, g, or t
tcagcgcagtacgacacgaccggtgctcgatttagactcatctacaggggggagtcagtcccaaccaggacacagcatggacactgagggtccctgctcagctcctggggctcctgctgctctggactctcaggtgccagagtgtactcactccagactacgacccagtcctccactccctccctgtctcnctatctaagtaggacgaacgaagaactccaacctactctaacgttcggacccgggacgtacgtacgaacggtaactaaacttaaactagttagtaaccttacgtaggttaaacgttaggttacacgacggtaacgaaaacggaaaacccgggtaaaccgggaaacccgttaaacccccttaaaacgtccgttacggtaaccttcccgtaacgtacgtacgtactaaacccttacgttaaaacggttaccggaaaccggtaccggtacccgtataccggtaagttacgaaggtacggtacggtcggtcggtacgaggtactaacggtttaactttaccgtttaccaacgtccgtcgaaccgtacgtacgtcgacgtaacgtcgaaaggtaaacttacttaaacgtagtaaaccgttaacttaacgtttaacttaccgtagtaaacttaacgtaattaacgtaacttaacttaaccttccggtaccttaacgttccccggtttaagggttcccggggaacgggttaaccgggtacggtaaacgggttgaccggttaaacggaacgtacggttaacgacggtttacggacggtactaccggaactaacg

SEQ ID NO: 12098 - DNA, 486 bp, Homo sapiens
  misc_feature: GYAE6OF02FF848.52.2.A02.1.454.CMB.1.raw
  modified_base (173)..(173): a, c, t, g, unknown or other
  misc_feature (173)..(173): n is a, c, g, or t
  modified_base (403)..(403): a, c, t, g, unknown or other
  misc_feature (403)..(403): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccattttccnccctgtctgcatctataggagacagaatcaccatcacttgccgggcagtcaggacattaacatgtatctgaatttggtatcagcagaaaccaggggaaagccccctaaaactcctagatcctcgatgcatccaatttggaaacaggggtccatcaaggtcagtggaagtgctctgggacagattttactttcacctatcgccagtactgcagcctgaagatattgacaanatattactgtcaacagtatgataatctcccgctcactttcggcgaggaccaaggtgagatcgagacgaactgtgctgcaaccg

SEQ ID NO: 12099 - DNA, 817 bp, Homo sapiens
  misc_feature: GYAE6OF02IM9UP.52.2.A02.1.454.CMB.1.raw
tcagcgcagtacgacacgaccggtgctcgatttagactcatctacaggggggggagtcagtcccaaccaggacacagcatggacatgagggtccctgctcagctccgtggggctcctgctgctctggctctcaggtcgccagatgtatcatccagatcgaccctgtcctccacttccctcccgtgtctcgctacttctaagtacggaacgaacaagaactccaacctactacctacggttccgggacccggggtacgtaacggtaccaacggggtaactaaacgtttaaacgtaacgttagttacgtttaccgtaaggttaaacgttagggtaacttacgaacggtaaccgaaaaccgggtaaaaaccgggaaaccggggtaaaacccgtaacccccgttaaaaccgttacccgtaacgttaacccgttacccgtaacggttactacgtaccgtaacgttaccttaaaggttaacggaaaccggtaccgggtacctacgtacggtaacgttgaaggtacggagtcgtacgtacggtacggaacttacgtttactttacgtaccactaacgtccgtacgtactaaccgttcaacgtcgtaagtaagtacgttataacgactaactaattacttacggtactaacctaagttacgtaattaaccgtaattaaccgtccgttaccgtaccgttaccggttaacggtttaccgggggaaacggtaccgggttaaacgggtacgggtaacggttaacgacggttaacgaaaccgtacgggttaacggtcggtttacggaccgtacccgtactaccggttacc

SEQ ID NO: 12100 - DNA, 651 bp, Homo sapiens
  misc_feature: GYAE6OF02JWXSW.52.2.A02.1.454.CMB.1.raw
  modified_base (230)..(230): a, c, t, g, unknown or other
  misc_feature (230)..(230): n is a, c, g, or t
  modified_base (269)..(269): a, c, t, g, unknown or other
  misc_feature (269)..(269): n is a, c, g, or t
  modified_base (504)..(504): a, c, t, g, unknown or other
  misc_feature (504)..(504): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcactccagatcgacccagtctcctatccctccctgtctgccattctagtaggacgacagtaactcaccatcacgtcggcggtacgngtcgagactataactatagtatctagtaattgtatctanacgaacgaaccgtaacggaaccgtaaccctaactaccgtacacgtccgtacgactcgactactaccttaacggttaacggtaaccgaacgggtcccaagtacgtaacggttacgtacgtagggtaacgtgtacgtacgacgggtactaggttacgtttaacttacctaacgtataccgagtacccgaaagtccgtacgtaccgagttccgacgtaagtacttagttacacgtaanattaactgtaacgtactaacgtaatacgtataccgttaacgttccgtacctcgttccggttcggttaccgggaaggggtaccgtagggtaaggtcgtaacgtacgtaacggtaacgttacggtggtcgtacgttaccgagtaacccg

SEQ ID NO: 12101 - DNA, 369 bp, Homo sapiens
  misc_feature: GYAE6OF02H5PYY.52.2.A02.1.454.CMB.1.raw
  modified_base (199)..(199): a, c, t, g, unknown or other
  misc_feature (199)..(199): n is a, c, g, or t
  modified_base (344)..(369): a, c, t, g, unknown or other
  misc_feature (344)..(369): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcacatcgccagactgcagcctgaagatattgcaacataattactgtcaacagtatgataatctcccgntcactttcggcggaggaccaaggtggagatcgaagacgaacgtgtggctgccaccatctgtctcatcctcccgcctattctagatagtcgacgttacgtctggacggccggggactgggacgaaacgggccgtacattaggctgnnnnnnnnnnnnnnnnnnnnnnnnnn

SEQ ID NO: 12102 - DNA, 926 bp, Homo sapiens
  misc_feature: GYAE6OF02FP96N.52.2.A02.1.454.CMB.1.raw
tcagcgcagtacgacacgaccggtgctcgatttagactcatctacaggggggagtcagtcccaaccaggacacagcatggacatgagggtccctgctcagctcctggggctcctgctgctctggctctcgaggtgccagatgtatcatccagatcgacccagtctccatcctcctgtctgcatctagtaggacacagtaactccgaacctatccgtaccttcgggaccggggacgtaacggtccgaacgggtaacctaaacgtttaaaccgaattacggtttaactaccgttaaggtaaacggttttagggttaacttacggtaacgaccgtaaaacgggaaaaaccccggtaacggggggtaaaaacccgtacccccttaaaaaccgttcccggtaacggttaaccttacccggttacgtaacgtcggtactaacgttaaccttaaaggtttaaaccggggaaaaccgtaccgggggttaaccctaaggttaccggtaaacgggtttaccgtaagggtacggggtaaaggttccggggtacgttaaccgggtagggtaaaccgttacgtttaaacgtttttaaccccttacgaaacccgtttacgtacccggtacctaacgggaccgttacggaccctaaccgggtaccttaaagggaaacgttacttaacgtttaacaaccgtaaaacttacgtttaaacttaaccttacgggtaaccttaaaaccgtagttacggtaaacgttaacgttaaaccgtttaccccggttacccttaactttaccccggttaacgggtttacccggggtacggggttaaaccgggaaccggttaaggggttacggaaccggtaaacggttaccggaaacggtaaccggtttaacggttcggggttaccggaacgtttccggtaacccgtaacccgg

SEQ ID NO: 12103 - DNA, 653 bp, Homo sapiens
  misc_feature: GYAE6OF02FV45J.52.2.A02.1.454.CMB.1.raw
  modified_base (211)..(211): a, c, t, g, unknown or other
  misc_feature (211)..(211): n is a, c, g, or t
  modified_base (213)..(213): a, c, t, g, unknown or other
  misc_feature (213)..(213): n is a, c, g, or t
  modified_base (286)..(286): a, c, t, g, unknown or other
  misc_feature (286)..(286): n is a, c, g, or t
tcagcgcagtacgacacgaccggtgctcgatttagactcatctacagggggggagtcagtcccaaccaggacacagcatggacatgagggtccctgctcagcctccgtgggctcctgctgctctggctctcaggtgccaggatgtactcgatccagtatacgaccctacgtcctcctacttcccttccctgtctgctatcgtagtacggananagtactcacctatcgtacgttcggccggtacgacgccgaagacctaattactatgtactgtagtattggtacncgatacgaagaaccgacggaaaccgtaccctaacgtctacgtccgtacgacgttagcactacgtttaacgtacggttaacggtaaccgtacgggtacctaggtacgtaacggtgaacggtaggtcggtcgtacggtccgtagacttacgtttaacgtttcctaacgctacgacgtcgacgtagtcgtacgtcgacgtaccgagtactaattcgtagtaacttactaactttatactacgtaactaacgttatagtacctacggtccttaccgcgttaccggtcggttacgtaccgggggaagttacgggacgtaggaacctacgggattaacgggacgtcgtacggttcaccgggtactactaccgg

SEQ ID NO: 12104 - DNA, 624 bp, Homo sapiens
  misc_feature: GYAE6OF02JX82H.52.2.A02.1.454.CMB.1.raw
  modified_base (135)..(135): a, c, t, g, unknown or other
  misc_feature (135)..(135): n is a, c, g, or t
  modified_base (140)..(140): a, c, t, g, unknown or other
  misc_feature (140)..(140): n is a, c, g, or t
  modified_base (167)..(167): a, c, t, g, unknown or other
  misc_feature (167)..(167): n is a, c, g, or t
  modified_base (189)..(189): a, c, t, g, unknown or other
  misc_feature (189)..(189): n is a, c, g, or t
  modified_base (203)..(203): a, c, t, g, unknown or other
  misc_feature (203)..(203): n is a, c, g, or t
  modified_base (248)..(248): a, c, t, g, unknown or other
  misc_feature (248)..(248): n is a, c, g, or t
  modified_base (252)..(252): a, c, t, g, unknown or other
  misc_feature (252)..(252): n is a, c, g, or t
  modified_base (263)..(263): a, c, t, g, unknown or other
  misc_feature (263)..(263): n is a, c, g, or t
  modified_base (298)..(298): a, c, t, g, unknown or other
  misc_feature (298)..(298): n is a, c, g, or t
  modified_base (372)..(372): a, c, t, g, unknown or other
  misc_feature (372)..(372): n is a, c, g, or t
  modified_base (508)..(508): a, c, t, g, unknown or other
  misc_feature (508)..(508): n is a, c, g, or t
  modified_base (608)..(608): a, c, t, g, unknown or other
  misc_feature (608)..(608): n is a, c, g, or t
  modified_base (617)..(617): a, c, t, g, unknown or other
  misc_feature (617)..(617): n is a, c, g, or t
tcagcgcagtacgacacgaccggtgctcgatttagactcatctacagggggggagtcagtcccaaccaggacacagcatggacatgagggtccctgctcagctcctggggctcctgctgctctggctctcaggtnccagntgtatcatccagatcgaccagtctccnctccctcctgtctgctatctanacggagacagtaanccaacatctcttcggcggtacgagtacgaagactaataacagttnactntagagtcgtancagacgaagaacggaacggtacccaaccgtctcgntactcacgatacgtactaacgtacgttaaggttaacggaaccggtacgtactaagttcggtaacggtgtaaggnggtaggtaccggtgtacggtaggtacttacttttaccttacgtacacgtacgtccgacgacgtctacgacgtagtacgtagtaactagtaactaactaactacgttaacttcgttaacacgtacgtaaactacgtntaaaccgccttaccgttccgtaacgtcgttaccgttacggtcgggtaccgtagggaacggtaggtacgttacgactacgtaaccggtcgaacggttcggngaccgttanacttacg

SEQ ID NO: 12105 - DNA, 972 bp, Homo sapiens
  misc_feature: GYAE6OF02I65DQ.52.2.A02.1.454.CMB.1.raw
  modified_base (257)..(257): a, c, t, g, unknown or other
  misc_feature (257)..(257): n is a, c, g, or t
  modified_base (612)..(612): a, c, t, g, unknown or other
  misc_feature (612)..(612): n is a, c, g, or t
tcagcgcagtacgacacgaccggtgctcgatttagactcatctacagggggggagtcagtcccaaccaggacacagcatggacatgagggtccctgctcagctccgtggggctcctgctgctctggctctcgaggtgccagatcgtatcatccagtactgacccagtctacctactccctcctgtactcgctatctagtacggagacagactacacctatctactcggccggtacgagtacgaggtactacttaacngttacgtacgtcgtaggtaagttacggtactaccgagtaaccgaaacggtaaacccggaacgggtaaacccgtaacccccgttaaaccttcccggtacgggtaacccttcctacggttacgtcgtacctaaccttaaccgtaaacggtttaacgggaaaacccggtacggggtaacccctaaggttaccgtaacggttcggtaacgggtacgggtaaacggttcgggtaccggtaacgggttacggggtaaccttaacggttttaaccgtttttacccgtaacccgtaaccggttaccgtccccggtaacctaacggtacccgtacgggtaccgtacccgttaaaacgggttaanaaacccggggttttattaacccgggtaacgtaaccgttaaaccgttaacttttaaaccgtttaaccgttaacggggttaaaacccttaaacgtttacggtttaaacgtttaaaccctttacgggttaaacccccctttcccgggggttaaaccctttcccccggtttaaacgggttacccggggtttaaccccggggggaaccgggggttaaaaacccgggggttccgggggttaaaacccggggttacgggtaaaaccggttacccgggttaaacccggggtaaaccgggttaaccgggttaaagggggtttccccggttacccgggtaaacccggttccccttaacccggtaaccccg

SEQ ID NO: 12106 - DNA, 923 bp, Homo sapiens
  misc_feature: GYAE6OF02JHESO.52.2.A02.1.454.CMB.1.raw
tcagcgcagtacgacacgaccggtgctcgatttagactcatctacaggggggagtcagtcccaaccaggacacagcatggacatgagggtccctgctcagctccgtggggctcctgctgctctggctctcaggtgcagatgtatcgatccagtatgacccagtcctcctactccctaccttgtctgcattctacgtaggagactagaacttcacctataccgtacttcgggccggtacaggtaccagggtaccaatttaacaattgtaatcgttacgaagtttagggtattaccaggtaccaaaccgggaaaaccgtaacggggtaaaaccggtaccccccttaaaacgtcccgttacgtaacgtaccctacgggtaaccttcgtaccgaacttaacccgttaaaggttttaccggggaaaaacctccgggggtaaccccctaagtttacgggtaaacgggtttccctaaaggggttacgggtaaacggttccgggtacccgttaacggggtaccgggggtaaaccttacgggtttaaacctttttaccggttttacccaaaccccgttaacgtaaccccggtttaccgaaacccgggttacgttaccggaaccgttaaaccgggtacccgtttaaagggtaaacggtaaccgtttaacttacgggtaaccttaaaacgtttaactttaaaccggttaccgtttacggttaaacccttaaacgttaacggttaaacgtttaccggtttaaaacttaacccggtttacctttaacccccggtatttaaacccccggaccgggtttttaacccggggcccggggtaaaacgggtacccggttaacggggtaagggtaccgttaaagtacccggtaaacggttaccggaaccggtttcggtaaccgtcggtacgtccgttaaccgg

SEQ ID NO: 12107 - DNA, 736 bp, Homo sapiens
  misc_feature: GYAE6OF02GJBXD.52.2.A02.1.454.CMB.1.raw
  modified_base (138)..(138): a, c, t, g, unknown or other
  misc_feature (138)..(138): n is a, c, g, or t
  modified_base (543)..(543): a, c, t, g, unknown or other
  misc_feature (543)..(543): n is a, c, g, or t
  modified_base (606)..(606): a, c, t, g, unknown or other
  misc_feature (606)..(606): n is a, c, g, or t
  modified_base (650)..(650): a, c, t, g, unknown or other
  misc_feature (650)..(650): n is a, c, g, or t
tcagcgcagtacgacacgaccggtgctcgatttagactcatctacagggggggatcagtcccaaccaggacacagcatggacatgagggtccctgctcagctccgtggggctcctgcctgctctggctctcagggtcnccagatgtatcatccaagtactcgacccagtcctccactcctccctggtcctaggcctaagttcgtaagtaacggaagaactaaggtaaactccaaacccggtattaccggtaaccgttcggggccccgggtgaaacggttccgaaaggttaaccaagttaaaccattaccgttataccgtagtaaacgtttacgggtaattaccggaagaccgtaaacggtaaaaaccgaacgggggtaaaccctaacccccgttaaactacccgtagacttaccgacgtagtacgactacgtactaagttaacggaaacgcgggttaccaagttaccgtaaggttacagtagggaacgtggacttacgggtaggactacggtttaacttttactccgtaaccagttacccganaacggtactacggccagtaccgtaagaacttaagtaccgttaagctaaaatcgttaacttacngtaacctaaagttataacttaggtacctaacgttccctacccgntttacccggacgtttcgacggacggttaacgagggttacaggactacggaaacgaccgttaaggaccgtggtacctatccgtaccg

SEQ ID NO: 12108 - DNA, 640 bp, Homo sapiens
  misc_feature: GYAE6OF02GCDHB.52.2.A02.1.454.CMB.1.raw
  modified_base (133)..(133): a, c, t, g, unknown or other
  misc_feature (133)..(133): n is a, c, g, or t
  modified_base (196)..(196): a, c, t, g, unknown or other
  misc_feature (196)..(196): n is a, c, g, or t
  modified_base (219)..(219): a, c, t, g, unknown or other
  misc_feature (219)..(219): n is a, c, g, or t
  modified_base (235)..(235): a, c, t, g, unknown or other
  misc_feature (235)..(235): n is a, c, g, or t
tcagcgcagtacgacacgaccggtgctcgatttagactcatctacaggggggagtcagtcccaaccaggacacagcatggacatgagggtccctgctcagctcctgggctcctgctgctctggctctcaggtnccagatgtatcatccagatcgacccagtcctccactccctccctgtctgctatctagtagganacagactcacatcactggccggnagtccgagactatacntgtatctagtatttgatcatacaacgaaaccgaacgggaaccacccctaactctacgtacctccgcgtaactcgactaacgttaccgtaagttaacggaaaccgtaccgggtaccctaacgtacgtacgggttacgaaggtaggtacggtcgtacgttacggtacgggtaacgttacgtttaacttttaccctacgtaccgtacgtaccgacctaggacgtcacgtacgactagaagttatcgtaacacctaacttattaacgttactacgtaactaactaagttacgtaattactacctcccgtcctacgttacgttaccggttacgggcggtaacggtaaccggagggactaacggtacgttacgaacgttacgtacggttacggagttccgactaccgtacc

SEQ ID NO: 12109 - DNA, 640 bp, Homo sapiens
  misc_feature: GYAE6OF02GI8F7.52.2.A02.1.454.CMB.1.raw
  modified_base (192)..(192): a, c, t, g, unknown or other
  misc_feature (192)..(192): n is a, c, g, or t
  modified_base (217)..(217): a, c, t, g, unknown or other
  misc_feature (217)..(217): n is a, c, g, or t
  modified_base (238)..(238): a, c, t, g, unknown or other
  misc_feature (238)..(238): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtgccagatgtatcatccagatgacccagtctccatcctccctgtctgcatctataggganacagaatcaccatcacttggccggnagtcaggacattaacatgtanctgtaattggtatcagactagaaaccgagggaaacgcccctaaactcctagactcctcgatcgactatacctaagtttacggaaaccgtacggggtaccctaagtacgtaaggtttaccgaaggtagggtaagtcggacgttacggtcggggaacctaggttactttttaccttacgtaccctagttcccgacccgtacgaccgttcgaccgtacgtacccgtaaggaacgtaagttaacgttgaacctaaactaacttacttaacgtagtaaccgtaatagttatacgtaattacttccctcccgtacttacctacggtttccgggacggtaacgggtacgtaacgggtaggaacgtacgtacgtaaggacgtaacggtggacgtcggtacgacctaaccg

SEQ ID NO: 12110 - DNA, 357 bp, Homo sapiens
  misc_feature: GYAE6OF02HKAMH.52.2.A02.1.454.CMB.1.raw
  modified_base (201)..(201): a, c, t, g, unknown or other
  misc_feature (201)..(201): n is a, c, g, or t
  modified_base (267)..(267): a, c, t, g, unknown or other
  misc_feature (267)..(267): n is a, c, g, or t
  modified_base (335)..(357): a, c, t, g, unknown or other
  misc_feature (335)..(357): n is a, c, g, or t
tcagcgcagtacgacacgaccggtgctcgatttagactcatctacagggcacgaccggtgctcgatttagactcatctacaggggtcccatcaaggttcagtggaagtggctctgggacagattttactttcaccatcgccagactgcagcctgaagatattgcaacatattactgtcaacagtatagataatcctcccgntctacgtttcggcggagggaccaaggtggagatacagacgacgtggtgcgtgcactatctgtctcncttcctcccgctatctagtatagacgtatcgctgacggcgggcgtaggacgaacggcgacgtagtagnnnnnnnnnnnnnnnnnnnnnnn

SEQ ID NO: 12111 - DNA, 865 bp, Homo sapiens
  misc_feature: GYAE6OF02GDLES.52.2.A02.1.454.CMB.1.raw
tcagcgcagtacgacacgaccggtgctcgatttagactcatctacaggggggagtcagtcccaaccaggacacagcatggacatgagggtccctgctcagctccgtggggctcctgctgctctggctctcaggtgccagagtgtatcatccagatcgacccagtcctccactcctcctgtctacgcaattctacgtaggagtaccaggtaactcaccatcacgttcggccggtacgtacggtcgaaggtacctaagttaacagttagtactacgtagtaagttcggtatacgacgacgtaacggaaaccggaacgggtaaacctacccccgttaaacgtccgtacggtaaccctaccgttacgtaacgtccggaacttaaccgtaaccgttaacggtttaaccgggaacgtaccgggttaacctacgtaacgtacggtttaccgtaggtacgggtacggtcgtactcggggttagacgtacggtttaactttttactaccgtaacctcgtacccgggtactaacggtcgttacgaccggtaactaccgggttaagaaaccggtttgttaaaccgtttacggggaaccctttaaactaaccggttttaacgtttaaacccgtccggtttaaaccggtaaacgttaaccggttaagtttaaaccggttaacgttaaccccggttttaacccgtacccgggttaaccccttaaaccggttttcccgggggtaaccgggttacggggtaaacccggggttaacggtaacccggggtaacttaaccgggttaacgtaaacggttaaccgggttaaccgtaacgggtttccggtacggggtaaccccctttaggaacccccggtttaacgg

SEQ ID NO: 12112 - DNA, 618 bp, Homo sapiens
  misc_feature: GYAE6OF02JUCEM.52.2.A02.1.454.CMB.1.raw
  modified_base (147)..(147): a, c, t, g, unknown or other
  misc_feature (147)..(147): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (204)..(204): a, c, t, g, unknown or other
  misc_feature (204)..(204): n is a, c, g, or t
  modified_base (232)..(232): a, c, t, g, unknown or other
  misc_feature (232)..(232): n is a, c, g, or t
  modified_base (247)..(247): a, c, t, g, unknown or other
  misc_feature (247)..(247): n is a, c, g, or t
  modified_base (263)..(263): a, c, t, g, unknown or other
  misc_feature (263)..(263): n is a, c, g, or t
  modified_base (266)..(266): a, c, t, g, unknown or other
  misc_feature (266)..(266): n is a, c, g, or t
  modified_base (272)..(272): a, c, t, g, unknown or other
  misc_feature (272)..(272): n is a, c, g, or t
  modified_base (295)..(295): a, c, t, g, unknown or other
  misc_feature (295)..(295): n is a, c, g, or t
  modified_base (313)..(313): a, c, t, g, unknown or other
  misc_feature (313)..(313): n is a, c, g, or t
  modified_base (476)..(476): a, c, t, g, unknown or other
  misc_feature (476)..(476): n is a, c, g, or t
  modified_base (483)..(483): a, c, t, g, unknown or other
  misc_feature (483)..(483): n is a, c, g, or t
  modified_base (493)..(493): a, c, t, g, unknown or other
  misc_feature (493)..(493): n is a, c, g, or t
  modified_base (603)..(603): a, c, t, g, unknown or other
  misc_feature (603)..(603): n is a, c, g, or t
tcagcgcagtacgacacgaccggtgctcgatttagactcatctacagggggggagtcagtcccaaccaggacacagcatggacatgagggtccctgctcagctccgtggggctcctgctgctctggcctctcaggtgccagatgtancatccgagatacgacccagttcctcctactccctcccgtgtctncnttcagtagganacagatcactatcaccgtggccgggtanagtcagacattaacntgtatctgtagtgtcnganacgganaaacggagggaacacccctaacnccgtacgtaactccgtanactcgaactctacgttaacttaggaaccggtcggtaccagtataaccgggtgtaacggtacgggtaacgtcgttaggtacgtacggggtaactacgtttattttaccctacggaccctttagacccgtagccgtaacgtacgtcgacgtactaggacgtactnttaacgngtaaaccttnttaactcgtactacgtaagaattccgtatacttactccgtctaccgtcgacgtttacgggacgtaacgggtacgtaacggtgtacgtacaacgtcgtaagggtacgtcgngtaacgttcacgtac

SEQ ID NO: 12113 - DNA, 647 bp, Homo sapiens
  misc_feature: GYAE6OF02IB1KL.52.2.A02.1.454.CMB.1.raw
  modified_base (134)..(134): a, c, t, g, unknown or other
  misc_feature (134)..(134): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcaggtnccagatgtatcatccagatcgaccctagtctccatccctcctgtctgctatctagtaggatacaagaactccaacatcacgttcggcccgggtgtacgtacgacggtaactaagttaacagttgtacttcgtagtaagtttcggtactcaacgactaacggaaaaccgaagggaaacccgtacccctaaacgtccgtagtaccgtcctacgatcgtactataccgtaagttacggaacgtcggtaccagtcgtagtcgagtagagtcgcgtcgtacgactagttactttacgttccactacgtccgtaaccgtagtacgtcggacacggtactaagtattatacgttcgaactaacgtatttaacgttacgtaagtactaaacgtaaggtacttagtaacttacctaccgttcccacgttaccggtaccggttacggggaccggtaaaggtccggtaaggtacggtagaccgttaacgaggtaacgcggttggtacgtcgtaccgactaacgg

SEQ ID NO: 12114 - DNA, 789 bp, Homo sapiens
  misc_feature: GYAE6OF02GWVTI.52.2.A02.1.454.CMB.1.raw
  modified_base (220)..(220): a, c, t, g, unknown or other
  misc_feature (220)..(220): n is a, c, g, or t
  modified_base (548)..(548): a, c, t, g, unknown or other
  misc_feature (548)..(548): n is a, c, g, or t
  modified_base (572)..(572): a, c, t, g, unknown or other
  misc_feature (572)..(572): n is a, c, g, or t
tcagcgcagtacgacacgaccggtgctcgatttagactcatctacaggggggagtcagtcccaaccaggacacagcatggacatgagggtccctgctcagctcctggggctcctgctgctctggctctcgaggtgccaggtatggtaatcaatccagacgttcaccccgagtcctacctacttccccgttccgtggttctggcctatacgtaagtagganacgagtaactccgacctattctacgttcggaccgggagtacgtccgaaggtaacctacttaaacgtgtacgttatcctaagttaacttaggtaacgtcacgtaccggaaacgaaaccggacgggaaaccccgtaaccccgtaaaccgttccgtagtaccgttccgtcggtataccgacgttacctaacgttaacggttaacggaaaccgggttaccgggtacctaacgtaccggttaacggtcctaaaggggtgttaacgggtcgtacgtgggaacgtacgtagtttaccgttaccttaccggacctacgtaccaccgtagtaccggntaccggcaccgtaaggttaacgtntaaccggttacaaaccgttaaacgtcttaacgtacgtttaaccggtaacctaagtaaccgttaagttaacggtaactttacccgtacgtaccctcggtttaacccgttagggtaccgtaacgggggtccgtaaacgtcgggggtaaggtaaccggtaacgttcgtaaaacgggtcggttaaacgggtccgttcggtaacccggtgtaccgtaaccgg

SEQ ID NO: 12115 - DNA, 806 bp, Homo sapiens
  misc_feature: GYAE6OF02F5CKA.52.2.A02.1.454.CMB.1.raw
tcagcgcagtacgacacgaccggtgctcgatttagactcatctacagggggggagtcagtcccaaccaggacacagcatggacatgagggtccctgctcagctccgtggggctcctgctgctctggctctcgaggtgccagatgtatcatccagatcgaccctagtcctccatccctcctgtctgctatctagtaggagacagaactcacctactctacgttcggccgggacgaggtcgaggactattaacagtgttatcgtagaagttggtactcagactaaggaaaccgaacgggaaacccaccccgttaaactcgtactacgtcctacgatcgactactaacgtaagttacggaacgtacgggtacctagtacgtaaggttacgaaggttacgggtaaggttcggtaccgtagggtacggtaacgttaacggtttacttttttaaccgtacctaactacgttacgaccggtcgtaacggtgttaaccgccgtaaccgtacgttaacggtaacgttaagtttacgttaacgaccgttaaaacgttactttaaacgttttaccggttacgtaaaacccgttaaggtttaaagtttaaccgttaacggtaccttttaaccggggtacccccttaccccgttaacgggtttacccgtttaccggggggttttaacgggggcccccggggggtaaaacggtaagggggttaccgggaaaacgggttacgaaaccggggttaaccgacccggggtttaaccggtttaggggaccgtttaacccgggtaccgtaaccccgtttaaccggg

SEQ ID NO: 12116 - DNA, 728 bp, Homo sapiens
  misc_feature: GYAE6OF02HBJ8L.52.2.A02.1.454.CMB.1.raw
  modified_base (133)..(133): a, c, t, g, unknown or other
  misc_feature (133)..(133): n is a, c, g, or t
tcagcgcagtacgacacgaccggtgctcgatttagactcatctacaggggggagtcagtcccaaccaggacacagcatggacatcgagggtccctgcgtcagctccgtggggcctcctgctgctcgtggctcncgaggtgccagatgtactcatccagactcgacccagtcctccagtccctcccgtgtacctgctatctaagtaggagacagatcccaacctatccacgttcgggccggtcgtacgtacgaaggactaattaacatcggttatctagtaacgtttcggtaatcccgaagtcgaaacgtaaaccggaacggggaaacccttacccccgtaaaacgttccgtaacgtacctccgtacggacctcgaccgtacgtaaccttaaggttacggaaaccggtcgggtaccctagtaccgtaaggttcaagggttggaacggtcggtacttcggtacggtacttagttacttttaccgtacacgtaaccgtcccgacgacgtaccgaggtaccgtacgtaccgtaagggtaactaagttacgttacaccgtaaactactttagttaaccaaggttaaccctaaattaacggttactaacgtaacttaccgtacccgttacccgcttaaccgttaccgggttacgggacccggggtacgaaccgggttgggaccggactaacggttaccgaggtaaccgtacgtggacgtctacggtcctaaccg

SEQ ID NO: 12117 - DNA, 832 bp, Homo sapiens
  misc_feature: GYAE6OF02G11US.52.2.A02.1.454.CMB.1.raw
  modified_base (131)..(131): a, c, t, g, unknown or other
  misc_feature (131)..(131): n is a, c, g, or t
tcagcgcagtacgacacgaccggtgctcgatttagactcatctacagggggggagtcagtcccaaccaggacacagcatggacatgagggtccctgctcagctcctggggcctcctgctgctctggctctnaggtgcagattgtatcatcagatcgaccagtcctctactccctccgtgtctgctatcgtaagtaggacgaacaagaactccaaacctacgtaccgtaccggttaccgggacccggggtacgtaacggttaccgaacggtaaccttaaaacgtttaaacgtaactttaggttaacttacgttaaaggttaagttttaggttaacgtacgtaacggaacggaaaaccggaaaacggaaaaccggggtaaaacccgtaacccccgtaaaacgttcccgttaacgtaccgttccgtacggtacgtacgtacctacgtaaccgttaacggttaacggaaaccggttacgggtacctaacggttacgtaacgggtacggttaacgggtaggtagggttcggtacggttacggtacgggttaactaacgttttacgtttttaaccgttacctaccgtacgtacccgtactaacgtacgtcgacgtaccgtactaggtaaacgtattacgtaagacttaaagtactttaacggtttactacgttaaacgtaacgtaattacgtaagtaacttaccgttcctaacccgttcgttaacgttaccggtacgggtacgggaaccgggttaaacggtggggttaaccgagtaaccggttaacggtaacggaacggttacggttaaggtccggtacgtaccgtacggttaacccg

SEQ ID NO: 12118 - DNA, 695 bp, Homo sapiens
  misc_feature: GYAE6OF02J2VIW.52.2.A02.1.454.CMB.1.raw
  modified_base (192)..(192): a, c, t, g, unknown or other
  misc_feature (192)..(192): n is a, c, g, or t
  modified_base (515)..(515): a, c, t, g, unknown or other
  misc_feature (515)..(515): n is a, c, g, or t
tcagcgcagtacgacacgaccggtgctcgatttagactcatctacaggggggagtcagtcccaaccaggacacagcatggacatgagggtccctgctcagctcctgggctcctgctgctctggctctcaggtgccagtatgtatcatccagatgacccagtcctccatcctccgtgtctagcatctataggnacagtatcaccatcacgttcgccggcgtagtacgaggactagttaacagttcgagtactagtaagttcgtatacgagacaaaggaaccgtagggaaaccctaccctaaatcccgtagaacgttcccgactaggtcctaactccgtaaccgtaaggtttacggaaaaccgttccggggtacccaacggttacgtaaacggtccgtaaggggttacggaacggtcgtaacccggtggttaacggtaaccgttagtttaccttactttaaccaccggtaactccgaacggtttaccgacgttacggtacgtaccgtacggttaaanaacgttacgtactacgtaactaacgtacttacgctagaacgttacttataagttaccacgttaccgtaccctacccggttacgtaccggttaccgggtcggggaccggtagggtaccggtacggagtacggtacctaaggaacgttacgtacggtcgggaccgtaccgtacctaccgttc

SEQ ID NO: 12119 - DNA, 624 bp, Homo sapiens
  misc_feature: GYAE6OF02FXB9I.52.2.A02.1.454.CMB.1.raw
  modified_base (275)..(275): a, c, t, g, unknown or other
  misc_feature (275)..(275): n is a, c, g, or t
tcagcgcagtacgacacgaccggtgctcgatttagactcatctacaggggggagtcagtcccaaccaggacacagcatggacatgagggtccctgctcagctcctgggctcctgctgctctggctctcaggtgccagatgtatcatccagatgacccagtctccatcctcctgtctgcatctaatacggagacagaactcaccatcaacttgaccggtcagtcaggtacaattaacatgtatcgtagaattggtatcagcagaaacagggaaacncccctaaatcctagactccgacgatagcataccgtaatttacggaaactacgggtacccaagtacgtaacggttacaggttaggaagtcggtacgtactggggaacctaggttacttttaccgtttacgaacctaacgtcgaccacgacttggaccagtccctaaggaacgaattagttacgactacgtaatactttaactagtaaccaaacttagtaatcggttaaataccttcgtaacccgtacgtaccgttacgttaccgggacgggtaacggaacggtaaacgggttaggaacgtaagtaccgtaacgtacggaacttccgggtagtacccgttagacctaaccg

SEQ ID NO: 12120 - DNA, 758 bp, Homo sapiens
  misc_feature: GYAE6OF02HB5IR.52.2.A02.1.454.CMB.1.raw
  modified_base (205)..(205): a, c, t, g, unknown or other
  misc_feature (205)..(205): n is a, c, g, or t
  modified_base (389)..(389): a, c, t, g, unknown or other
  misc_feature (389)..(389): n is a, c, g, or t
  modified_base (670)..(670): a, c, t, g, unknown or other
  misc_feature (670)..(670): n is a, c, g, or t
tcagcgcagtacgacacgaccggtgctcgatttagactcatctacgagggggggagtcagtcccaaccaggacacagcatggacatggagggtccctgctcagctccgtggggctcctgctgctctggcctctcgaggtcgcctagtagtgtactcacgtccaggactcgacccgtgtcctacctactccccttcccttgttccngtctactacgtagtagggaacgtaagatccacctagtcctacggttcggcccgggtacgtacgtacgaacggaacttaagttaacctagttacgttacttaggtagttacggtttacggtaacacgaacgtaacgaaaaccgggtaaaccggaacggggtaaaccccctaacccttaaccgtcnccgttaacctcccgtaagtcgacgtaccgtaacttaacggttaaaccgtaaccggggaaaccggttaccggtaccgttaaccgttacgggtacgggtagacggggttaacggtacgggtcgtacggttggaaacggttacgtttactttaccgttttccttacacccggttactccggacgtacgtccgtagactaccggtcgtaagtaaccggttattacggttaccaacgttaattacgtacttgaacgtacctaagttatagtactacttccgtaccncgtacgttccgtacgggtcggacgtcgggaacggtaggacgtaagtcggtaacgtaggtacgttacggtcggataggccgtacctacg

SEQ ID NO: 12121 - DNA, 757 bp, Homo sapiens
  misc_feature: GYAE6OF02IUE0L.52.2.A02.1.454.CMB.1.raw
  modified_base (617)..(617): a, c, t, g, unknown or other
  misc_feature (617)..(617): n is a, c, g, or t
tcagcgcagtacgacacgaccggtgctcgatttagactcatctacaggggggagtcagtcccaaccaggacacagcatggacatgagggtccctgctcagctccgtggggcctcctggctgctctggctctcaggtgccagatgtactcatccagactcgacctagtctacccattccctcctgttcctggtaccagttccgtaagtagggacgtacgaacgaactaccaccgacttaccctacgttcgggaccgggtacgtacggtaccgtaagggtaacctaacttaacgtaacggttggtaacttaccgtaaggttaaagttcggttaactcgacggtaacgaaaccggtaaaacccggaaagggtaaaaccccgtaccccttaaaccgtccgttagaccgttcctacggtaactgaactacttaccgtaagttaacggtaacgccggtacccagttaccgaaggttcgtagtacggtatcggtagtacgtaggatacgttacttttacctaccgaaccgtattaccgacctacgaccgttacgaccgtacgtacgaacgtaagtacgttaataccggaactaaacgttattaacctttagacttaaccttaanagttacgtaagtaactaccgtccttacccgtacttaccgtaccggtccgggttaggaaccgggtacccgggtaagaccggtaagaaccttacggaaaccgttacggtacggttcgggacgtaccggtacgtccctaaccg

SEQ ID NO: 12122 - DNA, 797 bp, Homo sapiens
  misc_feature: GYAE6OF02FSCWO.52.2.A02.1.454.CMB.1.raw
tcagcgcagtacgacacgaccggtgctcgatttagactcatctacaggggggagtcagtcccaaccaggacacagcatggacatgagggtccctgctcagctccgtggggctcctgctgctcgtggctactcaggtgccagatgtatcatccagtatcgaccctagtcctaccactcctccctgtcctgctatctagtaggagacagaactccaccgatctacgtcggccggacgacgtcgaaggacctaattaacagtacgtagttccttagtaatttaggtactcgaggtaacgaacggtaaaaccgaacgggtaaaccgtaccccccgttaaaccgtccgtagtaccgttcccgtagtacgtctaccgttaacgttaacccgttaaaggtttaaccggaaaccggtacggggttaccctaaaccggttaacgtaaacggtttggtaaacgggtagggtaaacggttccggtaacgttcggggtaacgggttaacttacggttttaacttttaccttttaccgaaccttacgtacccgaccgtaacggttaccgtcggaccgttcgaaccgtaggtaacgttacgttaacgtacggtaacctaacgttaacttaccgtttaacttacgtaacttaaacgactttaggttaactaacttaacccgttccttaccccgtagttacccgttaccgttacgggtaccgggtacgggaaccgtaagggtaaggtaaccgttacgaacggtttaaccggtaaccgttggtacggtaccctaccggttacgtacctaacccg

SEQ ID NO: 12123 - DNA, 777 bp, Homo sapiens
  misc_feature: GYAE6OF02FZ6MW.52.2.A02.1.454.CMB.1.raw
  modified_base (209)..(209): a, c, t, g, unknown or other
  misc_feature (209)..(209): n is a, c, g, or t
  modified_base (661)..(661): a, c, t, g, unknown or other
  misc_feature (661)..(661): n is a, c, g, or t
tcagcgcagtacgacacgaccggtgctcgatttagactcatctacaggggggagtcagtcccaaccaggacacagcatggacatgagggtccctgctcagctccgtgggctcctgctgctcgtggctctcgaggtgccagatgtatcatccagactacgaccctagtcctcctactccctccgtgttcctgctattacgtagtacgganacacgtaactcaaccgtataccgtacgttcggccgggtcgtacgtacgaagtactaacgttaactagttacgttactcgttaagttacgtttaggactacgagaaccgtaaacggaaaccggaacgggtaaacccgtaccccgttaaacttccgtacgtacctccgtaggtactcgtactacgttacgttaacgttaacggaaccggtacggtcctaagtacgtacgttcgaggtacggtacggtgtacgttcggtaacggtaattacgtttacttttaccgtaccgaaccgtaccgtacccgacgtaacggtctccggtaccgtaacggtaccgaaggttaactacgtttaacgtaccgaacgttaaagttacctttaagttacccggttacgtaaaacgacgtttaggttaacgtaacgttacgttccgggttacccctaccccggtttntttaaccccggggttaaccgggggttccgggggtaacggggtaccggtaagggttcgtaacccggtagaacggttacggtacgacggtttcggaccgtctaccggtacctgttacg

SEQ ID NO: 12124 - DNA, 768 bp, Homo sapiens
  misc_feature: GYAE6OF02F61XQ.52.2.A02.1.454.CMB.1.raw
  modified_base (148)..(148): a, c, t, g, unknown or other
  misc_feature (148)..(148): n is a, c, g, or t
  modified_base (157)..(157): a, c, t, g, unknown or other
  misc_feature (157)..(157): n is a, c, g, or t
  modified_base (205)..(205): a, c, t, g, unknown or other
  misc_feature (205)..(205): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
tcagcgcagtacgacacgaccggtgctcgatttagactcatctacagggggggatcagtcccaaccaggacacagcatggacatgagggtccctgctcagctccgtggggctcctgctgctcgtggctctcgaggtgccagatgtacncatccgagntcgaccagtcctcctactccctccgttgtcgtgcattcgtagtagganacaagtactccgaccaactccgtacgttcgggaccggtacggatacggacgtaactattaacgnttgtatacgtagtaacttcggtanacgaaggacgtaacgaaaccgagggtaaacccgtacccctaacgtcctagtacctaccctggtactcggaccttataccgttaagttacggaaccgttacgggacctaacgtacgtaaggttgaggtaggtaacggtcgacgtacggtggtacttagtttacctttacttaccaccgtactacggtaccaacggtccgtacgacccgtagtaccgtaaggtacgtaggttactaccgtataacgtttacgtacctaacgtacgtaactaacggttagtttaaccgtacgttaaccgttacccgtacccggttaccccgtttagttacccggttaccggggtttaaccggggacccggggtaaacccgggggtaactttaaccggggggtaacgtaaaccttaacccggggtaattaaccccggggttaaggttaccgggtaggtacccggtttaaccacggtacccgtttaaacg

SEQ ID NO: 12125 - DNA, 427 bp, Homo sapiens
  misc_feature: GYAE6OF01EL5CF.25.41.D08.1.454.CMB.1.raw
  modified_base (423)..(427): a, c, t, g, unknown or other
  misc_feature (423)..(427): n is a, c, g, or t
tcagactgtacagtcacgaccggtgctcgatttagtcacgcgagaaagggaaagggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaaccctggtcaccgtctcctcagcctccaccaagggccccatcggtcttccccctggcgccctgctcccaggagcacctccgagagcacagcggccctgggctgcctggtcaaggactacttccactgtacagtctgagcgggctgggcaaggcgcatagnnnnn

SEQ ID NO: 12126 - DNA, 429 bp, Homo sapiens
  misc_feature: GYAE6OF01BGDRX.25.41.D08.1.454.CMB.1.raw
  modified_base (418)..(418): a, c, t, g, unknown or other
  misc_feature (418)..(418): n is a, c, g, or t
  modified_base (424)..(429): a, c, t, g, unknown or other
  misc_feature (424)..(429): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatgggggactgccacggtgttgactactggggccagggaaccctggtcaccgtctcctcagcctccaccaagggcccatcggtccttccccctggccgccctgcctccaggacgcacctccgagagcacagcggcactgggctgcctggtcaaggctactccactgtacagtctgagcgggctggcaaggcncatagnnnnnn

SEQ ID NO: 12127 - DNA, 429 bp, Homo sapiens
  misc_feature: GYAE6OF01EX315.25.41.D08.1.454.CMB.1.raw
  modified_base (422)..(429): a, c, t, g, unknown or other
  misc_feature (422)..(429): n is a, c, g, or t
tcagactgtacagtcacgaccggtgctcgatttagtcacgcgagaaagggaaagggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaaccctggtcaccgtctcctcagcctccaccaagggccccatcggtcttccccctggccgccctgctccaggagcacctccgagagcacagcggccctgggctgactggtcaaggactacttccactgtacagtctgagcgggctggcaaggcgcatagnnnnnnnn

SEQ ID NO: 12128 - DNA, 432 bp, Homo sapiens
  misc_feature: GYAE6OF01ERPVO.25.41.D08.1.454.CMB.1.raw
  modified_base (426)..(432): a, c, t, g, unknown or other
  misc_feature (426)..(432): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatgggggactgccacggtgttgactactggggccagggaaccctggtcaccgtctcctcagcctccaccaagggccccatcggtcttccccctggccgccctgcctccaggacgcacctccgagagcacagcgcctgggctgcctggtcaaggactacttccactgtacagtctgagcgggctgggcaaggcgcagtagnnnnnnn

SEQ ID NO: 12129 - DNA, 425 bp, Homo sapiens
  misc_feature: GYAE6OF01AV7XR.25.41.D08.1.454.CMB.1.raw
  modified_base (419)..(425): a, c, t, g, unknown or other
  misc_feature (419)..(425): n is a, c, g, or t
tcagactgtacagtcacgaccggtgctcgatttagtcacgcgagaaagggaaagggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaaccctggtcaccgtctcctcagcctccaccaagggcccatcggtcttcccctggcgccctgctccaggagcacctccgagagcacagcggccctgggctgcctggtcaaggactacttccactgtacagtctgagcgggctggcaaggcgcatagnnnnnnn

SEQ ID NO: 12130 - DNA, 431 bp, Homo sapiens
  misc_feature: GYAE6OF01ACZD1.25.41.D08.1.454.CMB.1.raw
  modified_base (421)..(431): a, c, t, g, unknown or other
  misc_feature (421)..(431): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtattgactactggggccagggaaccctggtcaccgtctcctcagcctccaccaagggcccatcggtcttccccctggcgccctgcctccaggagcacctccgagagcacagcggccctgggctgcctggtcaaggctactccactgtacagtctgacgcgggctggcaaggcgcatagnnnnnnnnnnn

SEQ ID NO: 12131 - DNA, 431 bp, Homo sapiens
  misc_feature: GYAE6OF01A31EI.25.41.D08.1.454.CMB.1.raw
  modified_base (422)..(431): a, c, t, g, unknown or other
  misc_feature (422)..(431): n is a, c, g, or t
tcagactgtacagtcacgaccggtgctcgatttagtcacgcgagaaagggaaaggggctggtgtgggtctacacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccaggtgttgactactggggccagggaacccctggtcaccgtctcctcagcctccaccaagggcccatcggtcttccccctggcgccctgctccaggagcaccctccgagagcacagcggccctgggctgcctggtcaaggctacttccactgtacagtctgagcgggctggcaaggcgcatagnnnnnnnnnn

SEQ ID NO: 12132 - DNA, 428 bp, Homo sapiens
  misc_feature: GYAE6OF01BFRJW.25.41.D08.1.454.CMB.1.raw
  modified_base (417)..(417): a, c, t, g, unknown or other
  misc_feature (417)..(417): n is a, c, g, or t
  modified_base (423)..(428): a, c, t, g, unknown or other
  misc_feature (423)..(428): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactacgtggggccagggaaccctggtcaccgtctcctcagcctccaccaagggcccatcggtcttccccctggcgccctgcctccaggacgcacctccgagagcacagcgccctgggctgcctggtcaaggactacttccactgtacagtctgagcgggctggcaaggcncatagnnnnnn

SEQ ID NO: 12133 - DNA, 491 bp, Homo sapiens
  misc_feature: GYAE6OF01C7LQ3.25.41.D08.1.454.CMB.1.raw
  modified_base (243)..(243): a, c, t, g, unknown or other
  misc_feature (243)..(243): n is a, c, g, or t
  modified_base (322)..(322): a, c, t, g, unknown or other
  misc_feature (322)..(322): n is a, c, g, or t
  modified_base (346)..(346): a, c, t, g, unknown or other
  misc_feature (346)..(346): n is a, c, g, or t
  modified_base (470)..(491): a, c, t, g, unknown or other
  misc_feature (470)..(491): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaaggccgattcaccatctccagagacaacggcaagaacacggtggatctgcaaatgaacagtctgagagccgaggacacggcggtgtattattgtgtaagaggctgtgatggggactgccacggtnttgactacgtggggccagggaccctggtcaccgtctcctcagccctccaccacgggccccagtccggtccttcccccgnggccgcccctgcctaccgaggacnccaccgtccgaagacgccacgacgccggccctggggcctcggcccttagggtaccaaacggtccttacttcccacttcgtaacagtacgtggacggccgggtctgggacgaaggcgacagtagnnnnnnnnnnnnnnnnnnnnnn

SEQ ID NO: 12134 - DNA, 475 bp, Homo sapiens
  misc_feature: GYAE6OF01EZNI6.25.41.D08.1.454.CMB.1.raw
  modified_base (452)..(452): a, c, t, g, unknown or other
  misc_feature (452)..(452): n is a, c, g, or t
  modified_base (458)..(475): a, c, t, g, unknown or other
  misc_feature (458)..(475): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacgccaagaactccctgtatctgcaaatgaacagtctgagagctgaggacacggccttgtattactgtgcaaaaattaattacgttagcagcagctcggaaagggttccttactactactactactacatggacgtctggggcaaagggaccacggtcaccgtctcctcagcctccaccaagggcccagtccggtccttccccctggccacccctcctccaagacgccacctcgtgggggcacagcggcctgggctgcctggtcaaggtctacttccactgtacagtctgagcgggctggcaaggcncagtgnnnnnnnnnnnnnnnnnn

SEQ ID NO: 12135 - DNA, 543 bp, Homo sapiens
  misc_feature: GYAE6OF01CC5HV.25.41.D08.1.454.CMB.1.raw
  modified_base (353)..(353): a, c, t, g, unknown or other
  misc_feature (353)..(353): n is a, c, g, or t
  modified_base (510)..(510): a, c, t, g, unknown or other
  misc_feature (510)..(510): n is a, c, g, or t
  modified_base (512)..(522): a, c, t, g, unknown or other
  misc_feature (512)..(522): n is a, c, g, or t
  modified_base (524)..(543): a, c, t, g, unknown or other
  misc_feature (524)..(543): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaaggccgattcaccatctccagagacaacggcaagaacacggtggatctgcaaatgaacagtctgagagccgaggacacggcggtgtattatgtgtaagaggctgtgagtggggactgccacgggttgttgactacgtggggccaggggaaccctggtccaccgtctacctcacgccctccaaccgagggccccagtccggtccttcccccgtggccgccctcgcctccagggacnccaccctccggaagacgcaacgacgccggacccgttcgggcctcggcccgtcgggttacaacgggtaccttaaccctttcccgacgttacgtacctaggtccgttagggaccggtcggggacgttcgggacgaaacgggccgacgtagtaagtgacngnnnnnnnnnnncnnnnnnnnnnnnnnnnnnnn

SEQ ID NO: 12136 - DNA, 663 bp, Homo sapiens
  misc_feature: GYAE6OF01CMM4X.25.41.D08.1.454.CMB.1.raw
  modified_base (279)..(279): a, c, t, g, unknown or other
  misc_feature (279)..(279): n is a, c, g, or t
  modified_base (549)..(549): a, c, t, g, unknown or other
  misc_feature (549)..(549): n is a, c, g, or t
  modified_base (556)..(556): a, c, t, g, unknown or other
  misc_feature (556)..(556): n is a, c, g, or t
  modified_base (560)..(560): a, c, t, g, unknown or other
  misc_feature (560)..(560): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
tcagactgtacagtcacgaccggtgctcgatttagtcacgcgagaaagggaaagggggcctaacggtgtcgggtccttcgacgtatttcctaaagatggcaagtgcccagaactactacggcggacgtcccgtggaagggccgattctacctagtcgtccagagacaacggcaagaccacggtcggatctgcaaatgacagtctgagagccgaggacacggcggtgtagttacttgtagtaagaggtctcgtgactgggggacttgactacggtgtttnactatggggccagggaccctgggtcacccgtctccgtccaggcctaccgacctaggggccccagtccggtcgttccccctggtaccgccctggctacctagggaacgtccgaaccctccgaagtacggcaccgtacgaccgggaccctttggggacctggcccgttcgggtaccaaaggggtacctaccctttaccgacttacgtacctagtccgttacggacgccggggtacctcgggtacgaaacgggtccgacacgttacggagtcncgcacgngacncgacgctactacgtctgacgcacggngtaacncgtcgtcgtacggtagtacggaccgtggtccgtcgtagggacgtacgggacctagggtcccgtgtccgtcg

SEQ ID NO: 12137 - DNA, 696 bp, Homo sapiens
  misc_feature: GYAE6OF01CFVJ3.25.41.D08.1.454.CMB.1.raw
  modified_base (657)..(657): a, c, t, g, unknown or other
  misc_feature (657)..(657): n is a, c, g, or t
  modified_base (662)..(696): a, c, t, g, unknown or other
  misc_feature (662)..(696): n is a, c, g, or t
tcagactgtacagtcacgaccggtgctcgatttagtcacgcgagaaagggaaagggctggtgtgggtctcacgtatttctaaagatggcaatgccagatactacgcggactccgtgaaggccgattcaccatctccagagaccaacggcaagaacacggtggatctgacaaaatgaactagtctagagacgccggaggacacgggtggtagtatttatggtagtaagaggtcgtgtgagtcggggactcgccgtacggttgttacgaacgtaccggtgggggacccgaacggggtaaccccgttggttacccgtacccggttccttacccgttaccaccggttaccccttacccccgaaacccggtaaaaccgggggtcccccaaggttttcccccggggtttccccgttttccccccccgttcggggccccgttcccccgtcggtaccccgttaccgaacggggttaaccgtaccccgttaccggaacggtcgaacccaggtaaccggcccgggtccccgtcggggtcctccggtacccgttcggtaccgtaaaaggttaccccttaccgttacccgtaacttcggttaaacctacggtttccgagggcgggttacccggggtcgtacgggacgtaacgggtcacgtaaagtcggntacgnnnnnnnnnnnnnnnnnnnnnnnnnnnnnnnnnnn

SEQ ID NO: 12138 - DNA, 661 bp, Homo sapiens
  misc_feature: GYAE6OF01AO9O6.25.41.D08.1.454.CMB.1.raw
  modified_base (213)..(213): a, c, t, g, unknown or other
  misc_feature (213)..(213): n is a, c, g, or t
  modified_base (223)..(223): a, c, t, g, unknown or other
  misc_feature (223)..(223): n is a, c, g, or t
  modified_base (349)..(349): a, c, t, g, unknown or other
  misc_feature (349)..(349): n is a, c, g, or t
  modified_base (614)..(614): a, c, t, g, unknown or other
  misc_feature (614)..(614): n is a, c, g, or t
  modified_base (619)..(620): a, c, t, g, unknown or other
  misc_feature (619)..(620): n is a, c, g, or t
  modified_base (622)..(622): a, c, t, g, unknown or other
  misc_feature (622)..(622): n is a, c, g, or t
  modified_base (625)..(625): a, c, t, g, unknown or other
  misc_feature (625)..(625): n is a, c, g, or t
  modified_base (627)..(628): a, c, t, g, unknown or other
  misc_feature (627)..(628): n is a, c, g, or t
  modified_base (630)..(630): a, c, t, g, unknown or other
  misc_feature (630)..(630): n is a, c, g, or t
  modified_base (638)..(638): a, c, t, g, unknown or other
  misc_feature (638)..(638): n is a, c, g, or t
  modified_base (641)..(642): a, c, t, g, unknown or other
  misc_feature (641)..(642): n is a, c, g, or t
  modified_base (644)..(651): a, c, t, g, unknown or other
  misc_feature (644)..(651): n is a, c, g, or t
  modified_base (653)..(661): a, c, t, g, unknown or other
  misc_feature (653)..(661): n is a, c, g, or t
tcagactgtacagtcacgaccggtgctcgatttagtcacgcgagaaagggaaaggggcgtggtggtgggtctcacgtatttctaaagatggcaatgccagatacctacgccggactccgtgaacgggccgattcaccatctccagagacaacggcaagaacacggtggatctgcaaatgaactagtctgagagccgagacacggcgtgtattntgtagtaagnggctgtgagtgggactggccgtaggtgttcgactacgtcggggaccaacgggaacccgtggtacacccgtctcctacaccgtccctaccaaccgacggcccctagtcccggtttcccttcccccgnggcccgtcccgtcgtcccgtaccgacgtaccgtaccctacccgtaccggacgcggaccacccggtacggccccgggttccccgtgggggtacccttaccgggtacccggttacgggtaaacccgtaaacgggtttaccccgtttacccgttaaacccggttaccgttaacggttaaaccctcgggttcccggttacgggaacccggggtcggggttaccggtacgggaccggtaaacggggtcctaaccgtagttaccgactcgncgacnncngcncnngngcgcgcgngcnngnnnnnnnncnnnnnnnnn

SEQ ID NO: 12139 - DNA, 590 bp, Homo sapiens
  misc_feature: GYAE6OF01EKTUQ.25.41.D08.1.454.CMB.1.raw
  modified_base (190)..(190): a, c, t, g, unknown or other
  misc_feature (190)..(190): n is a, c, g, or t
  modified_base (230)..(230): a, c, t, g, unknown or other
  misc_feature (230)..(230): n is a, c, g, or t
  modified_base (398)..(398): a, c, t, g, unknown or other
  misc_feature (398)..(398): n is a, c, g, or t
  modified_base (448)..(448): a, c, t, g, unknown or other
  misc_feature (448)..(448): n is a, c, g, or t
  modified_base (555)..(555): a, c, t, g, unknown or other
  misc_feature (555)..(555): n is a, c, g, or t
  modified_base (557)..(557): a, c, t, g, unknown or other
  misc_feature (557)..(557): n is a, c, g, or t
  modified_base (561)..(590): a, c, t, g, unknown or other
  misc_feature (561)..(590): n is a, c, g, or t
tcagactgtacagtcacgaccggtgctcgatttagtcacgcgagaaagggaaaggggctggtgtgggtctctacgtatttctaaagatggcaatgccagatactacgcggactccgtgaagggccgattcaccatctccagagacaacggcaagaacacggtggatcctgacaaatgaacagtctgaagngcccgaggaccacgggtcgttgtattagttgtaggtaagngctggtgagtggggactcgaccgtcggtgttcgacgtacggtcgggggaccgacgggtaaccctggtacccgacccgtccttcccgtccacgtcccctacccgacccggaacgggtcccccacggttcccggtcccttacccccgtgggcccctccctcgcctaccgngaccgcctacccgtccgagacgcctacggacggtccccgcgtacgggtcnccggtccggtagtacgaacgtaccttaccttcccgaagttcgaacgtcgtcgtacgggaccggtcgggtcacggggtacgaaaccggtgtaacctaggtcgactggntnacgnnnnnnnnnnnnnnnnnnnnnnnnnnnnnn

SEQ ID NO: 12140 - DNA, 426 bp, Homo sapiens
  misc_feature: GYAE6OF02G4BDF.25.41.D08.1.454.CMB.1.raw
  modified_base (419)..(426): a, c, t, g, unknown or other
  misc_feature (419)..(426): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaaccctggtcaccgtctcctcagcctccaccaagggcccatcggtcttcccctggcgccctgctccaggagcacctccgagagcacagcggccctgggctgcctggtcaaggctacttccactgtacagtctgagcgggctggcaaggcgcatagnnnnnnnn

SEQ ID NO: 12141 - DNA, 435 bp, Homo sapiens
  misc_feature: GYAE6OF02JAKFK.25.41.D08.1.454.CMB.1.raw
  modified_base (336)..(336): a, c, t, g, unknown or other
  misc_feature (336)..(336): n is a, c, g, or t
  modified_base (423)..(435): a, c, t, g, unknown or other
  misc_feature (423)..(435): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactggggccagggaaccctggtcaccgtctcctcagcctccaccaagggccccatcggtcttccccctggccgccctgctccaggngccacctccgagagcacagcggccctgggctgcctggtcaaggctactccactgtacagtctgagcgggctggcaaggcgcagtagnnnnnnnnnnnnn

SEQ ID NO: 12142 - DNA, 450 bp, Homo sapiens
  misc_feature: GYAE6OF02I1M0I.25.41.D08.1.454.CMB.1.raw
  modified_base (422)..(422): a, c, t, g, unknown or other
  misc_feature (422)..(422): n is a, c, g, or t
  modified_base (444)..(450): a, c, t, g, unknown or other
  misc_feature (444)..(450): n is a, c, g, or t
tcagactgtacagtcacgaccggtgctcgatttagtcacgcgagaaagggaaaggggcgtggtgtgggtcgtcacgtatttctaaagatggcaatgccagatactacgcggactccgtgaaggccgattcaccatctccagagacaacggcaagaacacggtggatctgcaaatgaacagtctgagagccgaggacacggcggtgtatattgtgtaagaggctgtgatgggactgccaggtgttgactactggggccagggaaccctggtcaccgtctcctcagcctccaccaagggcccatccggtcttcccccctggccgcccctggctacccagggacgccaccgtccgagacgcaccagccggtccctgggcctcggccctaggtcaagggacctacgttccaccttgtacagtcctnaggcggctggcagcgcatagcnnnnnnn

SEQ ID NO: 12143 - DNA, 433 bp, Homo sapiens
  misc_feature: GYAE6OF02FYK6T.25.41.D08.1.454.CMB.1.raw
  modified_base (422)..(433): a, c, t, g, unknown or other
  misc_feature (422)..(433): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactgggggccaggggaaccctggtcaccgtctcctcagcctccaccaagggcccatcggtcttccccctggcgccctgctccaggagcacctccgagagcacagcggccctgggctgcctggtcaaggctacttccactgtacagtctgagcgggctggcaaggcgcatagnnnnnnnnnnnn

SEQ ID NO: 12144 - DNA, 425 bp, Homo sapiens
  misc_feature: GYAE6OF02ISY5W.25.41.D08.1.454.CMB.1.raw
  modified_base (347)..(347): a, c, t, g, unknown or other
  misc_feature (347)..(347): n is a, c, g, or t
  modified_base (399)..(399): a, c, t, g, unknown or other
  misc_feature (399)..(399): n is a, c, g, or t
  modified_base (410)..(410): a, c, t, g, unknown or other
  misc_feature (410)..(410): n is a, c, g, or t
  modified_base (416)..(425): a, c, t, g, unknown or other
  misc_feature (416)..(425): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaaatgaacagtctgagagccgaggacacggcggtgtattattgtgtaagaggctgtgatggggactgccacggtgttgactactggggccagggaaccctggtcaccgtctcctcagcctccacaggccatcggtcttcccctgcgccctgctccaggacgcacctccgagagcacngccgcctgggctgctggtcaaggactacttccactgtacagtctgagcgggntgggcaaggcncatagnnnnnnnnnn

SEQ ID NO: 12145 - DNA, 440 bp, Homo sapiens
  misc_feature: GYAE6OF02FS2P5.25.41.D08.1.454.CMB.1.raw
  modified_base (430)..(440): a, c, t, g, unknown or other
  misc_feature (430)..(440): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactactgggggccaggggaaccctggtcaccgtctcctcagcctccaccaagggccccatcggtcttccccctggccgccctgcctccaggagcacctccgagagcacagcggccctgggcctggcctggtcaaggactacttccactcgtacagtctgagcgggctgggcagggcgcatagnnnnnnnnnnn

SEQ ID NO: 12146 - DNA, 526 bp, Homo sapiens
  misc_feature: GYAE6OF02GGROO.25.41.D08.1.454.CMB.1.raw
  modified_base (336)..(336): a, c, t, g, unknown or other
  misc_feature (336)..(336): n is a, c, g, or t
  modified_base (344)..(344): a, c, t, g, unknown or other
  misc_feature (344)..(344): n is a, c, g, or t
  modified_base (364)..(364): a, c, t, g, unknown or other
  misc_feature (364)..(364): n is a, c, g, or t
  modified_base (437)..(437): a, c, t, g, unknown or other
  misc_feature (437)..(437): n is a, c, g, or t
  modified_base (486)..(487): a, c, t, g, unknown or other
  misc_feature (486)..(487): n is a, c, g, or t
  modified_base (489)..(489): a, c, t, g, unknown or other
  misc_feature (489)..(489): n is a, c, g, or t
  modified_base (492)..(493): a, c, t, g, unknown or other
  misc_feature (492)..(493): n is a, c, g, or t
  modified_base (495)..(526): a, c, t, g, unknown or other
  misc_feature (495)..(526): n is a, c, g, or t
tcagactgtacagtcacgaccggtgctcgatttagtcacgcgagaaaggggaaaggggctggtgtgggtctcacgtagtttctaaagatggcaatgccagatactacgcggactccgtgaaggccgattcaccatcctccagagacaacggcaagaacacggtggatctgccaaatcgaacagtctgagagccgaggacacggcgtgtattattgtgtaagagctgtgagtggggactgaccgacggtgttagacttacgtggggaccacggggtaaccctggtcaccgtctcctcacgcctccaccgacgggtcccagtccggtccttcccccgngggtcccncccgtgcctaccgagggacncaccgtcgagacgcacgacggccgccgtggcctcgtcctcggtacaaaggccttacctccgacgttcgtaacncgttctaggacggtcggggctaggggacgtaagggcctagaagttcggnngnagnngnnnnnnnnnnnnnnnnnnnnnnnnnnnnnnnn

SEQ ID NO: 12147 - DNA, 499 bp, Homo sapiens
  misc_feature: GYAE6OF02GVGSF.25.41.D08.1.454.CMB.1.raw
  modified_base (371)..(371): a, c, t, g, unknown or other
  misc_feature (371)..(371): n is a, c, g, or t
  modified_base (474)..(499): a, c, t, g, unknown or other
  misc_feature (474)..(499): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactacgtggggccagggaaccctggtcacccgtctccctcagcccctccaccaacgggccccagtccggtccttcccccgtggccgcccctcgcctcccgaggacgccacctccgagacgcacncgccggccctgggctcgccgtggtacgaaaggtaccttaccttcccagtcgtaacacggtctaggacgggcgggtcgtcgggacgaacgggcgacaagtacgnnnnnnnnnnnnnnnnnnnnnnnnnn

SEQ ID NO: 12148 - DNA, 508 bp, Homo sapiens
  misc_feature: GYAE6OF02I4UAS.25.41.D08.1.454.CMB.1.raw
  modified_base (326)..(326): a, c, t, g, unknown or other
  misc_feature (326)..(326): n is a, c, g, or t
  modified_base (410)..(410): a, c, t, g, unknown or other
  misc_feature (410)..(410): n is a, c, g, or t
  modified_base (450)..(450): a, c, t, g, unknown or other
  misc_feature (450)..(450): n is a, c, g, or t
  modified_base (457)..(458): a, c, t, g, unknown or other
  misc_feature (457)..(458): n is a, c, g, or t
  modified_base (464)..(464): a, c, t, g, unknown or other
  misc_feature (464)..(464): n is a, c, g, or t
  modified_base (472)..(476): a, c, t, g, unknown or other
  misc_feature (472)..(476): n is a, c, g, or t
  modified_base (478)..(478): a, c, t, g, unknown or other
  misc_feature (478)..(478): n is a, c, g, or t
  modified_base (480)..(482): a, c, t, g, unknown or other
  misc_feature (480)..(482): n is a, c, g, or t
  modified_base (484)..(484): a, c, t, g, unknown or other
  misc_feature (484)..(484): n is a, c, g, or t
  modified_base (486)..(488): a, c, t, g, unknown or other
  misc_feature (486)..(488): n is a, c, g, or t
  modified_base (490)..(490): a, c, t, g, unknown or other
  misc_feature (490)..(490): n is a, c, g, or t
  modified_base (492)..(492): a, c, t, g, unknown or other
  misc_feature (492)..(492): n is a, c, g, or t
  modified_base (495)..(495): a, c, t, g, unknown or other
  misc_feature (495)..(495): n is a, c, g, or t
  modified_base (498)..(498): a, c, t, g, unknown or other
  misc_feature (498)..(498): n is a, c, g, or t
  modified_base (503)..(504): a, c, t, g, unknown or other
  misc_feature (503)..(504): n is a, c, g, or t
  modified_base (507)..(508): a, c, t, g, unknown or other
  misc_feature (507)..(508): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatgaacagtctgagagccgaggacacggcggtgtattattgtgtaagaggctgtgatggggactgccacggtgttgactacgtgggccagggaaccctggtacaccgtctcctcagccctccaacgaagggcccatccggtacttcccctggccnccctgctccgtaggacgcaccgtccgagacgcacgacgccggcctgggcttgcctggtacaaggctacttaccagttcgtaacngtactggacgcgggactgggacaaggcgacaagtagactnagctagnntcagtnacagtgannnnnanannnanannnanancanacncacanncgnn

SEQ ID NO: 12149 - DNA, 531 bp, Homo sapiens
  misc_feature: GYAE6OF02F8I8Q.25.41.D08.1.454.CMB.1.raw
  modified_base (220)..(220): a, c, t, g, unknown or other
  misc_feature (220)..(220): n is a, c, g, or t
  modified_base (226)..(226): a, c, t, g, unknown or other
  misc_feature (226)..(226): n is a, c, g, or t
  modified_base (254)..(254): a, c, t, g, unknown or other
  misc_feature (254)..(254): n is a, c, g, or t
  modified_base (328)..(328): a, c, t, g, unknown or other
  misc_feature (328)..(328): n is a, c, g, or t
  modified_base (482)..(482): a, c, t, g, unknown or other
  misc_feature (482)..(482): n is a, c, g, or t
  modified_base (485)..(485): a, c, t, g, unknown or other
  misc_feature (485)..(485): n is a, c, g, or t
  modified_base (487)..(487): a, c, t, g, unknown or other
  misc_feature (487)..(487): n is a, c, g, or t
  modified_base (489)..(490): a, c, t, g, unknown or other
  misc_feature (489)..(490): n is a, c, g, or t
  modified_base (492)..(492): a, c, t, g, unknown or other
  misc_feature (492)..(492): n is a, c, g, or t
  modified_base (494)..(494): a, c, t, g, unknown or other
  misc_feature (494)..(494): n is a, c, g, or t
  modified_base (496)..(497): a, c, t, g, unknown or other
  misc_feature (496)..(497): n is a, c, g, or t
  modified_base (499)..(501): a, c, t, g, unknown or other
  misc_feature (499)..(501): n is a, c, g, or t
  modified_base (503)..(504): a, c, t, g, unknown or other
  misc_feature (503)..(504): n is a, c, g, or t
  modified_base (506)..(512): a, c, t, g, unknown or other
  misc_feature (506)..(512): n is a, c, g, or t
  modified_base (514)..(516): a, c, t, g, unknown or other
  misc_feature (514)..(516): n is a, c, g, or t
  modified_base (520)..(521): a, c, t, g, unknown or other
  misc_feature (520)..(521): n is a, c, g, or t
  modified_base (523)..(523): a, c, t, g, unknown or other
  misc_feature (523)..(523): n is a, c, g, or t
  modified_base (525)..(527): a, c, t, g, unknown or other
  misc_feature (525)..(527): n is a, c, g, or t
  modified_base (529)..(531): a, c, t, g, unknown or other
  misc_feature (529)..(531): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaaatgaacagtctagagagccgaggacacggcgtgtattattgtgtaagnggctgngagtggggactgccaggtgttgactacnggggccagggaaccctggtcaccgtctcctcagccctccaccaagggcccagtccggtccttcccccgtggccncccgtgcctccgaggcgccacccgtcgagagccacgacgcggccctgggcctgccgtggtacgaaaggtaccctttaccttcccgacgttcgtaacgacgttccgtaggacggtccgggcgtcgggacgtaaacgggccgtacgtaagtcggcngcngngnngncngnngnnngnngnnnnnnngnnngcgnncncnnncnnn

SEQ ID NO: 12150 - DNA, 757 bp, Homo sapiens
  misc_feature: GYAE6OF02IZUNH.25.41.D08.1.454.CMB.1.raw
  modified_base (684)..(684): a, c, t, g, unknown or other
  misc_feature (684)..(684): n is a, c, g, or t
  modified_base (686)..(686): a, c, t, g, unknown or other
  misc_feature (686)..(686): n is a, c, g, or t
  modified_base (693)..(693): a, c, t, g, unknown or other
  misc_feature (693)..(693): n is a, c, g, or t
  modified_base (707)..(707): a, c, t, g, unknown or other
  misc_feature (707)..(707): n is a, c, g, or t
  modified_base (710)..(710): a, c, t, g, unknown or other
  misc_feature (710)..(710): n is a, c, g, or t
  modified_base (730)..(730): a, c, t, g, unknown or other
  misc_feature (730)..(730): n is a, c, g, or t
  modified_base (734)..(734): a, c, t, g, unknown or other
  misc_feature (734)..(734): n is a, c, g, or t
  modified_base (746)..(746): a, c, t, g, unknown or other
  misc_feature (746)..(746): n is a, c, g, or t
  modified_base (751)..(751): a, c, t, g, unknown or other
  misc_feature (751)..(751): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgattcaccatctccagagacaacggcaagaacacggtggatctgcaaatagaacagtctagagagccgaggaacacgggcggtacgtatttagtttggtagtaaaggacggctaggtaggaagtgggggtacctcgacccgtaacgggttcggtttagaaccgttaccggtcggggacccgaaccggggtaaccccgttagggtaccccgaaccccgttccgttaccccgtaaccgtaccgtacccccgttaccccgaaaacccggaaccggggtaccccctaaccggtttaccccgggtttaccccgttttaccccccccggttcgggggacccccggtccccttacgggtaccccgttacgggaccgggttacaccccgtacccggttaccggacgaccgacctaccggacggtcccgtccggttccgggacttcggtcctacgggttagaaaccggtacctttacctacccgtaaacggttcgttaaacgtcgttccgtacggacggtaccgggacgttacggggaccgttaacgggaccgactaaccggtagacgnangatgcanagtctcgagtaganacncagtgactagcagacacgtncgtngtatagagacanagtancgagtc

SEQ ID NO: 12151 - DNA, 471 bp, Homo sapiens
  misc_feature: GYAE6OF02G8KTH.25.41.D08.1.454.CMB.1.raw
  modified_base (218)..(218): a, c, t, g, unknown or other
  misc_feature (218)..(218): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (431)..(432): a, c, t, g, unknown or other
  misc_feature (431)..(432): n is a, c, g, or t
  modified_base (436)..(437): a, c, t, g, unknown or other
  misc_feature (436)..(437): n is a, c, g, or t
  modified_base (440)..(440): a, c, t, g, unknown or other
  misc_feature (440)..(440): n is a, c, g, or t
  modified_base (442)..(442): a, c, t, g, unknown or other
  misc_feature (442)..(442): n is a, c, g, or t
  modified_base (444)..(446): a, c, t, g, unknown or other
  misc_feature (444)..(446): n is a, c, g, or t
  modified_base (448)..(448): a, c, t, g, unknown or other
  misc_feature (448)..(448): n is a, c, g, or t
  modified_base (450)..(450): a, c, t, g, unknown or other
  misc_feature (450)..(450): n is a, c, g, or t
  modified_base (452)..(452): a, c, t, g, unknown or other
  misc_feature (452)..(452): n is a, c, g, or t
  modified_base (454)..(456): a, c, t, g, unknown or other
  misc_feature (454)..(456): n is a, c, g, or t
  modified_base (458)..(471): a, c, t, g, unknown or other
  misc_feature (458)..(471): n is a, c, g, or t
tcagactgtacagtcacgaccggtgctcgatttagtcacgcgagaaagggaaaggggctggtgtgggtctcacgtatttctaaagatggcaatgccagatactacgcggactccgtgaagggccgatttcaccatctccagagacaacggcaagaacacggtgatctgcaaatgaacagtctgagagccgaggacaggcggtgtattattgtgtaagnggctgtgattgggactgccacggtgttgactactgggggccaggaccctggtcaccgtctcctcagcctccaccagggcccatcggtcttcccctgcgcctgctccacggagcacctccgacgacgcacacgcggccctggggcctaggccctggtcagggtacctacttcccactgtacagtctgagcgggctggcaaggcncataggntgnnctgnnacngntnnngnancnannncnnnnnnnnnnnnnn

SEQ ID NO: 12152 - DNA, 315 bp, Homo sapiens
  misc_feature: GYAE6OF01D70QW.10.71.G05.1.454.CMB.1.raw
  modified_base (311)..(315): a, c, t, g, unknown or other
  misc_feature (311)..(315): n is a, c, g, or t
tcagcatagtagtgcacgaccggtgctcgatttagtgtcgtcgcaagagagagggagagtgttagaggggcacttctccctctaacactctccctgttgaagctctttgtgacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcatcttccgcatctgacactactatgctgagcgggctggcaaggcgcatagnnnnn

SEQ ID NO: 12153 - DNA, 550 bp, Homo sapiens
  misc_feature: GYAE6OF01C76V8.10.71.G05.1.454.CMB.1.raw
  modified_base (397)..(397): a, c, t, g, unknown or other
  misc_feature (397)..(397): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagataccactggagaagtagtgatgaggcagtctccagccaccctgtctgtgtctccaggggaaacaccacctctcctgcagggccagtcagagtgttggcagcaggttagcctggtaccagcagaaacgtggccaggctcccaggctcctcgtatatggtgcatccaccgagggccactggtatctcaggcaggttccgtggcaggtgggtctgggacagagttcactgtcacatcagcagcctgcagtctagaagtntttgctagtttattactgtcagctagtataatagctcggcccgaggtacgttcggccgtaaagggacccggtaagggtacggtaaacttacgaaaacggtacgttacgggtacggaccgttacggaccctaccgtaacttccgttggttaccc

SEQ ID NO: 12154 - DNA, 600 bp, Homo sapiens
  misc_feature: GYAE6OF01CYSH4.10.71.G05.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (309)..(309): a, c, t, g, unknown or other
  misc_feature (309)..(309): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccacctctccngcagggccagtcagagtgttcgctacttcggttagggtgtatcaacataaatccggcaggcctccaggctcctcattctttgatgctttcaacncgggccctggccgtcccaggcaggttcaggtggcaggtgggtctgggacagacttcactctcaccatcagcagcctagacgcctagaacgtattttgcttaagttttattacgtgtacagtacagtcgtagcctacgttttccgggacggtacggttcgtacccgtacgtttcgggaccgggtaacgggaaccgtaaaagttaacggaacgggtaacgaaaaccggaacgttaggtacgggcgttcggaccaacccgtagttaccgttaggttccttcgtacgtttacccg

SEQ ID NO: 12155 - DNA, 521 bp, Homo sapiens
  misc_feature: GYAE6OF01EV41U.10.71.G05.1.454.CMB.1.raw
  modified_base (202)..(202): a, c, t, g, unknown or other
  misc_feature (202)..(202): n is a, c, g, or t
  modified_base (517)..(518): a, c, t, g, unknown or other
  misc_feature (517)..(518): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttaggggtgtatcaacataaatccggccaggctccaggctcctcatctttgatgctttcaacagggcccctggcgtcccaggcaggttcagtggcagtgggtctggggacagacttcactctcaccatcagcagcctagagcctgaagtattttgctagtttattactgtcagcagcgtcgcctacgtttcggcggaggtcgccgtacgtttcggacggagggaaccaaagtagaggtacaaacgactagtggctgcacctatctagtcttnntcc

SEQ ID NO: 12156 - DNA, 521 bp, Homo sapiens
  misc_feature: GYAE6OF01A80MI.10.71.G05.1.454.CMB.1.raw
  modified_base (201)..(201): a, c, t, g, unknown or other
  misc_feature (201)..(201): n is a, c, g, or t
  modified_base (512)..(512): a, c, t, g, unknown or other
  misc_feature (512)..(512): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggctcccaggctcctcatctttgatgctttcaacagggcccctggcgtcccaggcaggttcagtggcagtggtctgggacagacttcactctcaccatcagcagcctagacgcctgaagtattttgctagtttattactgtcagcagcgtgcctacgtttcggcggtaggtcgccgtacgtttcgggcggagggaccaaagtgacgtacaaacgtactggtagctgcaccatctgtcttcntccgtcccg

SEQ ID NO: 12157 - DNA, 525 bp, Homo sapiens
  misc_feature: GYAE6OF01A3M9G.10.71.G05.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcgttagggtgtatcaacataaatccggccaggctcccaggctcctcatctttgatgctttcaacngggcccctggctccagcaggttcagtggcagtggtctgggacagacttcactctcaccatcagcagcctagagtcctgaagtattttgctagtttattactgtcagcagcgtagcctacgtttcggcgaggtcgccgtacgtttcgggcggagggaccaaagtgaacggtacgaaacgtacgtggtggctgaccaccattctgttacttctatccttcccg

SEQ ID NO: 12158 - DNA, 560 bp, Homo sapiens
  misc_feature: GYAE6OF01DD7I0.10.71.G05.1.454.CMB.1.raw
  modified_base (213)..(213): a, c, t, g, unknown or other
  misc_feature (213)..(213): n is a, c, g, or t
  modified_base (300)..(300): a, c, t, g, unknown or other
  misc_feature (300)..(300): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagagattgtgttgacacagtctccagccaccctgtctttgctccaggggaaangccaccctctcctgcagggccagtcagagtgttggcgcctacgtagcctggtaccaacagaaacctggccaggctcccaggcccctnatctatggtgcatccaacacgggccacgtggcatcccagccaggttcagtggcaggtggtctgggacagacttcactctcaccatcatcagcctggacgcctgaagattgttgcgtagttttattactgtacaactattacgtacgtagttcgggcccgttcccgggggccctacgtttccgggccccgtacggggtaacctaaaggtcggtaatacgtaccgaaaacgtaacgtaggtcggactagccaccgtagtccg

SEQ ID NO: 12159 - DNA, 527 bp, Homo sapiens
  misc_feature: GYAE6OF01DBFJG.10.71.G05.1.454.CMB.1.raw
  modified_base (203)..(203): a, c, t, g, unknown or other
  misc_feature (203)..(203): n is a, c, g, or t
  modified_base (303)..(303): a, c, t, g, unknown or other
  misc_feature (303)..(303): n is a, c, g, or t
  modified_base (519)..(519): a, c, t, g, unknown or other
  misc_feature (519)..(519): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgtcgcacttcgtagggtgtatcaacataatccggcaggctccaggctctcatctttgatgctttcaacngggccctggctcccaggcagtcagtgcagtggtctgggacagacttcgactctcacatcagcagcctagagcctgaagtatttgactagtttattactgtcagcagcgtgcctacgtttcggacggtaggtcgtaccgtacgtttcggacggacgggaacctaaagtagacggtaacaaacggacgtaggtacggcgtcgcactactctgttcttnacttcccg

SEQ ID NO: 12160 - DNA, 519 bp, Homo sapiens
  misc_feature: GYAE6OF01CPIHJ.10.71.G05.1.454.CMB.1.raw
  modified_base (214)..(214): a, c, t, g, unknown or other
  misc_feature (214)..(214): n is a, c, g, or t
  modified_base (378)..(378): a, c, t, g, unknown or other
  misc_feature (378)..(378): n is a, c, g, or t
  modified_base (513)..(513): a, c, t, g, unknown or other
  misc_feature (513)..(513): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtggtatcaacataaatccggccaggctccaggctcctcatctttgatgctttcacagggcccctggctccaggcaggttcagtgcagtgggtctgggacagacttcactctcacntcagcagcctagagcctagaagtattttgctagtttattactgtcagcagcgtgcctacgtttcggcggtaggtcgcctacgtttcgggcggaagggaccaaaagtgaaggtacaaacgactgtacgctgacacngtctcg

SEQ ID NO: 12161 - DNA, 531 bp, Homo sapiens
  misc_feature: GYAE6OF01D40TU.10.71.G05.1.454.CMB.1.raw
  modified_base (198)..(198): a, c, t, g, unknown or other
  misc_feature (198)..(198): n is a, c, g, or t
  modified_base (281)..(281): a, c, t, g, unknown or other
  misc_feature (281)..(281): n is a, c, g, or t
  modified_base (299)..(299): a, c, t, g, unknown or other
  misc_feature (299)..(299): n is a, c, g, or t
  modified_base (342)..(342): a, c, t, g, unknown or other
  misc_feature (342)..(342): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccagctgtctttgctccaggggaaangccaccctctcctgcagggccagtcagagtgttcgcacttcgttagggtgtatcaacataatccggcaggctccaggctcctnatcttgatgctttcaacncggccctggcgtccaggcaggttcagtgcagtggtctgggacngtctcgactctcaccatcagcacgtcctagacgcctgagtattttgctagtttatactgtcagtcagtcgtgcctacgtttcggcggtagtcgccgtacgtttcggacgtaggacctaaagtcgacggttacgaaacgtacgtcgtacggtctgaccacgtacgtctcgtacttcacgttccgtacccg

SEQ ID NO: 12162 - DNA, 517 bp, Homo sapiens
  misc_feature: GYAE6OF01ECFMG.10.71.G05.1.454.CMB.1.raw
  modified_base (200)..(200): a, c, t, g, unknown or other
  misc_feature (200)..(200): n is a, c, g, or t
  modified_base (506)..(506): a, c, t, g, unknown or other
  misc_feature (506)..(506): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgctttcaacagggcccctggcgtcccaggcaggttcagtggcagtggtctgggacagacttcactctcaccatcagcagcctagagcctgaagtattttgctagtttattactgtcagcagcgtgccacttttcgggcggaggtcgcctacgtttcggcggagggaccaaaagtaggaggtcaaacggacgtgtggctgcaccatctgtnttcntctcccg

SEQ ID NO: 12163 - DNA, 506 bp, Homo sapiens
  misc_feature: GYAE6OF01BSIN6.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgcatccaacagggccactggcatcccagccaggttcagtggcagtgggtctgggacagacttcactctcaccatcagcagactagagcctagaagtattttgactagtttattactgtcagcagcgtagcaacgtggcctcgggacgttccggccgagggaacccaaggtcggacatcgaagcgaactgtcggctgcacatctgtctcc

SEQ ID NO: 12164 - DNA, 556 bp, Homo sapiens
  misc_feature: GYAE6OF01AB6ZH.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccacctctcctgcagggccagtcagagtgttcgcacttcggttagggtgtatcaacataaatccggcaggctccaggctcctcatctttgatgctttcaacgcgggcccctggccgtcccaggctaggttcagtggcaggtgggtctgggacagacttcactctcacatcagcagcctagagcctgaactattttgctagtttatactgtcagcagcgtgcctacgtttcggacggtaggtcgaccgtacgtttcgggacggaagggtaaccaaaagtcggaacggtaccgaaaacggtacgtggttacgggccttcggacaacccgtatcgtcgttccttcgactttcccg

SEQ ID NO: 12165 - DNA, 529 bp, Homo sapiens
  misc_feature: GYAE6OF01AF7U3.10.71.G05.1.454.CMB.1.raw
  modified_base (201)..(201): a, c, t, g, unknown or other
  misc_feature (201)..(201): n is a, c, g, or t
  modified_base (352)..(352): a, c, t, g, unknown or other
  misc_feature (352)..(352): n is a, c, g, or t
  modified_base (519)..(519): a, c, t, g, unknown or other
  misc_feature (519)..(519): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgctttcacaggcccctggcgtcccaggcaggttcagtggcagtggtctggggacngacttcactctcaccatcagcagcctagagcctgaagtattttgctagtttattactgtacagcagcgtgcctacgtttcgggcggtaggtcgccgtacgtttcgggcggtacgggaccaaagtgaggtacaaacggtaacgtggtgctgacaccatctgttcttcngtccttcccg

SEQ ID NO: 12166 - DNA, 520 bp, Homo sapiens
  misc_feature: GYAE6OF01D9OBY.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgctttcaacagggcccctggcgtcccaggcaggttcagtgcagtggtctgggacagacttcactctcaccatcagcagcctagagcctagaagtatttgctagttttatactgtcagcagcgtcgcctacgtttcggcggtaggtcgaccgtacgtttcgggcggaagggaccaaaagtagaggtacaaacgtacgtggtgctgcacatcagtctcatctcccg

SEQ ID NO: 12167 - DNA, 519 bp, Homo sapiens
  misc_feature: GYAE6OF01AEDG4.10.71.G05.1.454.CMB.1.raw
  modified_base (201)..(201): a, c, t, g, unknown or other
  misc_feature (201)..(201): n is a, c, g, or t
  modified_base (500)..(500): a, c, t, g, unknown or other
  misc_feature (500)..(500): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgctttcaacagggcccctggccgtcccaggcaggttcagtggcaggtggtctggggacagacttcactctcaccatcagcagcctagagcctgaagtattttgctagtttattactgtcagcagcgtgcctacgtttcggcggtaggtcgcctacgtttcggcggacggacaaagtgaggtacaaacgacgtgtggctgcacntctgtcttcntccgtcccg

SEQ ID NO: 12168 - DNA, 563 bp, Homo sapiens
  misc_feature: GYAE6OF01AJNO5.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaanagccaccctctcctgcagggccagtcagagtgttcgcacttcgttagggtgtatcaacataaatccggccaggctcccaggctcctcatctttgatgctttcaacagggcccctggcgtcccaggcaggttcagtggcaggtgggtctggggacagacttcactctcaccatcagcagcctagagcctgaagtattttgctagttttattactgtcagcagcgtgccctacgtttcgggcggtaggtcgtcccgtacgtttcgggccgggtagggaaccctaaaagtacggaacgggttaccgaaaaccggtacgtaggtcggcttacggccacctacttcgttgttccttcgcgttcccg

SEQ ID NO: 12169 - DNA, 538 bp, Homo sapiens
  misc_feature: GYAE6OF01DRRUA.10.71.G05.1.454.CMB.1.raw
  modified_base (213)..(213): a, c, t, g, unknown or other
  misc_feature (213)..(213): n is a, c, g, or t
  modified_base (246)..(246): a, c, t, g, unknown or other
  misc_feature (246)..(246): n is a, c, g, or t
  modified_base (322)..(322): a, c, t, g, unknown or other
  misc_feature (322)..(322): n is a, c, g, or t
  modified_base (433)..(433): a, c, t, g, unknown or other
  misc_feature (433)..(433): n is a, c, g, or t
  modified_base (519)..(519): a, c, t, g, unknown or other
  misc_feature (519)..(519): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaacactgcagaaatagttatgacgcagtctccagccaccctgtctgtgtctccgagggganagacgcccacccctctcctgccgagggccggtnagaatattgctaaccaacttagcctggtaatcaaacaaaagcctggccaggctcccagacctcctcatctctggtnctatcttcggaggccagtggtctcccagcccaggttcaggtggctagggtgggtactaggaacaggtacgttccacttctacaccagtcagcgtctgctagtctagaagtnttttcgcttagtttatacgtgtacagtctagtaattagtgtacgttggtttatctaccgttcgcccgtggaactaaagtgtattanacgtacgtactgtgctgac

SEQ ID NO: 12170 - DNA, 581 bp, Homo sapiens
  misc_feature: GYAE6OF01BWMA7.10.71.G05.1.454.CMB.1.raw
  modified_base (214)..(214): a, c, t, g, unknown or other
  misc_feature (214)..(214): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctagaagtattttgctagtttattactgtcagcagcgtgcctacgtttcgggcggtacggtgtcccgtacgtttccgggacgggtacggggaacccgtaaaaggtacggtaagggttaccgtaaaaccggtaaccgttaggttacgggtaccttaggaccctaacccgtaagttccgttacgg

SEQ ID NO: 12171 - DNA, 539 bp, Homo sapiens
  misc_feature: GYAE6OF01A07ET.10.71.G05.1.454.CMB.1.raw
  modified_base (203)..(203): a, c, t, g, unknown or other
  misc_feature (203)..(203): n is a, c, g, or t
  modified_base (309)..(309): a, c, t, g, unknown or other
  misc_feature (309)..(309): n is a, c, g, or t
  modified_base (532)..(532): a, c, t, g, unknown or other
  misc_feature (532)..(532): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcggttagggtggtatcaacataaatccggcaggctccaggctcctcatctttgatgctttcaacngggcccctggccgtcccaggcaggttcaggtggcaggtgggtctgggacagacttcactctcaccatcagcagcctagacgcctagaagtatttgactagtttattactgtcagcagcgtgcctacgtttcggacggtaggtcgtcctacgtttcgggacggacgggaaccaaagtacgaggtacaaacggacgtggtacggctgaccacctatctgtcttcncgttccc

SEQ ID NO: 12172 - DNA, 520 bp, Homo sapiens
  misc_feature: GYAE6OF01AYD08.10.71.G05.1.454.CMB.1.raw
  modified_base (204)..(204): a, c, t, g, unknown or other
  misc_feature (204)..(204): n is a, c, g, or t
  modified_base (514)..(514): a, c, t, g, unknown or other
  misc_feature (514)..(514): n is a, c, g, or t
  modified_base (517)..(517): a, c, t, g, unknown or other
  misc_feature (517)..(517): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccaggcaccctgtctttgtctccgaggggaaanagccaccctctcctgcagggccagtcagagtgttaacaacaactacttagcctggtaccagcagaaacctggccaggcctccaggcctcctcatctatgatgcatccagcagggccacgtggcatcccagactaggttcagtggcaggtgggtctgggacagacttcactctcacatcagcagacgtggacgcgtagaagtatttgctagtgtattacgtgtcagcgtagtagtcggtcgcccggcggtcgtcgtaggttcgggcggacgggacgtaaggtcgagagtacgaaacgacgtggtcgctgcncgntcg

SEQ ID NO: 12173 - DNA, 588 bp, Homo sapiens
  misc_feature: GYAE6OF01E1N5G.10.71.G05.1.454.CMB.1.raw
  modified_base (213)..(213): a, c, t, g, unknown or other
  misc_feature (213)..(213): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccacctctcctgcagggccagtcagagtgttcgcacttcgttaggtggtatcaacataaatccggcaggctccaggctcctcatctttgatgctttcaacagggcccctggccgtccaggcaggttcaggtggcaggtgggtctgggacagtacttcactctcaccatcagcacgcctagacgtccgtagaagttatttgacttaagtttattacttgtctagcgacgtcgtgcccttacgtttcgggacggtacggtcgtacccgttacgttcggggaccggtaacgggaaacctaaaaggtacggaacggttaaccgaaaacggtaacgttacgggtacggtcgtacgaccctaccgttacgtcgttacgg

SEQ ID NO: 12174 - DNA, 577 bp, Homo sapiens
  misc_feature: GYAE6OF01ESRBL.10.71.G05.1.454.CMB.1.raw
  modified_base (295)..(295): a, c, t, g, unknown or other
  misc_feature (295)..(295): n is a, c, g, or t
  modified_base (416)..(416): a, c, t, g, unknown or other
  misc_feature (416)..(416): n is a, c, g, or t
  modified_base (443)..(443): a, c, t, g, unknown or other
  misc_feature (443)..(443): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagcggtggtttcgcgtaggctcttaagtagatgtcagtgtcagatgcagatggtggagtgtgggggagcgtggtccggccgtggggggtccctgagctctcctgttctgcgtctggattcattctttagaatctggcatgtcctgggtccnccgtaggttccaggccacgggctaggaagtgggtggcagatataacaatatgatgacaagtaaatataatataggactactccttacgaagggccctaattcaccctatcctaccgaaganactaattacccaaagtaacagtaggtntatctagactaaagtcgaccaagtccgtagaacgacgcccggaagggacctaccggggttattttaacgtacgttgggtaggtaacgtaaattcccgaaggttaccggactaacgttctaaccgttggttaagg

SEQ ID NO: 12175 - DNA, 500 bp, Homo sapiens
  misc_feature: GYAE6OF01D4RHA.10.71.G05.1.454.CMB.1.raw
  modified_base (495)..(495): a, c, t, g, unknown or other
  misc_feature (495)..(495): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctggggacagacttcactctcaccatcagcagcctgcagtctgaggaccttggatttattactgtcagcagtatcataactggcctcgtgacgttcgccgagggccaggtggacctcgaaacgactgtggctgcnctacg

SEQ ID NO: 12176 - DNA, 320 bp, Homo sapiens
  misc_feature: GYAE6OF01EJ2B8.10.71.G05.1.454.CMB.1.raw
  modified_base (314)..(320): a, c, t, g, unknown or other
  misc_feature (314)..(320): n is a, c, g, or t
tcagcatagtagtgcacgaccggtgctcgatttagtgtcgtcgcaagagagaggggagagtgttagaggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttccgcatctgacactactatgctgagcgggctggcaaggcgcatagnnnnnnn

SEQ ID NO: 12177 - DNA, 567 bp, Homo sapiens
  misc_feature: GYAE6OF01EHM3Z.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcggttagggtgtatcaacataaatccggcaggctccaggctctcatcttgatgctttcaacacggcccctggccgtcccaggcaggttcagtggcaggtggtctgggacagacttcactctcacatcagcacgcctagacgtcctagtaagtatttgactagtttattacgtgtacagctagccgtgaccctacgtttcgggacggtaggtcgtacccgtacgtttcgggacggaaggaaccgaaagtacggaggtaccaaaacggtacgtggtggactgacccaacgtacttaccgtgttaccttcgtaactcccgttaccccg

SEQ ID NO: 12178 - DNA, 512 bp, Homo sapiens
  misc_feature: GYAE6OF01AZGKB.10.71.G05.1.454.CMB.1.raw
  modified_base (487)..(487): a, c, t, g, unknown or other
  misc_feature (487)..(487): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggcaggctcccaggctcctcatctttgatgctttcaacagggcccctggccgtcccaggcaggttcagtggcagtgggtctgggacagacttcactctcaccatcagcagcctagagcctgaagatttgcagtttatactgtcagcagcgtgcctactttcggcggagtgtccaactttcggcggtagggaccaaaatacgaggtacaaaagactggnggctgcaccatctagtcttcagtcc

SEQ ID NO: 12179 - DNA, 595 bp, Homo sapiens
  misc_feature: GYAE6OF01DU932.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggcaggctccaggctcctcatctttgatgctttcaacagggcccctggcgtcccaggcaggttcagtggcaggtggtctgggacagacttcactctcaccatcagcagcctagacgctgaagtattttgctagtttattactgtcagcagcgtgtcctacgtttcgggcggtaaggtcgcccgtacgtttccgggacgggtaacgggaaccgtaaaagtacggaacgggtaaccgtaaaacggtaaccgttcgggtaggaccgttacggacccgtaaccacgtttccgttacggtttacctttaccgtaactttccccgttacccccgg

SEQ ID NO: 12180 - DNA, 647 bp, Homo sapiens
  misc_feature: GYAE6OF01DNJ4O.10.71.G05.1.454.CMB.1.raw
  modified_base (204)..(204): a, c, t, g, unknown or other
  misc_feature (204)..(204): n is a, c, g, or t
  modified_base (308)..(308): a, c, t, g, unknown or other
  misc_feature (308)..(308): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacttcggttagggtgtatcaacataaatccgcaggctccagctcctcatctttgatgctttcaacnggccctggctcccaggcaggtcagtggcagtggtcgaggacagtaccttcactctccacatcagcacgcctagacgcgtagaagttatttgacttagtttacttacgtgtacagtacctagtccgttacgtaccgtacggtttccgggaccggggtacggttccggtacccgttaccgggtttaccggggaacgggtaaccgggtaaaacccgtaaaaggttacggggaaaccgttaaacggtaaaacccggtaacggttgggttacgggtaccgttaccggaccctaaccgttacttacccgttacggtttacccttaccgtaccgtttaccccccgg

SEQ ID NO: 12181 - DNA, 321 bp, Homo sapiens
  misc_feature: GYAE6OF01BF381.10.71.G05.1.454.CMB.1.raw
  modified_base (316)..(321): a, c, t, g, unknown or other
  misc_feature (316)..(321): n is a, c, g, or t
tcagcatagtagtgcacgaccggtgctcgatttagtgtcgtcgcaagagagaggggagagtgttagaggggcacttctccctctaacactctcccctgtttaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttcccgccatctgacactactatgctgagcgggctggcaaggcgcatagnnnnnn

SEQ ID NO: 12182 - DNA, 544 bp, Homo sapiens
  misc_feature: GYAE6OF01B6R4L.10.71.G05.1.454.CMB.1.raw
  modified_base (203)..(203): a, c, t, g, unknown or other
  misc_feature (203)..(203): n is a, c, g, or t
  modified_base (538)..(538): a, c, t, g, unknown or other
  misc_feature (538)..(538): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacgttcggttagggtgtatcaacataaatccggcaggctccaggctctcatctttgatgtctttacaacgacgggcccctgggccgtcccaggcaggttcaggtggcaggtgggtctggggacagtacttcgactctcacatcagcagcctagagcctagaagtattttgactagttttattactgtcagtcagcgtgacctacgtttcggcggtggtcgtccgtacgtttcggacggacgggaaccaaagtaggacggtacgaaacggactgtaggctagcacgtctctgtctcgtnttcccg

SEQ ID NO: 12183 - DNA, 557 bp, Homo sapiens
  misc_feature: GYAE6OF01AS8LP.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaaaccccagcgcagcttctcttcctcctgctactctggctcccaggtaccaccggagaaattgtgttgacacagtctccaggcaccctgtctttgtctccaggggaaagngccaccctctcctgcagggccagtcagagtgttaacaacaactacttagcctggtaccagcagaaacctggccaggctcccaggctcctcatctatgatgcatccagcagggccactggcatcccagacaggttcagtgcaggtgggtctgggacagacttcactctcaccatcagcagactggagccctgaagtattttgctagtgtattactgtcagctagtagtggtcggccccggtcggtcctcgtacggtttccgggacgggtacgggtaccgtaagggttcgaggtacgtacgaaacggtaacgttggtggtaccgtcggaccaacccgtactccgttggttacccg

SEQ ID NO: 12184 - DNA, 518 bp, Homo sapiens
  misc_feature: GYAE6OF01ED3AJ.10.71.G05.1.454.CMB.1.raw
  modified_base (200)..(200): a, c, t, g, unknown or other
  misc_feature (200)..(200): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcggttagggtgtatcaacataaatccggccaggctcccaggctcctcatctttgatgctttcaacagggccctggcgtcccaggcaggttcagtgcagtggtctgggacagactttcactctcaccatcagcagcctagagcctgaagattttgctagtttattactgtcagcagcgtgcctactttcgggcggaggtcgccgtacgtttcggcggtagggaaccaaagtagaggtacaaacgacgtgtggctgacacatctgtcttcntcctcccg

SEQ ID NO: 12185 - DNA, 330 bp, Homo sapiens
  misc_feature: GYAE6OF01DNHTM.10.71.G05.1.454.CMB.1.raw
  modified_base (299)..(299): a, c, t, g, unknown or other
  misc_feature (299)..(299): n is a, c, g, or t
  modified_base (316)..(330): a, c, t, g, unknown or other
  misc_feature (316)..(330): n is a, c, g, or t
tcagcatagtagtgcacgaccggtgctcgatttagtgtcgtcgcaagagagaggggagagtgttagaggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcacatctgtcttcatccttcccgcatctgacactactatgctgagcgggntggcaaggcgcagtagnnnnnnnnnnnnnnn

SEQ ID NO: 12186 - DNA, 879 bp, Homo sapiens
  misc_feature: GYAE6OF01AV4JM.10.71.G05.1.454.CMB.1.raw
  modified_base (216)..(216): a, c, t, g, unknown or other
  misc_feature (216)..(216): n is a, c, g, or t
tcagcatagtagtgcacgaccggtgctcgatttagtgtcgtcgcaagagagagggggagagcccgtggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagtgttcgctacgttcggttagggtgtatacgaactataaacgtccggacaggcctccccgaggtcctcctacatttccgtttagacttcgtacctttaccgaacgtaccggggtccccctgggacccgttccccgagggtccgtaagggtttccgaaggttcgggaccgtagggttcggggtcgtacggggacctaggtaccctttacgaccgttcctaccgaacccgtattaccgaaggtacccgaacggtacccccgttaagggaaccgtaccccgttaagggtaaacggtttacgttttttacggaaccgttttaacggttttttaaacgtttaaccgtttacggtaccgttaaggtacccgttaacgggttccggtttaccggtaccccgtttaaccgggttttttaccgggggacccggggttaacgggtttcccggtaccccgtttaacccgggttttaccgggggaccgggggttaaaaaccgggggtaaaccccgttaaaaaagggtttaaccggggtaaacggggttaaaacccgtaaaaaccggggttaaaaccgttcggggttaaccgggggtaccctttaacgggaaccccgtaaaccccgttagtttcccgttttaaccgg

SEQ ID NO: 12187 - DNA, 576 bp, Homo sapiens
  misc_feature: GYAE6OF01AV3DY.10.71.G05.1.454.CMB.1.raw
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtggggggtccctggagactctcctgttctgcgtctggattcatctttagtaatctggcatgtcctgggtccgccaggttcccaggccacgggctggaagtgggtggcagatatacaatatgatgaacagtaaaatatactatggatactaccgttacgaacgggtccgattaccaaccatcctaccaagaacgaacaacttacccaaagaacctagtggtatactctagacaaatcgaaccctagaccctgaacgacgaccgaaggacgtacggggttagtttaagttacgtggtagggtaataaacgttccgtaaggtcggacaattccgtaccgttggttaacg

SEQ ID NO: 12188 - DNA, 740 bp, Homo sapiens
  misc_feature: GYAE6OF01DDV52.10.71.G05.1.454.CMB.1.raw
  modified_base (112)..(112): a, c, t, g, unknown or other
  misc_feature (112)..(112): n is a, c, g, or t
  modified_base (147)..(147): a, c, t, g, unknown or other
  misc_feature (147)..(147): n is a, c, g, or t
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
tcagcatagtagtgcacgaccggtgctcgatttagtgtcgtcgcaagagagagggggaggaactgctcagttaggacccagagggaaccatggaagccccagctcagcttcncttcctctgctactctggctccagacaccacgganaaattgtgttgacacagtctccagccacgctgtctttgctccgaggggaancgccacctntccgtgcagggccagtcagtagtcgttcgcacgttcggttaggtcgtactcgaaactataacgtcccggacctaaggtcctccgaaggtcctaccgtagtacttccgtttaggacttcggtaccttttaccgaaaccggtcgggtaccccttaggacccgttacccgaaggtcctaaggttccgacggttacggacctaacggtttcggggtacttacggggaaccttaacggtacccgtttacggaaccgtttccgtaaccgtaacccgttaagttcccgaacgggttacccgtaacggtacccgttaacggtaccggtaccgttaacggtaaacggttacgttttaccggtaccgttaacggttttacgttaccgttacggttaccgtaacggtccgtacggtcgtacgtaccgtacgttcggacggtacgtcgtacgtacgttcggacggtacgtaaccgtaaagtcgtaacgtacgaaacgtcgtaggtacgtcgtacgctacgtatacgtagtccttcgtcgttcccg

SEQ ID NO: 12189 - DNA, 549 bp, Homo sapiens
  misc_feature: GYAE6OF01DQEMS.10.71.G05.1.454.CMB.1.raw
  modified_base (289)..(289): a, c, t, g, unknown or other
  misc_feature (289)..(289): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtcttagcagcaactacgtgcctggtaccaacagaaacctggccaggctccccgggntcctcatctatggtacatctagcagggccactggcatcccagacaggttcagtggcaggtgggtctgggacagacttcactctcaccatcagcagactaggagtctagtaagtattttgctagttgttatttattgtcagtactaagttagtaggtaggtcgtaccgttgggtacgttttcgggccgtacggggtaccaaggtcgtagggacgtagtacgaaacgaacgtggtacggcgtacgacctacctgtcgttacg

SEQ ID NO: 12190 - DNA, 538 bp, Homo sapiens
  misc_feature: GYAE6OF01BEDC5.10.71.G05.1.454.CMB.1.raw
  modified_base (203)..(203): a, c, t, g, unknown or other
  misc_feature (203)..(203): n is a, c, g, or t
  modified_base (394)..(394): a, c, t, g, unknown or other
  misc_feature (394)..(394): n is a, c, g, or t
  modified_base (532)..(532): a, c, t, g, unknown or other
  misc_feature (532)..(532): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggctccaggctcctcatctttgatgctttcaacagggcccctggcgtcccaggcaggttcagtgcagtggtcgtgggacagacttcactctcaccatcagcagcctagacgcctagaagtnttttcgactagtttattactgttcagcagtcgtgccctacgtttcggcggtaggtcgtcctacgtttcgggacggacggaaccaaagtagaggtacgaaacgtacgtaggtggtcgtagcaccgtatctgttcttctnttcccg

SEQ ID NO: 12191 - DNA, 583 bp, Homo sapiens
  misc_feature: GYAE6OF01CX5YG.10.71.G05.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (312)..(312): a, c, t, g, unknown or other
  misc_feature (312)..(312): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctntcctgcagggccagtcagagtgttcgctacttcgttaggggtgtatcaacataaactcggccaggcctccgaggctcctcattctttgatgctttcaacnggccctgcgtcccaggcaggttcagtggcagtgggtctgggacagtacttcactctcaccatcagcacgcctagagcctgaagtattttgacttagtttatactgtacagctagcgtgcccgtacgtttcggacggtaggtcgacccgtacgtttcgggacgggtaacgggaaccgtaaaagttacggaacggttaaccgaaaacggtaacgttagggtacggacttacggacctaaccgtacttcgttagttccgttctaacgttccccg

SEQ ID NO: 12192 - DNA, 560 bp, Homo sapiens
  misc_feature: GYAE6OF01B4NM2.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcactttcggttaggggtgtatcaacataaatccggccaggctccaggctcctcattctttgatgctttcaacaggcccctggccgtcccaggcaggttcagtggcagtgggtctggggacagacttcactctcaccatcaagcagcctagacgcctagaacgtattttggactaggtttattactgtcagcagcgtgccctacgtttcgggacggtaggtcgtcccgtacgttttcgggacggaagggaacccaaaaggtagaaggtacaaaacggtacgttaggcggctggaccaccgtattctgttccttcgattccccg

SEQ ID NO: 12193 - DNA, 323 bp, Homo sapiens
  misc_feature: GYAE6OF01AJGI0.10.71.G05.1.454.CMB.1.raw
  modified_base (316)..(323): a, c, t, g, unknown or other
  misc_feature (316)..(323): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttcccgcatctgacactactatgctgagcgggctggcaaggcgcatagnnnnnnnn

SEQ ID NO: 12194 - DNA, 527 bp, Homo sapiens
  misc_feature: GYAE6OF01BLQVG.10.71.G05.1.454.CMB.1.raw
  modified_base (502)..(502): a, c, t, g, unknown or other
  misc_feature (502)..(502): n is a, c, g, or t
  modified_base (522)..(522): a, c, t, g, unknown or other
  misc_feature (522)..(522): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggccctggcgtcccaggcaggttcagtggcagtgggtctgggacagacttcactctcaccatcagcacgcctagacgcctgaagtatttgctagtttattactgtcagcagtcgtcgcctacgtttcggcggtaggtcgtccgtacgtttcgggacggacgggaaccaaagtagaggtacgaaacgacgtgnggctgcactatctgtcttcnttccc

SEQ ID NO: 12195 - DNA, 568 bp, Homo sapiens
  misc_feature: GYAE6OF01CUHU1.10.71.G05.1.454.CMB.1.raw
  modified_base (202)..(202): a, c, t, g, unknown or other
  misc_feature (202)..(202): n is a, c, g, or t
  modified_base (552)..(552): a, c, t, g, unknown or other
  misc_feature (552)..(552): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctactttcgtagggtgtatcaacataaatccggcaggctcccaggctcctcattctttgatgtctttcaacgacggcccctggcgtcccaggcaggttcagtgcagtggtctgggacagacttcactctacaccatcagcagctagactcctagaagtatttgacttagtttatctgtcagcagtcgtcgccgttacgtttcggcggtaggtccgtacccgtcgtttccgggacgggaagggtaaccaaaaggtaggaacgtaccgaaacgtaacgttggtacggctacgacctacccagttctagttccttacnctttcccgttaccccg

SEQ ID NO: 12196 - DNA, 541 bp, Homo sapiens
  misc_feature: GYAE6OF01B3GRM.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtggtatcaacataaatccggccaggctcccaggctcctcatcttgatgctttcaacacgggcccctggccgtccaggcaggttcagtggcaggtgggtctgggacagacttcactctcaccatcagcagcctagacgcctagaagtattttgctagtttattactgtcagcagtcgtgcctacgtttcggcggtaggtcgtcctacgtttcgggacgggtagggaacctaaaagtacgaggtaacaaacgtacgtgtggctgacaccgtattctagtcttcacgttcccg

SEQ ID NO: 12197 - DNA, 556 bp, Homo sapiens
  misc_feature: GYAE6OF01BBDCT.10.71.G05.1.454.CMB.1.raw
  modified_base (203)..(203): a, c, t, g, unknown or other
  misc_feature (203)..(203): n is a, c, g, or t
  modified_base (390)..(390): a, c, t, g, unknown or other
  misc_feature (390)..(390): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgcacttcggttaggggtgtatcaacataaatccggcaggctccaggctcctcatctttgatgtctttcaacgcgggcccctggcctcccaggcaggttcaggtggcaggtgggtctgggacagcttcactctcaccatcagcacgcctagacncctagaacgtattttgcttagtttattactgtcagcagtcgtgcctacgtttcggcggtaggtcgccgtacgtttcgggacggacggaaccaaaagtggaacggtacgaaacggtacgtggtcggtcgtcgaccaccgtacgttcttagttccttcgtcttccccg

SEQ ID NO: 12198 - DNA, 563 bp, Homo sapiens
  misc_feature: GYAE6OF01C3OE3.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgcagggccagtcagagtgttcgctacttcggtagggtgtatcaacataaatccggccaggctccaggctcctcatctttgatgctttcaacacgggccctggcgtcccaggcaggttcagtggcagtggtctgggacagacttcactctcacatcagcagcctagacgcctagaagtattttgacttagtttattactgtcagcagcgtcgcctacgtttcggcggtaggtcgtccgtacgtttcgggacgggtacgggaaccgtaaaagtaggaacggtacgaaacgtaacgtaggtacggtcgtcggacctaccgtactacgttgttccttcgtacttccccg

SEQ ID NO: 12199 - DNA, 606 bp, Homo sapiens
  misc_feature: GYAE6OF01DHPHE.10.71.G05.1.454.CMB.1.raw
  modified_base (267)..(267): a, c, t, g, unknown or other
  misc_feature (267)..(267): n is a, c, g, or t
  modified_base (276)..(276): a, c, t, g, unknown or other
  misc_feature (276)..(276): n is a, c, g, or t
  modified_base (404)..(404): a, c, t, g, unknown or other
  misc_feature (404)..(404): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccaggtaccaccggagagattgtgttgacgcattcgccagcccacccttgttcctttttctccgaggggacagagtccaccctctcctgtagggccagttatggtgtggcgctatttaacngtaaccaanagaacgtggccaggcctccgaggcctcctcactcgtaacgaagcactcccaccgacgggccacgtcggccgtcccgagcccgaggttcgagtggcaggtgggtctgggacagtacttcactctcaccntcagcacgctggacgctagaatatattgacttagtttattattgtcagtcagtcgtagcgtaggttcgtcctttcgtacgtttccgggacccggggtactaaagggtacggtaaaacgtaccgaaacggtaaccgttgggtacggacgtacgacccgtacctagttccgttacgttacctttacctccgttcccgttccccg

SEQ ID NO: 12200 - DNA, 571 bp, Homo sapiens
  misc_feature: GYAE6OF01AQN84.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttaggggtgtatcaacataaatccggccaggctcccaggctcctcatctttgatgtctttcaacacgggcccctggccgtcccgaggcaggttcagtggcagtgggtctgggacagacttcactctcaccatcagcacgcctagacgcctagaagtatttgctagtttatactgtcagcagtcgtgtccctacgtttcgggacggtaggtcgtcccgtacgtttcgggacgggacgggtaaccaaaagttaggaacggttaccgaaaacggtaactggtacgggctggacctaaccgtagttcctaggtaccttcgtacttccccg

SEQ ID NO: 12201 - DNA, 520 bp, Homo sapiens
  misc_feature: GYAE6OF01AJ8VR.10.71.G05.1.454.CMB.1.raw
  modified_base (213)..(213): a, c, t, g, unknown or other
  misc_feature (213)..(213): n is a, c, g, or t
  modified_base (271)..(271): a, c, t, g, unknown or other
  misc_feature (271)..(271): n is a, c, g, or t
  modified_base (396)..(396): a, c, t, g, unknown or other
  misc_feature (396)..(396): n is a, c, g, or t
  modified_base (508)..(508): a, c, t, g, unknown or other
  misc_feature (508)..(508): n is a, c, g, or t
  modified_base (514)..(514): a, c, t, g, unknown or other
  misc_feature (514)..(514): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccaccctctcctgcagggccagtcagagtgttcgcacttcgttagggtgtatcaanataaatccggcaggctcccaggctcctcatcttgatgctttcaacagggcccctggccgtccaggcaggttcagtggcaggtgggtctgggacagacttcactctcaccatcagcagcctagacncctagaagtattttgactagtttacttactgtacagtcagtcgtgcctacgtttcggcggtagtcgcctacgttcggcggtacggacaaagtcgaggtacaacgatgtcgcngacacngtctcg

SEQ ID NO: 12202 - DNA, 552 bp, Homo sapiens
  misc_feature: GYAE6OF01CD3RZ.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggctccaggctcctcatctttgatgctttcaacagggcccctggcgtcccaggcaggttcagtggcagtgggtctgggacagacttcactctcaccatcagcagcctagacgcctagaagtattttgctagtttattactgtcagcagcgtgtccctacgtttcggcggtaggtcgtccgtacgtttcgggacggtacgggaacctaaaagtacggaacggtacgaaacggtaacttaggtaggtctacgacacctagttctagttcttctattccccg

SEQ ID NO: 12203 - DNA, 526 bp, Homo sapiens
  misc_feature: GYAE6OF01EWS3Z.10.71.G05.1.454.CMB.1.raw
  modified_base (340)..(340): a, c, t, g, unknown or other
  misc_feature (340)..(340): n is a, c, g, or t
  modified_base (433)..(433): a, c, t, g, unknown or other
  misc_feature (433)..(433): n is a, c, g, or t
  modified_base (511)..(511): a, c, t, g, unknown or other
  misc_feature (511)..(511): n is a, c, g, or t
  modified_base (517)..(517): a, c, t, g, unknown or other
  misc_feature (517)..(517): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttccggccacgggctggaatggggtggcagatatacaatatgatgaacagtaaaatatactatgganactcttcaaggccgattcacatctccagagacaattaccaagaacatggtgtatctgacaaatcgaccagcctgagagccgaggacacgggtntttatacgtggtaggagaatccgtagtgcatccacttggtattggtgacgttcccgggaccagggtacccgtggtacncccgtntcgtcccgg

SEQ ID NO: 12204 - DNA, 325 bp, Homo sapiens
  misc_feature: GYAE6OF01CVSPE.10.71.G05.1.454.CMB.1.raw
  modified_base (314)..(325): a, c, t, g, unknown or other
  misc_feature (314)..(325): n is a, c, g, or t
tcagcatagtagtgcacgaccggtgctcgatttagtgtcgtcgcaagagagaggggagagtgttagaggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtacaaacgaactgtggctgcacatctgtctcatcttcccgcatctgacactactatgctgagcgggctggcaaggcgcatagnnnnnnnnnnnn

SEQ ID NO: 12205 - DNA, 581 bp, Homo sapiens
  misc_feature: GYAE6OF01E3NI4.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggcaggctccaggctcctcatctttgatgctttcaacagggcccctggccgtcccaggcaggttcagtggcagtgggtctggggacagacttcactctcaccatcagcagcctagagcctagaagtattttgctagtttatactgtcagcagtcgtgcctacgtttcgggacggtaggtcgtcccgtaccgtttcgggaccgggtaacgggaaccctaaaagtacggtaacgggtaccaaaacggtaaccgttaggtacgggtcctcggacctaacccgtaattccgtacgttcctttccgacgtttccccg

SEQ ID NO: 12206 - DNA, 515 bp, Homo sapiens
  misc_feature: GYAE6OF01EVG0A.10.71.G05.1.454.CMB.1.raw
  modified_base (202)..(202): a, c, t, g, unknown or other
  misc_feature (202)..(202): n is a, c, g, or t
  modified_base (378)..(378): a, c, t, g, unknown or other
  misc_feature (378)..(378): n is a, c, g, or t
  modified_base (496)..(496): a, c, t, g, unknown or other
  misc_feature (496)..(496): n is a, c, g, or t
  modified_base (501)..(501): a, c, t, g, unknown or other
  misc_feature (501)..(501): n is a, c, g, or t
  modified_base (503)..(503): a, c, t, g, unknown or other
  misc_feature (503)..(503): n is a, c, g, or t
  modified_base (508)..(508): a, c, t, g, unknown or other
  misc_feature (508)..(508): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggcaggctccaggctcctcatcttgatgctttcacagggccctggcgtcccaggcaggttcagtgcagtggtctgggacagacttcactctcacatcagcagcctagacncctagtaagtatttgctagtttattactgtcagtcagtataagtgtacgttgggttttatcgtactttcggccttagggtacctaagtcggtatttcgagtacgagtgtgctgcaccngtctntnttacntctcccg

SEQ ID NO: 12207 - DNA, 609 bp, Homo sapiens
  misc_feature: GYAE6OF01BXPIH.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagacgcctgaagattttgctagtttattactgtcagcagcgtgcctacgtttcgggcggtaggtcgcccgtacgttttccgggacgggtacgggaaccctaaaaagttacgggaaacgggttaccgtaaaaccgggtaaaccttagggttacggggtcccttacgggaacccgtaaccccgtaacgttacccgttaggtttcccctttccgtaacgttttacccccgg

SEQ ID NO: 12208 - DNA, 559 bp, Homo sapiens
  misc_feature: GYAE6OF01DYJ05.10.71.G05.1.454.CMB.1.raw
  modified_base (201)..(201): a, c, t, g, unknown or other
  misc_feature (201)..(201): n is a, c, g, or t
  modified_base (306)..(306): a, c, t, g, unknown or other
  misc_feature (306)..(306): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctccaggctcctcatctttgatgctttcaacngggcccctggctcccaggcaggttcagtggcaggtggtctgggacagacttcactctcaccatcagcagcctagacgcctagaagtattttgctaagttttattactgtcagcagcgtcgcctacgtttcgggcggtaggtcgtcccgtacgtttcgggacgggacgggtaaccaaaagtaggacggtacaaacggtaacgtggtaggctcggaccacctagttcctacgttcttctacgttccgttaccccg

SEQ ID NO: 12209 - DNA, 557 bp, Homo sapiens
  misc_feature: GYAE6OF01EUOKC.10.71.G05.1.454.CMB.1.raw
tcagcatagtagtgcacgaccggtgctcgatttagtgtcgtcgcaagagagagggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcgtggtccggcgtggggggtccctgagctctcctgttctgcgtctggattcattctttagtaatctggctatgtccgtcgggtccgccgtacggttccagggcccgacgggctggaagtgggtgcagatatacaatatgatgaacaagtaaatatactagtggatactccttacgaagggcctattccacctactcctaccagacaactaacttaccaagaactagtggtatactctagactaaatcgaccagcctagaaggacgccggaaggacgtacgggttatttagttacgtgggtagggataaacgttcgtaggtcgactatcgacgtggttacg

SEQ ID NO: 12210 - DNA, 511 bp, Homo sapiens
  misc_feature: GYAE6OF01DQG96.10.71.G05.1.454.CMB.1.raw
  modified_base (203)..(203): a, c, t, g, unknown or other
  misc_feature (203)..(203): n is a, c, g, or t
  modified_base (505)..(506): a, c, t, g, unknown or other
  misc_feature (505)..(506): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaaangccaccctctcctgcagggccagtcagatgttcgcacttcgttagggtgtatcaacataaatcggcaggctccaggctctcatctttgatgctttcaacagggcccctggcgtcccaggcaggttcagtgcagtgggtctgggacagaacttcactctcaccatcagcagcctagagcctgaagtattttgctagtttattactgtcagcagcgtgcctactttcggcggaggtgcctacgtttcggacggacgggaacaaaagtagagtacaaacgaactgtgtctgcacatactgtcttnnttccg

SEQ ID NO: 12211 - DNA, 538 bp, Homo sapiens
  misc_feature: GYAE6OF01DO5P4.10.71.G05.1.454.CMB.1.raw
  modified_base (388)..(388): a, c, t, g, unknown or other
  misc_feature (388)..(388): n is a, c, g, or t
  modified_base (411)..(411): a, c, t, g, unknown or other
  misc_feature (411)..(411): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
tcagcatagtagtgcacgaccggtgctcgatttagtgtcgtcgcaagagagagggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcattctttagtaaatctggcatgtcctgggtccgccaggttcccaggccgacgggctagggaagtgggtgcagatatacaatatgatgaacaagtaaaatatactatggatactccttanaagggtccattcacatctcaganacataccaagacatggtagtatctgacaatcgaccagcctgagcgaccgaggacgtacgggttntttagttacgtggtagggaanaaacgttccgtaaggtcggactagttaccaccgttggttacg

SEQ ID NO: 12212 - DNA, 784 bp, Homo sapiens
  misc_feature: GYAE6OF01D5X89.10.71.G05.1.454.CMB.1.raw
  modified_base (212)..(212): a, c, t, g, unknown or other
  misc_feature (212)..(212): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtcttgtctccaggggaanagccaccctctcctgcagggccagtcagagtgttcgctacttcggttagggtggtatcaactataaactccggccaggcctcccgaggcctcctcattctttgatgtctttacaacgcgggtcccctgggccgtcccgaggcctagggttcaggttcgggctaggtcggggtcgtacggggaactacggtaccttccgaaccttccttaccaacccgtacttaccgaacggtccgaacgtaccccgttaaaggaccgtacccgttaaggtaaaggtttacgtttttacgggtacctttaaggtttttaactttaccgttacggttaccgtacggtaccgtaacggtacccggtcggtaccccgtttaccggttttcccgggggacgggttaacgggttccggtaccccgttacgggttttacccgggggaaccgggggtaaaccggggtaaaacccggtaaaaacggttaacgggtaaacggggttaaacccgtaaaaacccgggttaaacggttcgggttaacgggtaccggttaccggaacccgtaacccgtaacgttccgtttaaccgg

SEQ ID NO: 12213 - DNA, 576 bp, Homo sapiens
  misc_feature: GYAE6OF01CGMYW.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctactttcgtagggtgtatcaacataaatccggcaggctccaggctcctcatcttgatgctttcaacgacgggcccctggcgtcccaggctaggttcagtggcaggtggtctgggacagacttcactctacaccatcagcacgcctagacgcctagaagttattttgacttaagtttattacgtcgtacacgcagtcgtcgtcctacgtttcgggcggtaggtcgaccttacgtttcgggacggtaacggggaaccaaaaggtcggaacggtaccgaaaacggtacgtggtaggacctgacctaccacgttctacgttaccttcacttcccgttacccc

SEQ ID NO: 12214 - DNA, 542 bp, Homo sapiens
  misc_feature: GYAE6OF01CXVG7.10.71.G05.1.454.CMB.1.raw
  modified_base (410)..(410): a, c, t, g, unknown or other
  misc_feature (410)..(410): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtgtatcaacataaatccggcaggctccaggctcctcatctttgatgtctttcaacacgggcccctggcctcccaggctaggttcaggtggcaggtgggtctgggacagactttcactctacaccatcagcagcctagcgctagaatntttgacttagtttatactgtcagcagcgtgcctacgtttcggcggtagtcgcctacgttcgggacggacggaacctaaaagtggaggtaacgaaacgtacgtggtcggacttacgaccaacctgtcgttacg

SEQ ID NO: 12215 - DNA, 334 bp, Homo sapiens
  misc_feature: GYAE6OF01C0R2M.10.71.G05.1.454.CMB.1.raw
  modified_base (319)..(334): a, c, t, g, unknown or other
  misc_feature (319)..(334): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccacgtttcggcggagggaccaaaaatagaggtcaaaacgaactgtggctgcacatctgtctcatcttcccgccatctgacactactatgctgagcgggctggcaaggcgcaatagnnnnnnnnnnnnnnnn

SEQ ID NO: 12216 - DNA, 555 bp, Homo sapiens
  misc_feature: GYAE6OF01DYNCG.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcggttagggtgtatcaacataaatccggccaggctccaggctcctcatcttgatgctttcaacgagggccctggccgtcccaggctaggttcagtggcaggtgggtctgggacagacttcactctcaccatcagcagctagcgcctagaagtattttgactagtttattactgtcagcagtcgtcgcctacgtttcggcggtacggtcgcctacgtttcggacggtacgggaaccaaagtacggacggtacgaaacgtaacgtagtcggcgtacgccaaccgtactacgttgttccttcgtcgttaccccg

SEQ ID NO: 12217 - DNA, 550 bp, Homo sapiens
  misc_feature: GYAE6OF01B6TLP.10.71.G05.1.454.CMB.1.raw
  modified_base (330)..(330): a, c, t, g, unknown or other
  misc_feature (330)..(330): n is a, c, g, or t
  modified_base (382)..(382): a, c, t, g, unknown or other
  misc_feature (382)..(382): n is a, c, g, or t
  modified_base (398)..(398): a, c, t, g, unknown or other
  misc_feature (398)..(398): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggaggcgtggtccggcctggggggtccctgagactctcctgttctgcgtctggattcatctttagtaaatctggcatgtcctgggtccgccaggttccaggccacgggctggaatggggtgcagatatacaatatgatgacagtaaaatntactatggagtactcctgaaggccattcactatctacagagactaatccaanaacatggtatatctanacaatgaccagcctgagagcgagacgtagggtatttacttacgtggtagggaataactcgtaggtcgacagtaccgacgttggtattggtcgtaccggttcccggggtaccgtaacggggacccgttggtaccctacccggttcttacccgg

SEQ ID NO: 12218 - DNA, 664 bp, Homo sapiens
  misc_feature: GYAE6OF01BGPLY.10.71.G05.1.454.CMB.1.raw
  modified_base (214)..(214): a, c, t, g, unknown or other
  misc_feature (214)..(214): n is a, c, g, or t
  modified_base (492)..(492): a, c, t, g, unknown or other
  misc_feature (492)..(492): n is a, c, g, or t
  modified_base (627)..(627): a, c, t, g, unknown or other
  misc_feature (627)..(627): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtcttgtctccgaaggggaangccaccctctcctgcgagggccagtcagagtgttcgctacttcggtaggtgtatacaacataaactccggcaggcctcccgaggccttccgtactattccgtttgacgtcgtcctttaccgaaacgtaccgggtcccctagggtcccgtcccgaggctaggttcaggtcggcgtaggtggtcgtgggactacgtacttcgactctaccactatcgacgacacgtacccgtaagaccgtcctaggtaagttcgttttagacgttaagttttactacgtntacgaacgtcggtacgtccggttacgtaccgttaccgtttacggggacggttaaggttcccggtacccggttcggttaccggggacggggtaaccgtaaaaccgtaaggtaacggaacggtaacgtaaaaccggngttcgggaagtccaggacctacgtacgtcgttaaccg

SEQ ID NO: 12219 - DNA, 547 bp, Homo sapiens
  misc_feature: GYAE6OF01B9TNT.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggctccaggctcctcatcttgatgctttcacagggccctggcgtccaggcaggttcagtggcagtgggtctgggacagacttcactctcaccatcagcacgcctagacgcctgaagtattttgctagtttattactgtcagcagtcgtcgcctacgtttcggcggtacggtgtccgtacgttttcgggcggtacgggaaccgtaaaacgtaggaacggtacgaaaacggtaacgtgtagggtctcgacaccgtactcttgtcttctacgttcccg

SEQ ID NO: 12220 - DNA, 593 bp, Homo sapiens
  misc_feature: GYAE6OF01BOZNF.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgcacttcggtagggtgtatcaacataaatccggcaggcctccaggctcctcatctttgatgtctttcaacgacgggtcccctgggccgtcccgaggccgtaggttcaggtggctaggtggggtctgggacagtacttcactctcaccatcagcagcctagacgcctagaagttatttgactaagttttacttacgttgtacagctagcgttcgccgtacgtttcgggcggtacggtcgtacccgtacgtttccggggacggacgggtaacctaaaagtacggtacggtaaccgaaacggtaacgtgggtacggtccgtagcccaaccgtacttctacggttccttcgtcttcccg

SEQ ID NO: 12221 - DNA, 573 bp, Homo sapiens
  misc_feature: GYAE6OF01C6JWR.10.71.G05.1.454.CMB.1.raw
  modified_base (215)..(215): a, c, t, g, unknown or other
  misc_feature (215)..(215): n is a, c, g, or t
  modified_base (380)..(380): a, c, t, g, unknown or other
  misc_feature (380)..(380): n is a, c, g, or t
  modified_base (407)..(407): a, c, t, g, unknown or other
  misc_feature (407)..(407): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgcattcgttaggtgtatcaacataatccgcaggctccaggctcctcatcttgatgctttcacacgggcccctggccgtcccaggcaggttcaggtgcgtaggtgggtctgggacagacttcactctcacntcagcagtcctagcgcctagtaaagtnttttgacttagttttacttacgttgttacagtcgagcgttacgcccgttacgtttcgggcgggttaggtcgtcccgtacggtttccgggacgggtacggggaacctaaaagttagggacggtactaaaacggaacgttggaggtccgtagaccacctgtcgttcgg

SEQ ID NO: 12222 - DNA, 668 bp, Homo sapiens
  misc_feature: GYAE6OF01AV22U.10.71.G05.1.454.CMB.1.raw
  modified_base (213)..(213): a, c, t, g, unknown or other
  misc_feature (213)..(213): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgctccaggggaaancgccacctctcctgcaggccagtcagagtgttcgctactttcggttagggtgttaatcaactataaactccggcaggcctcccaggccttcctcattctttgatcgtcctttacgaacgcgggtcccctagggcccgtacccgaggtccctagggttccagggttcgcgtaggtcggggtctagggaactcggtacttcacttcaccacatcacgtcaacggtcctaaggacgtccgtagaacgttagttttcgacttaagttttactacgttcgtctagtaccgtaggtccgtacggtacccgttaggttccggggacggttacgtccggtaccgttaccgggtttcggggaccggaaacggtaaaccggttaaaagtacggggtaaccgtaacgggaaaacgttacggttcggtaacgggtcctacgaaccctaaccgttgttccggttaccg

SEQ ID NO: 12223 - DNA, 746 bp, Homo sapiens
  misc_feature: GYAE6OF01CZH3J.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagcttgggttttcctcgttgcttcttttaagagatgtccagtgtcagatgcagagtgggtggagtcggtggggggaggtcggtcgggtcccgggccggtcggggggtccctggacgtccttcctccttgttctgcgttcgtggtattctattactttaagtaacttcgtggctagttcggttccggtcgggtcccgaccgtacggtccgacgggcccgacggggtcgtagggtaagttgggggtacgacgaagtataactaacgtaaatagtagaatagaaactaaagttaaaaactatacgtaagtaggaacttaccttaccgttaacggaacgggtccctaattccgaacctatacctaccgaaagaactaactaacttaaccaaagtaactagtggtaatatacgtagaactaaacgtacgaccgacgacctaggaacgacggaccggaaggtacggttaacggtttagtttaacgttagggtaggtaagggtaaacttaaccgttcggtaaggtaccgactacgttaccgtaacggttggtttaacgttcggttaaccggtacccgggttacccggggaccggttaacggggtaacccgttcggtacccctccggttcccgttacccgg

SEQ ID NO: 12224 - DNA, 595 bp, Homo sapiens
  misc_feature: GYAE6OF01DK3EW.10.71.G05.1.454.CMB.1.raw
  modified_base (318)..(318): a, c, t, g, unknown or other
  misc_feature (318)..(318): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaagacgcccaccctctcctgcagggccagtcagagtgttcgctacgttcgttagggtgtatcaaacataaatccggcctaggcctcccaggctcctcattctttgatgtctttcaacncgggccctggccgtcccaggctaggttcaggtcgcgaggtgggtcgtgggactagacttcgactctcaccatcagcagtacctagacgccgtagaagtatttgactagtttattactgtacagctacgcgtcgtcctacgtttcggcgggtacgtcgtaccctagtttcggacggtacggaaccaaaagtacgaacggtaccgaaacggtaacgttaggtacggtccgtacgacccgtaacctacgttaccgttcgttaccttacgtctttaccccg

SEQ ID NO: 12225 - DNA, 556 bp, Homo sapiens
  misc_feature: GYAE6OF01EACCO.10.71.G05.1.454.CMB.1.raw
  modified_base (213)..(213): a, c, t, g, unknown or other
  misc_feature (213)..(213): n is a, c, g, or t
  modified_base (408)..(408): a, c, t, g, unknown or other
  misc_feature (408)..(408): n is a, c, g, or t
  modified_base (548)..(548): a, c, t, g, unknown or other
  misc_feature (548)..(548): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtcttgtctccaggggaaangccacctctcctgcagggccagtcagagtgttcgcacttcgttaggtgtatcaacataatccggcaggctccaggctcctcatctttgatgtctttcaacagggcccctggccgtccaggcaggttcagtggcaggtgggtctgggacagtacttcactctcaaccatcagcacgctaagagcctagaaacgttnttttgacttagttttacttactgtcagcagtcgtgccttacgtttcgggcggtaggtcgtccgtacgtttccgggagggaacgggaacctaaaaggtcggaaggtaccaaacggtaacgtggtacggtctagaccctacntcgttacg

SEQ ID NO: 12226 - DNA, 619 bp, Homo sapiens
  misc_feature: GYAE6OF01A4PXX.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaanagccaccctctcctgcagggccagtcagagtgttcgcacttcgttagggtgtatcaacataaatccggcaggctccaggctcctcatctttgatgtctttcaacgcgggcccctggccgtcccaggcaggttcagtggcaggtgggtctgggacagtacttcactctcaccatcagcagcctagacgcctagaacgtattttggacttaagtttattacgttgtcagctaggcgttcgccgtacgtttccgggcgggtacggttcggtacccgttaccggttttcgggacgggaacgggtaacccgtaaaaggtacgggtaacgggtaaccgaaaaccggtaaccgttgggtacggtccgttacggaccctaacccgtacgttaccgttacggtttcctttccgtaacgtttccccg

SEQ ID NO: 12227 - DNA, 694 bp, Homo sapiens
  misc_feature: GYAE6OF01AF7V2.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcatctttagtaaatctggcatgtcctgggtccgccgaggttccaggccacggggctggaagtggggtggcagatatacaatatgatagaactaagtaaaatataactagtaggaagtaccttccttacgaacgggcctattccaaccactcctaccgagtaacgactaacttaccaaagaactagtaggtagttaactcgtagaacaaatcgaaccctagcccgtaggaacggacggaccggaacgggtaaccgtacggggtttagttttaacgttaccggttagggtaacggggtaagtaaaacgttccggtaaggtcgggtacctaagttacccgtaaccggtttgggttactttacgggtccgggttacccggtttaccccggggggacccgtaaacggggggtaaccccgggttagggttaccccgttaccccggttccggtttacccccggg

SEQ ID NO: 12228 - DNA, 717 bp, Homo sapiens
  misc_feature: GYAE6OF01CQYX6.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgttctttgtctccgaggggaaancgccacctctcctgcagggccagtcagagtgttcgctacgttcggttagggtgtactacaactataaactccggacacggcctcccgaggcctcctctattctttgatcgtctttacgaacgtacggccccgtggccgtccccgaggcgtaggtttccagggttcggacgtagggttcgggtcgtaggggaactacggtacctttcaccttctacctacctataccgacgacgaacgtccgtaaggacgtcctaggtaagttacttttgacgtttaagttttaataccgtagttcaacgctaacggtccgtacgtacccgttacggttttaccggggacgtacgggttcctacccggttacgggtttcccgggacgggtaacgggtaaacccgtaaagtaacgggtaacggtaaaccgaaaacgggttaccgtgggttacggaccgttacggcccgtaaacccgtcgttaccggttacctttacttacccgttacgtttccccgtttacccccg

SEQ ID NO: 12229 - DNA, 291 bp, Homo sapiens
  misc_feature: GYAE6OF01EETW7.10.71.G05.1.454.CMB.1.raw
  modified_base (281)..(291): a, c, t, g, unknown or other
  misc_feature (281)..(291): n is a, c, g, or t
tcagcatagtagtgcacgaccggtgctcgatttagtgtcgtcgcaagagagagggggtgagccatcaaattgctgacagacttcactctcaccatcagcagactggagcctgaagattttgcagtttattactgtcagcagcgtgccactttcggcggaggtgccactttcggcggaggaccaaaaagtagaggtcaaacgaactgtggctgcaccatctgtctcatcttcccgccatctgacactactatgctgacgcggggctggcgaaggcgcatagnnnnnnnnnnn

SEQ ID NO: 12230 - DNA, 853 bp, Homo sapiens
  misc_feature: GYAE6OF01C5C1A.10.71.G05.1.454.CMB.1.raw
  modified_base (208)..(208): a, c, t, g, unknown or other
  misc_feature (208)..(208): n is a, c, g, or t
tcagcatagtagtgcacgaccggtgctcgatttagtgtcgtcgcaagagagaggaggggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaancgcccaccctctcctgcagggccagtcagagtgttcgctacgtttcggttagggtgtatacaaactagtaaacgtccggaccagggcctcccgaggtcctcctctattctttgattcgtcctttacaacgacgggtccccctgggcccgtcccgagggctaagggttccaggtggacgtagggtcgggtcgtacggggaacctaacggtaccttccgaaccgttccctaccgtaaacccgtagttaccgaacggacccgtaacgaccccgttaaagggaccggtacccgttaagggtaaacggttttaccgtttttacgggaccgtttaaacggtttttaactttaaccggtttcggtaccgtaacggtaccgtaacgggtccggtttaccggtaccccggtttaaccggttttacccgggggaccggggttaaccgggttcccgggtaaccccgttaaccggggttttacccgggggaaccgggggtaaaaccggggtaaaacccgttaaaaaggttaaccggggaaaccgggtttaaacccggaaaaacccgggttaaccggttagggtacccggggtaccttacccggaacccgttaacccgtagtttaccggtttcggtttaccctttccggttaaacccg

SEQ ID NO: 12231 - DNA, 559 bp, Homo sapiens
  misc_feature: GYAE6OF01BIPEM.10.71.G05.1.454.CMB.1.raw
  modified_base (266)..(266): a, c, t, g, unknown or other
  misc_feature (266)..(266): n is a, c, g, or t
  modified_base (455)..(455): a, c, t, g, unknown or other
  misc_feature (455)..(455): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagaaatctgcatgtcctgggtccncaggttccaggccacgggctggaatggggtggcagatatacaatatgatgaacaagtaaaatatactatggagactccttacgaagggccgtattcaacctatcctaccgagacgacaacttaccaagaacagtggtagtatctagactaaatcgaaccagccctggacgagccgaggactacgggttntttatacgtggtaggaataaactccgtagtggactagtccacgttggtattggtntaccggttccgggacgtaacgggtaaccgtggtacctccgttctcccgg

SEQ ID NO: 12232 - DNA, 862 bp, Homo sapiens
  misc_feature: GYAE6OF01CJRK5.10.71.G05.1.454.CMB.1.raw
  modified_base (215)..(215): a, c, t, g, unknown or other
  misc_feature (215)..(215): n is a, c, g, or t
tcagcatagtagtgcacgaccggtgctcgatttagtgtcgtcgcaagagagagggggagagccctgtggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagtgttcgctacgtttcggttagggtggtatacaaacaataaactccggaccaggcctccgacggtcctcctcatttccttttagacttcgtaccttttaccgaaccgtacggggtcccccttgggccgtaccccgaagggtccgtaacggtttccgaagggttcgggacctaaggggttcggggtccgttagggggaactaacgggttacctttaccgaccttcccgttaccaaccctaagttacccgaacggaccccgtaacggtccccgttaaacggaaccggtaccccgtttaaggtaaaacggtttacgttttttacggacctttaaaggtttttaactttaaccgttcgggttacaacggtaccgtaacggtccggttaccggtaccccgttaacgggttttccggggaccgggttaacgggttaccggtaccccgggtttaacggtttttacccgggggaaccgggggttaaaaccggggaaaaccccgttaaaaaagggttaacgggggtaaaaccgggtttaaacccggtaaaaaaacccgggttaccggtttaacggggttaccggggtaaccgttacgggaacccctaaacccgtacgtttacccgg

SEQ ID NO: 12233 - DNA, 603 bp, Homo sapiens
  misc_feature: GYAE6OF01B5ZY7.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaancgccaccctctcctgcagggccagtcagagtgttcgcacgtttcggtagggtgtatcaacataaatccggcaggctccaggctcctcattctttgatgctttcacgacggtccctggccgtccagggctaggttcaggtggctaggtggtactgggacagtactttcactcacaccatcagcacgtctagcgtcctagaagtctttgacttagtttacttactgtacacgtcgtagtcgtcgtaccgttaccgttcgggacggtacggtccgacccgttacggttccgggagggtaacgggaacctaaaaggtacggtaaggtaacctaaaacggacgttcggtagggacctacgaccgtactacgttcgtacggttacttccgtaacttcccgttaccccg

SEQ ID NO: 12234 - DNA, 610 bp, Homo sapiens
  misc_feature: GYAE6OF01B7LOC.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgcccaccctctcctgcagggccagtcagagtgttcgctacgttcggttagggtgtatcaacataaatccggccaggctccaggctcctcatctttgatgctttcaacagggcccctggccgtcccgaggctaggttcagtggcaggtgggtctggggacagtacttcgactctcaccatccagtcacgtccgtagacgccgtagaagttattttgactagttttacttacgtgtacagtcagtcgtgtccctacgtttcgggacgggaggttcgcccgttacggtttccgggacgggtaacgggaacccgtaaaaggtacggtaacggtaaccgaaaaccggtacgttacggtgggtcctacgaccgtaacctactacgttagttccttccgtcgtttacccccg

SEQ ID NO: 12235 - DNA, 607 bp, Homo sapiens
  misc_feature: GYAE6OF01C8XQB.10.71.G05.1.454.CMB.1.raw
  modified_base (263)..(263): a, c, t, g, unknown or other
  misc_feature (263)..(263): n is a, c, g, or t
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggagtttgggctgagctgggttttcctcgttgcttctttaagagatgtccagtgtcagatgcagatggtggagtcgtgggggaggcgtggtccggccgtgggggtccctgacgctcctctgttcngtcgtctggattcattcttaagtaatctggctatcgtccgtggtcccgccgaggttccaggccgacgggctaggaagtgggtgacagactataacaatagtgatagactaaagtaaaatataactagtcggaataccttccgttacgaacgggcctattaccgacctatcctaccaagaccgtaacaaacgttaccaaagtaacctagttaggtagtactctagactaaagtccaaccagcccgtaaggacggacggtaccggaacgggttaaccgtacgggtttagttttaagttacggttagggtaagggaacgtaaagttcccgtaaggtcggtctaaccg

SEQ ID NO: 12236 - DNA, 778 bp, Homo sapiens
  misc_feature: GYAE6OF01B7HK1.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgagggaaagcgccaccctctcctgcacgggccagtcagagtgttcgctacgttcggttaggggtggtatacaactaataaacgtcccggacctacggcctcccgaggtcctcctcattctttagattgtcctttacgaacgtaccgggtcccccgtagggtccgtccccgaagggccgtacggttccgaggttcgggaccgtagggttggggttaccgtacgggggaacctaacgggtaccctttaccgaacccgtttcctacccgtaaacccacgttacccgaacgggtacctaacgggtacccgttaacggtaaccggtcccgtttaagggtaaacggtttaacgtttttacggaaccgtttaaggtttttaacgtttaaccgttacgttaccgtaacgtacgtacggtaccggtcgttacccgtaccgggttttccgggaccgggttacggtccgtaccgttacggtttcgggacgggtacggaaaccgtaaaagtcggtaaacggtaacgaaacggtaacgtcggtacggtaccgtacgacctaaccgtacttacggttattcttcctacgtttaccccg

SEQ ID NO: 12237 - DNA, 565 bp, Homo sapiens
  misc_feature: GYAE6OF01A61LI.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccacctctcctgcagggccagtcagagtgttcgctacgtttcggttagggtggtatcaacataaatccggcaggcctccaggctcctcattctttgattgtcctttacaacgcgggcccctgggcctcccaggctaggttcaggtcggctaggtgggtctggggactaggtacttcacgttcctacaccagtcaggccacgcctagacgcctagaagttatttgacttagtttattctagttcagcagtcgtgtccgtacgttcgggacgtacggtcgtccgtacgttcggacggaaggtaacaaagtgacggtaacaaacgacgtggtcgctgacacgtactcgttagtcttgcttccg

SEQ ID NO: 12238 - DNA, 695 bp, Homo sapiens
  misc_feature: GYAE6OF01BD2T5.10.71.G05.1.454.CMB.1.raw
  modified_base (218)..(218): a, c, t, g, unknown or other
  misc_feature (218)..(218): n is a, c, g, or t
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggctcccagacaccaccggagaaattgtgttgacacagtctccagccacgtctgtctttgtctccgaaggggaaancgcccaccctctcctgcagggccagtcaggagtgttcgctacttcggttagggtgtatcaactataaatccggaccaggcctccccgaggtcctcctctattcctttgacttgtccttttacgaacgtacgggccccctgggcccgtacccgagggccgtaggttcaggtcggctagggtgggtcgtgggacacggtactcactctacgaccatcgagccacggtcccttaaggacgtccgtaaggtaacgttaagtttttggacctttaaggttttacttacgttcggtactagaccggtagtccgttagtacccgtaacgttttccggggacggtacggttccgtacccgttacggtttccggggacgggtaacggtaaacccgtaaaaggtacgggttaaccggtaaccgtaaaaacgggtaccgttagggttccgggtacgtacggtaccctaacggtcgttccgtttaccgg

SEQ ID NO: 12239 - DNA, 753 bp, Homo sapiens
  misc_feature: GYAE6OF01DO7QU.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcattctttagtaatctggcatgtccgtggtccgccaggttccaggccacgggctggaagtgggtgcagatagtacaatatgaatgaactaagtaaaatatactagtaggacgtaccttccgttacgaagggtccgtaattaccgaacctactacccgtaccgaagaacgtaacctaaactttacccgaaaaggtaaaccttaggttacgggttacggttaaacttaccggttaagaaccgttaaaaacgttacggaacccctaacggtacccgttagggaacggtaaccggacccggggaaggtaacccggttacgggggttttaattttaaccgttacggttacggggttaaggggtaaaacgttaaacgtttccccgttaagggtaccggtccttaaaccgttccgttaacccggtttaggtttacgttcgggttacccggtacccgggtttcccggggaccgtaacgggggtaacccgttcggtacccgttacccggttccgtttacccccggg

SEQ ID NO: 12240 - DNA, 583 bp, Homo sapiens
  misc_feature: GYAE6OF01D32MC.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangcccaccctctcctgcagggccagtcagagtgttcgctacttcggttagggtgtatcaacataaatccggccaggctcccaggctcctcatctttgatgctttcaacgacgggcccctggccgtcccaggcctaggttcagtggcaggtggtctgggacagcttcactctcaccatcagcagcctagacgcctagaatatttgctagttttattacttgtacagtcagtcgtcgtcctacgtttcgggcggtaggtcgaccgtacgtttccgggacgggtaacgggaacccgtaaaagtacggaacggtaccgaaaacgtaacgtggtacggacgtcgaccaaccgtacgttctacggttaccttctacttcccgtaccccg

SEQ ID NO: 12241 - DNA, 602 bp, Homo sapiens
  misc_feature: GYAE6OF01EWCT5.10.71.G05.1.454.CMB.1.raw
  modified_base (339)..(339): a, c, t, g, unknown or other
  misc_feature (339)..(339): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggccgtggggggtccctgagactctcctgttctgcgtctggattcatctttagtaaatctggcatgtccgtgggtccgccaggttccaggccacgggctggaagtgggtggcagatatacaatatgatgacaagtaaaatatactanaggacgactccttacgaagggccgaattcacctatcctaccagacgaacaacttaccaaagaacatggtatatctagactaaatcgacacgtcctaggagacgccgaggacgtacggggttatttaagttacgtggtagggtaagtaagtaccgtaggtggacacgtactaacccgttggttatttggttcggtaccggtttcccgggggacccgtaacgggggtacccggttagggttccctaacccggtcgtttaccccgg

SEQ ID NO: 12242 - DNA, 602 bp, Homo sapiens
  misc_feature: GYAE6OF01BO7FI.10.71.G05.1.454.CMB.1.raw
  modified_base (271)..(271): a, c, t, g, unknown or other
  misc_feature (271)..(271): n is a, c, g, or t
  modified_base (320)..(320): a, c, t, g, unknown or other
  misc_feature (320)..(320): n is a, c, g, or t
  modified_base (414)..(414): a, c, t, g, unknown or other
  misc_feature (414)..(414): n is a, c, g, or t
  modified_base (425)..(425): a, c, t, g, unknown or other
  misc_feature (425)..(425): n is a, c, g, or t
  modified_base (522)..(522): a, c, t, g, unknown or other
  misc_feature (522)..(522): n is a, c, g, or t
tcagcatagtagtgcacgaccggtgctcgatttagtgtcgtcgcaagagagagggggcctccattcggtgatcagcactgaacacagaggactcaccatggagtttgggctgagcgtggtttcctcgttagctctttaagagatgtccagtgtcagatgcagatggtggagtcgtgggggaggcggtggtccggccgtggggggtccctggagctctcctgttctgcgtctggattcattctttagtaaatctggcatcgtccgtggtccnccgtaggttccaggccacggggctaggtaagtggggtgcagtatataanatatgatcgaataagtaaaatatactagtacggagtaacctctacgaacgggcctattcaccatcctacgaagtacaactacttaccaagaacngttggattaancctagacaaagtccgacagaccctaggaacgacggacggacggtaacgtacgggtttaatttaagtacggttagggtagggaaataactacgtaagnggacctagtacctacgtggttatggtaccggacggttaccgggcgtaacgggaccgttcggactacccgttcgttcccgg

SEQ ID NO: 12243 - DNA, 560 bp, Homo sapiens
  misc_feature: GYAE6OF01DE7NH.10.71.G05.1.454.CMB.1.raw
  modified_base (203)..(203): a, c, t, g, unknown or other
  misc_feature (203)..(203): n is a, c, g, or t
  modified_base (552)..(552): a, c, t, g, unknown or other
  misc_feature (552)..(552): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctccagacaccaccggagaaattgtgttgacacagtctccagccacgctgtctttgtctccgaggggaaancgccaccctctcctgcagggccagtcagagtgttcgctacttcggttaggggtgtatcaacaataaactccggccaggcctccaggctcctcattctttgattgctttcaacgacgggccctggccgtccgaggctagtcagtgcagtggtctgggacagacttcactctcacctatcagcagctagagctagaagtatttgacttagtttattacgtcgtcagcagtcgtcgaccgtacgtttcgcggtaggtcgtccgtacgtttcggacgggtaggaacctaaaagtcgaaggtaacaaacggtaactaggtcggtctacgacaaccgtacttacgtagttccttntcttcccg

SEQ ID NO: 12244 - DNA, 747 bp, Homo sapiens
  misc_feature: GYAE6OF01DNTB9.10.71.G05.1.454.CMB.1.raw
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccgaggggaagcgccctaccctctccgtgcgacgggccagtcaggtagtcggttcgctacgtttcggttagggtagtacgtacaaactaagttaaacgtccggacctacggccctacccgaggcctcctctattcgtttgattcgtccttttaccgaaccgtacggtcccctgggcccgtcccgaggtaccgtaggttacgaggtcggcgtacgggtggtccgtagggacctaggtaccttaccgaccgttcctacccaccgtatccgtaacgacgaccggccgtaaggacccgtacgttaggtaagtttagttttcgtaacgtttagttttaacgttacgttacgtacgtagtccgtaggtccggttacgtacccgttacggtttccgggaccggttaggtccggttacccgttaacgggtttaccggggacgggtaaacgggaaaccgttaaaacggttagggaaaccggtaaacgtaaaccggtaacggttacggtccggtaaccgttaccggaaccgttaccgttacgttccgtttaccg

SEQ ID NO: 12245 - DNA, 807 bp, Homo sapiens
  misc_feature: GYAE6OF01DF8WG.10.71.G05.1.454.CMB.1.raw
  modified_base (223)..(223): a, c, t, g, unknown or other
  misc_feature (223)..(223): n is a, c, g, or t
  modified_base (238)..(238): a, c, t, g, unknown or other
  misc_feature (238)..(238): n is a, c, g, or t
tcagcatagtagtgcacgaccggtgctcgatttagtgtcgtcgcaagagagagggggagagcccgtggggaggaactgctcagttaggacccagagggaaccatggaacgccccagctcagcttctcttcctcctgctactctgcctcccagaccaccaccggagaaattgtgttgacacacgtcctccagccacggtcttgtctttgctaccgaggggaaancgcccaccgtctccnggcacgggacctagtcagtagttgtccgcgtacgttcggttagggtgtaactacaaactaagtaaacgtcccggaccacggtcctacccgaggtcccttcccttactactttcgtttagactttcgttccttttaacgaaaccggtcccgggtcccctgggtaccccggttacccggaacggtccggtaacggggtttaccgacggggtcggtacggtaagggttccggggttcgtacggggaacctacggttaacctttcccgaaccttcctacccgaacccttacgtaccgtaacggaccgtaacggtacccgttaaaggacccggttaaccttaaagggtaaacgttttagtttacgtaacgtttaaacggttttacttttaacgcggtttaacgacggtaccgtaacgttcggtaccgtacccggttacggtttcggggaccgttagggttccgtacccgttacgggttacgggaaccgggtaaacggaaacctaaagggtaccgaagggtaaccgaaacgtacggtggttacggccttacggaaccctgtaccgttgttacccg

SEQ ID NO: 12246 - DNA, 616 bp, Homo sapiens
  misc_feature: GYAE6OF01B8D07.10.71.G05.1.454.CMB.1.raw
  modified_base (157)..(157): a, c, t, g, unknown or other
  misc_feature (157)..(157): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
  modified_base (470)..(470): a, c, t, g, unknown or other
  misc_feature (470)..(470): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcgtggtttcncgttagctctttaagagatgtccagtgtcagatgcagatggtggagtcgtggggggagcgtggtccggcgtggggggtccctgagtctctcctgttctgcgtctggattcattctttagtaaattcgtggctatcggtccgtcggggtccctccgtaggttcccagggccctacggtggtcgtaggtaggtgggngacagtatataacaagtagtagntaacgaataagtaaatatatagtaggaactacttccgtacgaacggtactactacactactccanagacatactaacgaaanactgtagtacgtntcgacaacgtagacgtacccagtaccaggtagacccgaacggaacggtaccgaccgggttaacttacgttaatacgtcggtacgtaaccgtaaacctaaccggtttacccggtccgttaacggtttacgtttaaccgttaacccgg

SEQ ID NO: 12247 - DNA, 679 bp, Homo sapiens
  misc_feature: GYAE6OF01C1EZ9.10.71.G05.1.454.CMB.1.raw
  modified_base (221)..(221): a, c, t, g, unknown or other
  misc_feature (221)..(221): n is a, c, g, or t
tcagcatagtagtgcacgaccggtgctcgatttagtgtcgtcgcaagagagagggggagagcccgtggggaggaactgctcagttaggacccagagggaaccatggaacgccccagctcagcttctcttcctcctgctactctcggcctcccagacaccaccggagaaattgtgttagacacagtcctccagccacgctgttctttgtctacgaggggaanacgcccacctctcctgcgacgggccagtcagtagtcgttcgctacgttcggttagggtcgtatcaaactaataaactccggacaggcctaccgagtcctcctcattctttgattcgtactttacaacgtcgggcccctggccgtaccgaggctacggtgaggtcggactggtggtctaggggactggtacctcgctcctacgacctactacgacgacgacgccgtaagaccgtcgtagtaagttagtttcgtaacgttaacggttttaactaccgttgttaacgacgtaccgtagtccgtacggtacccgtacgggtttccgggaccgggtttaacgggtccgtacccggttaccgggttcggggaacggtaaaccgggtaaactaaaaggtacggaacgggtaaacgaaacggtacggttggtacggtaccgtcgtaacccgtactgttcccgttag

SEQ ID NO: 12248 - DNA, 534 bp, Homo sapiens
  misc_feature: GYAE6OF01CV7EB.10.71.G05.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (288)..(288): a, c, t, g, unknown or other
  misc_feature (288)..(288): n is a, c, g, or t
  modified_base (525)..(525): a, c, t, g, unknown or other
  misc_feature (525)..(525): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctntcctgcagggccagtcagagtgttcgctactttcgttagggtgtatcaacataaatccggccaggctcccaggctcctnatctttgatgtctttcaacgacggcccctggcgtcccaggcaggttcagtgcaggtggtctgggacagtacttcgactctcaccatcagcagcctagacgcctagaagtatttgactagttttatactgtacagtcagtcgtgcctacgtttcggcggtaggtcgcctacgtttcggacggtaacgggaccaaagtggagtaccaaagacgtggagctgaccactatctagtctctntccgtcccg

SEQ ID NO: 12249 - DNA, 551 bp, Homo sapiens
  misc_feature: GYAE6OF01D8ZVM.10.71.G05.1.454.CMB.1.raw
  modified_base (214)..(214): a, c, t, g, unknown or other
  misc_feature (214)..(214): n is a, c, g, or t
  modified_base (315)..(315): a, c, t, g, unknown or other
  misc_feature (315)..(315): n is a, c, g, or t
  modified_base (545)..(545): a, c, t, g, unknown or other
  misc_feature (545)..(545): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggcaggctccagctctcatcttgatgctttcaacncggcccctggcctccagcaggtcagtggcaggtcggtcgtgggacagtactcacgtctacaccatcagcagcctagacgtctaggtaacgtattttcgacttagttttaacttacgtgttacagtcaaggtcgtgccctacgtttcgggacgggtagtcgcctacgttcgggaccggtagggaacctaaaagtcggaggtacaaacggacttggcggtctcgacaccgtntcgtcg

SEQ ID NO: 12250 - DNA, 619 bp, Homo sapiens
  misc_feature: GYAE6OF01BQA5B.10.71.G05.1.454.CMB.1.raw
  modified_base (270)..(270): a, c, t, g, unknown or other
  misc_feature (270)..(270): n is a, c, g, or t
tcagcatagtagtgcacgaccggtgctcgatttagtgtcgtcgcaagagagaggggggcctccattcggtgatcggcactgaacacagaggactcaccatggagtttgggctgagctgggttttcctcgttgctcttttaagagatgtccagtgtcagatgcagatggtggagtctggggggaggcgtggtccggcctggggggtccctgagactctcctgttctgcgtctggattcattctttagtaaatctggcatgtcctgggtccnccaggttccaggccacgggctggaatgggtggcagatatacaatatgatgacaagtaaaatatactatggacactccttagaaggcctattcacatctccagagacaattaccaagaacagtggtagtatctagacaaatcgaaccagtcctagacggacgccggaaggaccgtacggggttagttttaagttaccgtagggtacggggaagtaaacgtccgtaaggtcggactaacgttccgtaacccgttaggtagtttaggtcggttacccggttccccgggggaccgtaacgggggtaacccggttgggtacccgtacccggttccgttcccggtttaccccggg

SEQ ID NO: 12251 - DNA, 586 bp, Homo sapiens
  misc_feature: GYAE6OF01EUUF5.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttagggtgtatcaacataaatccggcaggctccaggctcctcatctttgatgctttcaacgacgggccctggccgtccaggcaggttcaggtgcaggtgggtctgggacagtacttcactctacacatcagcagcctagacgcctagtaagtatttgactagtttatactgtacagcagtcgtcgcctacgtttcggacggtacggtcgtccgtacgtttcgggacgggtacgggtaacctaaaaggtacggtaacggtaaccgtaaaacggtaacgttaggtacgggtcgtacggacctaaccgtacttcgttacgttccttccgtacgtttccccg

SEQ ID NO: 12252 - DNA, 572 bp, Homo sapiens
  misc_feature: GYAE6OF01BP681.10.71.G05.1.454.CMB.1.raw
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (253)..(253): a, c, t, g, unknown or other
  misc_feature (253)..(253): n is a, c, g, or t
  modified_base (549)..(549): a, c, t, g, unknown or other
  misc_feature (549)..(549): n is a, c, g, or t
tcagcatagtagtgcacgaccggtgctcgatttagtgtcgtcgcaagagagagggggggaactgctcagttaggacccagagggaaccagtggaagccccagctcagcttctcttcctcctgctactctggctcccagacaccaccggagaaattgtgttgacacagtctccagccacgctgtctttgctccgagggaangccaccctntcctgcagggccagtcagagtgttcgctacgttcggttaggggngtatcaacataaatccggcaggctccaggctcctcatcttgatgctttcaacgacgggcccctggccgtcccaggctaggttcagtcggctaggtcggtctgggactagacttcactctcaccatcagcacgcctagacgtaccgtagtaacgtattttcgacttagtttattacgttgtacctagtcgagtccgtacgcctacgttcgggacggtaacggttcgccctacggtttccggacggtaacgggaaccaaagtaggacgtacgaaaacgtctaggtcgactgacctacntctcgtcttctcgtccctacccg

SEQ ID NO: 12253 - DNA, 555 bp, Homo sapiens
  misc_feature: GYAE6OF01EPE7I.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcggttagggtgtatcaacataaatccggcaggctccaggctcctcatctttgatgctttcaacacgggcccctggccgtccaggctaggttcagtggcagtggctgggacagacttcactctcaccatcagcacgcctagacgcctagaagtattttgactagtttatactgtacagcagcgtgcctacgtttcggcggagtcgccgtacgtttcgggacggagggaaccaaagtaggtaacggtacgaaaaccgtacgtcggtaggactcggaccaccacttcgtcgttactttactacttcccgttaccccg

SEQ ID NO: 12254 - DNA, 564 bp, Homo sapiens
  misc_feature: GYAE6OF01D3KJM.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacttcggttaggggtgtatcaacataaatccggccaggctcccaggctcctcattctttgatgtctttcaacgtacgggcccctggccgtcccgaggcaggttcgagtggcgtaggtgggtcgtgggacaggacttcgactctcacatcagcagctagcgcctgaagtatttgactagtttattactgtcagcagtcgtgtctacgttcggacggtaggtcgtccgtacgtttcgggcgggaacgggtaacctaaagtaggacggtacgaaacggtaacgtggtcggtctacgacacctattactgtcttcgtacttccccg

SEQ ID NO: 12255 - DNA, 571 bp, Homo sapiens
  misc_feature: GYAE6OF01EQN53.10.71.G05.1.454.CMB.1.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
  modified_base (442)..(442): a, c, t, g, unknown or other
  misc_feature (442)..(442): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccagctgtctttgtctccaggggaaangccaccctntcctgcagggccagtcagagtgttcgctacttcgtagggtggtatcaacataaatccggccaggctcccaggctcctcattctttgattgctttcaactagggcccctggcgtcccaggtcaggttcagtggcagtgggtctgggacagacttcactctcaccatcacgcagcctagacgccgtgagtactttagctagtttatactgtcagcagcgtanccgtacgtttcggcggtagtcgtacccgtacgttcgggacggaacgggtaaccaaaaggtacggaagggtaccgaaaaccggtacgtaggttacgggaccttacggacctaacccgtagttccgttacg

SEQ ID NO: 12256 - DNA, 540 bp, Homo sapiens
  misc_feature: GYAE6OF01BYBGQ.10.71.G05.1.454.CMB.1.raw
  modified_base (201)..(201): a, c, t, g, unknown or other
  misc_feature (201)..(201): n is a, c, g, or t
  modified_base (311)..(311): a, c, t, g, unknown or other
  misc_feature (311)..(311): n is a, c, g, or t
  modified_base (359)..(359): a, c, t, g, unknown or other
  misc_feature (359)..(359): n is a, c, g, or t
  modified_base (370)..(370): a, c, t, g, unknown or other
  misc_feature (370)..(370): n is a, c, g, or t
  modified_base (533)..(533): a, c, t, g, unknown or other
  misc_feature (533)..(533): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctccctgcagggccagtcagagtgttcgcacttcggttagggtggtatcaacataaatccggccaggcctcccaggcctcctcatctttgatgctttcaacncgggccctggccgtcccaggcaggttcagtggctagtggtctgggacngacttcactcncaccatcacgcagccctagacgcctagaacgtattttcgatagtttaacttacgtgtcagcagtccgtgcctacgtttcggcggtaggtcgccgtacgtttcgggcggacgggaacctaaagtggaagtacaaacgtacgtggtggctgcacatctgtcttcntctcccg

SEQ ID NO: 12257 - DNA, 756 bp, Homo sapiens
  misc_feature: GYAE6OF01BJ2C8.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctctttaagagatgtccagtgtcagatgcagatggtggagtcgtgggggaggcgtggtccggccgtgggggtccctgacgactctctgttctgcgtctggattcatctttagtaaatctggctatcgtccgtgggtccgccgaggttccaggccgaacggggctagggaagttggggtaggacaggaataactaacgaaatatagaatagaaactaagttaaaaatattaactagtaggaacgtaaccgttacccttacgaaacggggacccgtaatttccaaccctatacctaccgaagaacgtaactaaacttaccgaaacgtaaactaagttagggttacgttaactactagaacctaaaacgttcgaacctaacggtaccgtaggaacgtaacggaccggtaaacgggaaccggttaacggggtttacgttttaaacggttaccgttaggggttaacggggtaaacgtaaaccgttacccggtaaggttacgggacttaacgtacccgtaacccggttaggtttaacgttacgggtacggttacccgggttacccgggggacccggtaaacgggggtaacccggttagggtccccgtaacccgggttccgttaccccggg

SEQ ID NO: 12258 - DNA, 589 bp, Homo sapiens
  misc_feature: GYAE6OF01B9V3L.10.71.G05.1.454.CMB.1.raw
  modified_base (214)..(214): a, c, t, g, unknown or other
  misc_feature (214)..(214): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccgaggggaanacgccaccctctcctgcagggccagtcagagtgttcgctacttcggttagggtggttatcaaacgataaactccggaccaaggcctccccaggcctcctctatcctttgattgtctttacaacgacgggtcccctggccgtcccaggctaggttcaggtgcaggtgggtctgggacagtacttcactcctacacctatcagcacgcctagacgtcctggtaagtacgttttagccttagtttattacgtgttacagcagtcgtacgtcctacgtttcggacgtggtcgccgtacggtttcggacgggtacggaacccgaaaagttcggaaggtaactaaaccggaagtcggtaggtctacgacacgtatgttacg

SEQ ID NO: 12259 - DNA, 667 bp, Homo sapiens
  misc_feature: GYAE6OF01B9XRM.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtcttgtctcgagggaanacgccacctctcctgcagggccagtcagagtgttcgctacgttcggttagggtggtatcaactataaacgtccggaccaggtcctccaggtctcctcattctttgactcgtactttcaacgtacgggccccttgggcccgtcccgaggtccgtacggttccgaggtcggccgtaggtcgggtcgtaggggacacgtacttccgacttctcaaccgtatacgagaccacgtacctaagacgtaccgtagtaacgttagttttacgacttaagttttattaacgtcgtacacgtacgacgtcgttcgtacccgttacggtttccgggacggtaacggttccggtacccgttacggtttacgggaccgggtaacgggaaacctaaaggtacggaacggtaccgaaacggtacgtaggtacggcgtacgaccctacgtacgttacgttacgttcttccgtacgtttccccg

SEQ ID NO: 12260 - DNA, 624 bp, Homo sapiens
  misc_feature: GYAE6OF01A4Z4U.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacttcggttagggtgtatcaacataaacgtccggccaggcctcccaggcctcctcattctttgatgtctttacaacgcggcccctggccgtcccgaggctaggttcaggtggcaggtggtcgtgggacagacttcactctcacctatcagcacgcctagacgtcctagaagttattttgacttaagttttaatacgttgtactacgacgacgtcgtcgtacccgtacggtttcgggacggtacggttcgtacccgttacggtttcggggaccgggtaacgggaaaccctaaaaggtacgtaacggtaaccgaaaacggaaccgttggtacggtcctacggacctaacctacgttccgtacgttcctttactacgtttccccg

SEQ ID NO: 12261 - DNA, 787 bp, Homo sapiens
  misc_feature: GYAE6OF01C95DG.10.71.G05.1.454.CMB.1.raw
  modified_base (213)..(213): a, c, t, g, unknown or other
  misc_feature (213)..(213): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaancgccaccctctcctgcagggccagtcagagtgtcgctacgttcggttagggtgtatacaactaataaacgtccggcacggcctcccaggtcctacctctattcgtttgattcgtcctttacaaccgaccgggtcccctagggccgtacccgaggtctacggtttcagggtcggacgtagggttcggggttacgtggggaacctacggtaccgtttaccaacgtttccgttacccgaacccgtaacttaccgaacggtacccgtaacggtaccccgtaaagggtaaccggtccccgttaagggtaaaacgtttacgttttttacggaaccgttttaacggttttttaaacttacggtttaccgttaccgtaacgtccgtaacggttccggttaccggtaccccgttaaccgggttttccggggacgggttacgggttccgtcccgttacgggttttacccggggaccgggtaaacggggaaaccctaaaaggttacgggtaacggttaaccggaaaaaccggtaacggttgggtacgggtaccgtaacggtaccgtaaccctagttccgttacgg

SEQ ID NO: 12262 - DNA, 712 bp, Homo sapiens
  misc_feature: GYAE6OF01C47GX.10.71.G05.1.454.CMB.1.raw
  modified_base (210)..(210): a, c, t, g, unknown or other
  misc_feature (210)..(210): n is a, c, g, or t
  modified_base (489)..(489): a, c, t, g, unknown or other
  misc_feature (489)..(489): n is a, c, g, or t
tcagcatagtagtgcacgaccggtgctcgatttagtgtcgtcgcaagagagagggggaggaactgctcagttaggacccagagggaaccatggaacgccccagctcagcttctcttcctcctgctactctggcctccagacaccaccggagtaaattgtgttgacacagtctccacgccacgcttgttctttgtctaccgaaggggaaanacgtcccaccctctccgtgcgacgggccagtcaggtagtcgtcgactacgtttcggttagggttgtactacgaactaataacgtccggaccgacggacctcccgagtcctcctcacttcttagacttcgtacctttacgaacccggacggtcccctggtaccgtccgagcgtacggtcaggtggacgtaggtcggtacgtacgggactacgtaccttcaccttcacctactacgtccgagtaccgactacgtacggacgttaccggtaataacggtttnttttacgtaacgtttaagtttttaactacgttacgtacgtagtaccgtacggtacgttccggttaccgttacgggtttccgggtaccggggtacgtcccggttaccgtacggggttacggaacgggaaccgggtaaaaccgtaagtaaccggtaacggtaaccgaacgtacgtggtacgtacgcgtacctacgtacttactcggtttactcgtcccgtacccg

SEQ ID NO: 12263 - DNA, 790 bp, Homo sapiens
  misc_feature: GYAE6OF01CYJFZ.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagaccaccaccggagaaattgtgttgacacagtctccagccacgctgtctttgctccgaggggaanacgccaccctctcctgcagggccagtcagagtcgttcgctacgttcggttaggggtcgtaactacaaacgtaacttaaaacgttccccgggaccgaacgggtcccgttaccccgaacgggtcccttaccccttacgtaactttccgttttaggtaacttcggttaccttttacccgaaaccggtaccggggtccccccgttaggggtcccgttaccccggagggtaccgtaacgggtttccaagggtcggcgtaaggggtcgggtcgtaggggtaacaacggtacctttacacgttcctaccaccgtatccgaagccacggtccttaaggacgtcccttaggaagttacgttttgactttaagtttacttacgttcgtacagtcgacggtccgttacgtacccgttaacggtttccgggacgggttacgggtccgttaccgttaccggtttacggggaaccgggttaacggaacctaaaaagggttacggtaaacggtaacgtaaaaccggtacgttgggtacggtacctcggaaccctaccgtacgttccttaggttaccctttacgaccgtttcccggttacccccg

SEQ ID NO: 12264 - DNA, 576 bp, Homo sapiens
  misc_feature: GYAE6OF01EVXI5.10.71.G05.1.454.CMB.1.raw
  modified_base (204)..(204): a, c, t, g, unknown or other
  misc_feature (204)..(204): n is a, c, g, or t
  modified_base (383)..(383): a, c, t, g, unknown or other
  misc_feature (383)..(383): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgcagggccagtcagagtgttcgcacttcgttaggggtgtatcaacataaatccggcaggctccaggctcctcattctttgatgtcctttcaacacgggcccctggccgtccgaggctaggttcagtggcagtgggtctgggacagacttcactcgtcaccatcancagctagagcctagaatatttgactagtttatactgtcagctagtcgtgccgtacgttcgggacggtacggtcgccttacgtttcgggacgggaacgggtaaccgaaaagtacggtaacggtaacgtaaaacggtaacgtggtacggtcgtacggaccaaccgtacttcgttacgttcttcgtcgttaccccg

SEQ ID NO: 12265 - DNA, 823 bp, Homo sapiens
  misc_feature: GYAE6OF01DM7D3.10.71.G05.1.454.CMB.1.raw
  modified_base (201)..(201): a, c, t, g, unknown or other
  misc_feature (201)..(201): n is a, c, g, or t
  modified_base (229)..(229): a, c, t, g, unknown or other
  misc_feature (229)..(229): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagaccaccaccggagaaattgtgttgacacagtctccagccacgctgtctttgctcgaggggaaangccaccctctcctgcagggccagtcagngtgttcgctacgtttggtagggtgtatcaacataatccggacaggcctccaggcctcctctattctttgattgtctttcaacgacgggcccctggcctcccgaggctaggttcaggtcggctaggtcgggtctggggaacctaggtacctttacgaccttctaccaaccctatacgacgcctaacggtacccttaacggtaccgtaccggttaaggttaaacggtttaacgttttttacggtaaccgtttaaacggttttttaacgtttaacccgttcgggtttaaccgtaacggtacccgttacgggtacccggtttaccgtaccccggtttaaccggtttttaccgggggccggggttaacgggttcccggttaccccgtttaacccggggttttaccgggggaaccgggggttaaaccggggtaaacccgtaaaaaaacgggttacggggtaaacccgggttaaaacccgtaaaaaccgggttaaaccggttaggggttaccgggtaccgtttaccgggaacccgtaacccgtttacgttacgtttaccgttaccctttaccgtaaacctttcccccgtttaaacccccgg

SEQ ID NO: 12266 - DNA, 621 bp, Homo sapiens
  misc_feature: GYAE6OF01CTN7D.10.71.G05.1.454.CMB.1.raw
  modified_base (202)..(202): a, c, t, g, unknown or other
  misc_feature (202)..(202): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacgtttcggtagggtggtatcaacataaactccggccaggcctcccaggcctcctcattctttgatgtctttcaacgacgggcccctggccgtcccaggctaggttcaggtggcgaggtgggtctggggactagtaccttcgactctcacctatcganccgagcctaggacgtccgtagtaacgttagttttcgacttacgttttaattacgttgtcacgtcagtcgtcgtccgtacgtttcgggcggtacggtcgtaccgtcggtttccgggacgggtacgggtaaccgtaaagtagtaacggtaaccaaacggaacgttgggtacggtaccgtcggaccacctcgttacgttcgttctttcctcgttcccgttaccccgg

SEQ ID NO: 12267 - DNA, 640 bp, Homo sapiens
  misc_feature: GYAE6OF01E1OBA.10.71.G05.1.454.CMB.1.raw
  modified_base (203)..(203): a, c, t, g, unknown or other
  misc_feature (203)..(203): n is a, c, g, or t
  modified_base (441)..(441): a, c, t, g, unknown or other
  misc_feature (441)..(441): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagaccaccaccggagaaattgtgttgacacagtctccagccacgctgtctttgtctccgaggggaaancgcccaccctctcctgcgagggccagtcagtagtgttcgctacgttcggttagggtgtatcaacaataaacgtccggccaggcctccccgaggcctcctcattcctttgattgtccttttcgaaccgacgggtcccctgggccgtcccgaggccgtaggttcgagtggcgaggtcgggtcgtgggacagtactttcactctacaccactcagcacgcctagacgccgttagaacgttntttacgacttagtttatacctgtctacgcgtacgtcgtcgtccctacggtttcgggcggacggtccgaccgttaccggttcggggacgggtaaccggaacctaaaaggtacggacggtaccgaaaacggtacgtcgggtacgtcgtcggacctacgtacgttccgttacgttacctttccgtacttcccgttacccccg

SEQ ID NO: 12268 - DNA, 632 bp, Homo sapiens
  misc_feature: GYAE6OF01B5XDV.10.71.G05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagattccaccggagaagttgtgttgacacagtctccagccaccctgtctttgctccgagggaancgccacctctcctgcaggccagtcagagtcgtaggagctctagcctggtactacaacagaaccgtgaccacggcctacccgagcctcctcatctatgatgctactacccaaggaccggccacgtcggctactccccgagcctaggttcaggtcggactagggttgggtctaggggaactacggtacctttcacgttcctaccaccgtatccgaacgtacgacgaacgtaggacgtacccgtaagtaacggtttatttcggactttaagttttacttacgttgacctagcgtaagtcgaacgtacgtaaccgtcgggtacccgtacgggttaccggtacggaccggaacgggaccgtaaaggttcgaaccgtaagtacgaacggtaccgtacgtcggttcgaccgtcgacctaccgtgttcccgttgttacccg

SEQ ID NO: 12269 - DNA, 660 bp, Homo sapiens
  misc_feature: GYAE6OF01CYLWW.10.71.G05.1.454.CMB.1.raw
  modified_base (209)..(209): a, c, t, g, unknown or other
  misc_feature (209)..(209): n is a, c, g, or t
  modified_base (407)..(407): a, c, t, g, unknown or other
  misc_feature (407)..(407): n is a, c, g, or t
  modified_base (504)..(504): a, c, t, g, unknown or other
  misc_feature (504)..(504): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctgctccagacaccacggagaaattgtgttgacacagtctccagccacgctgtctttgctcgagggaacncgccacctctcctgcgacgggccaggtcagtagtcgttcgactaacgttcgttagggtggtactacgaaactaagtaaacgtccggccaggtcctcccgaggccttcctctacttcttttgacttcgtacctttacgaaccgtaccgggtccctgggtccgtcccgaggtctaggttcaggtcggcgtaggtcgggtntcgggactagtactcgactctaccgtacatcagctacgccgtaagacggtctaggtaatttgtttacgacttaagttttacgtacgtaggttacganccgtaggtccgtacgtccgtaccggtttcggacggtcggttcgtacccgtaggtttccgggaacgggtaacgggtaactaaaacggttgggtaacggttaaaccgaaacggttacggtacggtacggtaccgtacgacctaacctgtccgtttacg

SEQ ID NO: 12270 - DNA, 653 bp, Homo sapiens
  misc_feature: GYAE6OF01B0TFJ.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagatgggtggagtcgtgggggagcggtcggtccggcgtgggggtccctgagactctctgttctgtcgtctggattctattcgtttaagtaaatcgtggctagtcgtccgtgggtcccgtcgtacggttccagggccacgggtctaggaagtggggtgacagatatactagtatgatagaactaaagtaaaatagtaactagtaggaactacgtacgttacgaacgggtcctacttaccacctactaccctacgaacgtaactaacgtaactaccgtaaagaactaggttacggtatttaactcgtaaacgacgtaaaagtccgaaccgtaccggtacgtacgaacgggtacgaacccgggtagggaaccgttacgggtttacgtttaacgttacgggttaggtagggtaaacgtaacgttacccgaggttcgactaagtcgttaacgtggtttaacg

SEQ ID NO: 12271 - DNA, 622 bp, Homo sapiens
  misc_feature: GYAE6OF01DFOI5.10.71.G05.1.454.CMB.1.raw
  modified_base (202)..(202): a, c, t, g, unknown or other
  misc_feature (202)..(202): n is a, c, g, or t
  modified_base (361)..(361): a, c, t, g, unknown or other
  misc_feature (361)..(361): n is a, c, g, or t
  modified_base (602)..(602): a, c, t, g, unknown or other
  misc_feature (602)..(602): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgctacgtttcggtaggggtgtatacaaacataaactccggccaggcctacccaggctcctcattcttgatcgtcttcaacgcgggccctggccgtccgaggcaggttcagtggcaggtggtcgngggacagtcttcactcacactatcagcagcctagcgtcgtagtaagtattttgagttatttatactgtacagcagtcgtcgaccgttacgtttcgggacgtaggttcgtacccgttacggtttccgggacgggtaacgggtaacctaaaaggttacgtaaacgggtaaccgtaaaacggtacggttcgggtaggtaccgtcggacccgtaacctacgtttccgttacgttaccgtttaacncccgttccccgttacccccg

SEQ ID NO: 12272 - DNA, 629 bp, Homo sapiens
  misc_feature: GYAE6OF01APMKJ.10.71.G05.1.454.CMB.1.raw
  modified_base (203)..(203): a, c, t, g, unknown or other
  misc_feature (203)..(203): n is a, c, g, or t
  modified_base (294)..(294): a, c, t, g, unknown or other
  misc_feature (294)..(294): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaaggggaaancgcccaccctctcctgcagggccagtcagtatgttcgctacgttcggttagggtgtatacaacataaatccggccaggctcccagctcctnatcttgatgctttcacacggcccctggcctccgacggcgaggttcagtcggctaggtggtcgtcgggacaggtaccttcacctctaccacctatccgacgtcgacgtaccgtagacgtccctaggtaacgttagttttcgacttaacggttttattaacgttcgttacgagtacccgaggttcccgtggtaccctggttttaccggcggtacggtcctaccgttacggtttccgggagtaaccgggaacctaaagtacgggtaggtaaccaaacggtacgttgggagtccgtacgaccgtacctagtcttacgtaccttctcgttcccgtacccg

SEQ ID NO: 12273 - DNA, 840 bp, Homo sapiens
  misc_feature: GYAE6OF01DWE7P.10.71.G05.1.454.CMB.1.raw
  modified_base (210)..(210): a, c, t, g, unknown or other
  misc_feature (210)..(210): n is a, c, g, or t
tcagcatagtagtgcacgaccggtgctcgatttagtgtcgtcgcaagagagagggggagagccctggggaggaactgctcagttaggacccagagggaaccatggaacgccccagctcagcttctcttcctcctgctactctggctccagacaccacggagaaattgtgttgacacagtctcagccacgctgtctttgctcgaagggaancgccacctctcctgcacgggccagtcgagtagttcgtcgctacgtttcggttagggtgtatacgaaactaagttaaaacgtccggaccgtaacggtccctaccccgaaggtccttaccccttactaacgtttcttttacgaacgtttcgtaccttttaccgaaaaccggtccggggtacccccttaggggtcccgttaaccccgggtaagggtaccgttaagggggtttaccgaagggttcggggaccgttaacggggtttcgggtaccgtacgggggaacctaacgggtttaaccctttaccgaaccttccgtaaccgaacccgtaagttaccgaacgtccgtaaccgtacgttaacggacgtaccgttaagtaacggttaactttttacggacttttaaggttttaactttacgttcggttacaacgtcgttaacggcgttacgtacccggtttacggtttaccgggacgggtacgggttacgacccggtttaaggttacccgggaggggtaaaccgggtaaactaaaaacggttaacggaacccgggttaaacgaaaaaccgggttacggttagggaacgggttaccgacggtaacccgtaaccgtttaaggttcccgtttaaacgg

SEQ ID NO: 12274 - DNA, 659 bp, Homo sapiens
  misc_feature: GYAE6OF01DT8IE.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgttctttgtctaccgaggggaaagacgcccaccctctcctgcagggccagtcagtagtgttcgctacgttcggttagggtgtatacaactataaacgtccggacaggcctaccgaggtcctcctcatctagtcggtacagtctaggcgacgggccacgtcggacactcccgagtacgtaggttcaggtggactagggtcgggtcgtagggacacggtaccttcgtacctcgtaccaaccgtactcacgacgtaaggacgtagggacgttacgtaggtaagttagtttaggacgttaggtttagttactttagttcgtacgtagtacttaagttggttaacgggtacggttaccgtaccggttacgggtttaccggttttacgggaccggtaacggggaacctagggtacggtagggaacgtacgtaacgaaacgtcgttacggtacgacgtcgtaccgtactacgttcgtcgttccg

SEQ ID NO: 12275 - DNA, 613 bp, Homo sapiens
  misc_feature: GYAE6OF01BFFSA.10.71.G05.1.454.CMB.1.raw
  modified_base (203)..(203): a, c, t, g, unknown or other
  misc_feature (203)..(203): n is a, c, g, or t
  modified_base (378)..(378): a, c, t, g, unknown or other
  misc_feature (378)..(378): n is a, c, g, or t
  modified_base (419)..(419): a, c, t, g, unknown or other
  misc_feature (419)..(419): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagcccaccctctcctgcagggccagtcagagtgttcgctacgttcggttaggggtgtactcgaaacattaaaagtccggccagggccttcccaggcctcctcattctttgacttgctttcaacgtcgggcccctggccgtcccaggcaggttcagtggcagtgggtctcgggacngacttcactctccacatcagcagcctagacgcctagaagtntttgctagtttatacgtgtcgagtcagcgtgcccgttacgtttccggcggtacggtcgtacccgttacggttttcgggcgggtaacgggtaacccgtaaaaggttcggtaaacggtacgaaaaccggtacgttaggttacgggcctaggaccctaaccgtagttccgttagttccttaccgtacgtttcccccg

SEQ ID NO: 12276 - DNA, 605 bp, Homo sapiens
  misc_feature: GYAE6OF01AYKLQ.10.71.G05.1.454.CMB.1.raw
  modified_base (206)..(206): a, c, t, g, unknown or other
  misc_feature (206)..(206): n is a, c, g, or t
  modified_base (423)..(423): a, c, t, g, unknown or other
  misc_feature (423)..(423): n is a, c, g, or t
  modified_base (478)..(478): a, c, t, g, unknown or other
  misc_feature (478)..(478): n is a, c, g, or t
tcagcatagtagtgcacgaccggtgctcgatttagtgtcgtcgcaagagagaggggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacgtttcggttagggtgtatcaacataaatccggccaggcctcccgaggctaccgtcatctttgatgctttcaacgcgggcccctggccgtccacggctaggttcaggtggcgtaggtgggtctgggactagtacttcacgtcctacgaccatcacgcacgcctagacgtcctagaagtntttgcttaagtttattactgtactagacacgtcgttagacccttacggtttcggngggtacggttcgtaccgttacgtttcgggcggtaacggtaaccgaaaagtgaacggtacgaaaacggtcgtaggtacggccgtagaccgtaccgtaagttccttaggttccttcgtacgtttccccg

SEQ ID NO: 12277 - DNA, 764 bp, Homo sapiens
  misc_feature: GYAE6OF01CIYPP.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagtagtgttcgctacgttcggtagggtgtatcaacataaacgtcccggcaggtcctacccgaggtcccttcctctacttctttagacttcgttacctttaccgaaacccggccggggtcccccttagggccccgttaccccggaggggtccgtacggttccgacgggtcggaccgtagggttcggggtaccgtagggggaacctacgttccttaccaccttccgtaccaaccctagtccgaacggtccaaccgtaccgtaacggaccgtaccgttaaggtaaacgttttcgttttacggtacgtttaaggtttttaccttaccgttagttaccacggtaccgtaacggtccgttacggtacccgtttaacgggtttccgggacgggtacggtccgtaccggttacccggtttcggggaaccgggtaacggtaaaccgtaaaggtacggtaaccggtaacgtaaaccggtacgttagggtacgtccgtacgaccctaccgtacttcgttaccgttccttacgttcccgttccccg

SEQ ID NO: 12278 - DNA, 800 bp, Homo sapiens
  misc_feature: GYAE6OF01EC9H7.10.71.G05.1.454.CMB.1.raw
  modified_base (157)..(157): a, c, t, g, unknown or other
  misc_feature (157)..(157): n is a, c, g, or t
  modified_base (214)..(214): a, c, t, g, unknown or other
  misc_feature (214)..(214): n is a, c, g, or t
tcagcatagtagtgcacgaccggtgctcgatttagtgtcgtcgcaagagagagggggggggagaactgctcagttaggacccagagggaaccatggaacgccccagctcagcttctcttcctcctgctactctggcctcccagaccaccgaccgganaattgtgttgacacagtctccagccacgtctgttctttgtcctacgaaggggaaacncgccctaccctctccgtgacgagggccagtcagtacgttcgttcgcttacgtttcggttagggtgtactacaactaataacgtcccggacgacggccctaccgaggtccttcctactactttcgtttagacgttcgttacctttaaccgaaccggtaccgggtcccctgggcccgttacccgagggtcctacggttcgacggtcggcgtacgggttcggggtacgtacggggactacgttccttaccacttccgtacccacctagtaccgacgtccaaccggttccgtaacggaccgttaccgtaaggtaacgtttttacgttttacgaaccgttttaaggttttaacttttccggtacgttaccggtacggtacgtaccgggtccgtttacccggtacccgtttaccgggttcggggtaacggttccggttccggtacccgttttacgggttacccgggaaccgggtaacggtaaactaaaggttcccggaaacggtaaccggtaaaccggtggttacggtcggtacccgtagtaccccgtaacgttcgtaccgtttagtaccctttagtacccgtttacccccg

SEQ ID NO: 12279 - DNA, 706 bp, Homo sapiens
  misc_feature: GYAE6OF01AT6AS.10.71.G05.1.454.CMB.1.raw
  modified_base (388)..(388): a, c, t, g, unknown or other
  misc_feature (388)..(388): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgagggaaagagccacctctcctgcagggccagtcagagtgttcgcacgtttcggttaggggtggtatcaacataaacgtccggaccaggcctcccgaggcctcctcattctttgatgtctttcaacgcggccctggccgtcccaggcaggttcagtggcgtaggtgggtctgggacagtacttcactctcgacntacgacgcacgctagacgcctagtaacgtattttacgacttaaggttttacttacgttacgtacgtacgtacgtaacggtccggttacggtacccgtaacggttttccggggaccgggtacgggttaccggtacccgttaccggttttaccggggaaccggggtaacggggtaaacccctaaaaagggttacgggaaccgggttaaaccgtaaaaaccgggttaacgttacgggttacgggtaacccgttcgggtaccctaaaaccccggttacgttaccgtttacggtttccctttaccttaacggtttacccccgg

SEQ ID NO: 12280 - DNA, 925 bp, Homo sapiens
  misc_feature: GYAE6OF01CH0FQ.10.71.G05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctccagacaccacggagaaattgtgtgacacagtctccagccacgctgtctttgtctcgaggggaaancgccacctctcctgcagggccagtcagtagtcgttcgctacgttcggttaggggtcgtaatacaactaataaacgtccggaccaggcctacccgaggtcctccctactatttcctttagacttcgtaccttttaccgaaaccgtccggggtcccccgttagggtcccgtaccccgagggtccgtaacgggttccgaaggtcgggtaccgtacggggttcggggtaccgttacgggggaactaacgggtaccctttaccgaaccgttcccgtaacctaacccgtaacgttacccgaacggacccgtaaccggtacccggttaaggacccggtacccgttaggtaaaacggtttacgttttttacggaaccgttttaacggtttttaacgtttacgtacggtttaccgaaacgggtccgtaacggggttcccggttacggttaacccccggtttaacgggtttttacccggggggaaccggggttaaccggggttaccgggttacccccggtttaaccggggtttttacccgggggaaccgggggttaaaccgggggaaaaaccgttaaaaaacgggttacggggtaaaaccgggttaaaccgtaaaaacccggggttaaccggtaggggttaaccgggtcccggttaacccggtaacccttaaccccggtaacgtttacccggtttaccggtttaccctttaacccggtaaccgttttaccccccgg

SEQ ID NO: 12281 - DNA, 573 bp, Homo sapiens
  misc_feature: GYAE6OF01AP14D.10.71.G05.1.454.CMB.1.raw
  modified_base (202)..(202): a, c, t, g, unknown or other
  misc_feature (202)..(202): n is a, c, g, or t
  modified_base (260)..(260): a, c, t, g, unknown or other
  misc_feature (260)..(260): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgaacttcggtagggtgtatcaanataaatccggcaggctcccaggcctcctctatctttgatgtctttacaacgacgggcccctggccgtccgaggcaggttcagtggcaggtgggtctggggacaggtacttcactctcacatcagcacgtacctagcgtcctagaagtagtttgacttagtttactactgtcagcagtcgtcgcctacgtttcgggcggtagtcgaccgtacgttccgggacgggtaacggaaccaaagtacggaaggtacgaaaacgtacgtacggtcgacgtagcctaccgattctacgtacttcacttcccgtcccgtacc

SEQ ID NO: 12282 - DNA, 532 bp, Homo sapiens
  misc_feature: GYAE6OF01CN973.10.71.G05.1.454.CMB.1.raw
  modified_base (201)..(201): a, c, t, g, unknown or other
  misc_feature (201)..(201): n is a, c, g, or t
  modified_base (289)..(289): a, c, t, g, unknown or other
  misc_feature (289)..(289): n is a, c, g, or t
  modified_base (398)..(398): a, c, t, g, unknown or other
  misc_feature (398)..(398): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcggtagggtgtatcaacataaatccggaccaggctccaggctcctnatcttgatcgtctttcaacgtcggccctggctcccagcagttcagtggcaggtggtctgggacagtctcgactcgtacacatcgagcacgcctagacgcctagtaagtntttagctagtttacttactgtacagcagctcgcctcgttcggcggtaggtcgccgtacgttcggcggtaaggacaaagtggaacgtacaaacgactggtgactgcctacattctacgtctcgcttccgtacccg

SEQ ID NO: 12283 - DNA, 632 bp, Homo sapiens
  misc_feature: GYAE6OF01B5SIA.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaangcccaccctctcctgcagggccagtcagagtgttcgctacgttcggttagggtgtatcaacataaactcccggccaggcctccaggcctcctcattctttgattgtctttacaacgcgggcccctgggccgtcccgaggctaggttcaggtcggcgtaggtgggtcgtggggacagtaccttcacgtctaccaccatcagacagtacgtggtagtacgtaggtaagtagtttgacgtagttagttatttagtttcgtcgtagtactaagttagttagggttacggtaccgtaccggttacgggttacgttttacgggaccggtaacggggaaccgtacggtacgtacgggacgtacgtaacgaaacggtacgttaggtacggtcgtacgtaccaccgtacttacgttacgttcttccgtaccgttcccg

SEQ ID NO: 12284 - DNA, 541 bp, Homo sapiens
  misc_feature: GYAE6OF01CP3BT.10.71.G05.1.454.CMB.1.raw
  modified_base (384)..(384): a, c, t, g, unknown or other
  misc_feature (384)..(384): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgttttgacacagtctccagccacgctgtctttgtctccaggggaagagccaccctctcctgcagggccagtcagagtgttcgcacttcgttagggtggtatcaacataaatccggccaggctcccaggctcctcatctttgatgcttttcaacagggcccctggctcccaggccaggttcagtggcagtgggtctgggacagacttcactctcaccntcagcagcctagacgctgaagatttgctagtttattactgttcagcagcgtgcccactttcggcggtacggtgtccacgtttccggcggtacggggaccaaaaggtacgaagggtacaaacggaacgtcgtaggcgttcgaccaccgactctcgttc

SEQ ID NO: 12285 - DNA, 574 bp, Homo sapiens
  misc_feature: GYAE6OF01CKFMF.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcggttagggtgtatcaacataaatccggccaggcctccgaggctcctcatcttgatgtctttcaacgcggccctggccgtccaggcaggttcagtggcaggtcggtcgtgggacagtacttcactctcaccatcacgcacgcctagactccgtagaagtatttgacttagtttatactgtacgagcagcgtcgcctacgttcggcggtagtcgaccgtacggtttcgggacgggtaacgggaactaaaggtggaacgtacgaaacggtacgtggtacggctcggacctaaccgtagttccttacggttccttacgtacttccccgttacccg

SEQ ID NO: 12286 - DNA, 932 bp, Homo sapiens
  misc_feature: GYAE6OF01DC5RQ.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgcagggccagtcagtagtgttcgctacgttcggttagggtgtatcaacataacgtccggccaggcctccgaggcctcctcatttctttgattcgtcctttaccgaaccgacgggtccccctgggtcccgttaccccgagggtccgtacgggtttccgaaggttcggaccgtagggttcgggggttaccgtacgggggaaccgtaacgggttaccctttccgaaccttccctacccgtaaaccccgtaacttcccgaaacggtacccgtaaccggtaaccccgttaaacggtaacccggtaccccgttaagggttaaaacggtttaacgtttttttaccggtaaccgttttaaacggttttttaaaccgttttaacccggtttacggtttaacccggtaaacggtacccgttaaccgggttacccgggtttacccggttacccccggtttaacccgggttttacccgggggtaaccggggttaccggggtttacccgggtaccccggtttaacccgggtttttacccgggggaacccggggttaaaccgggggtaaaacccgtaaaaaaccgggttaacgggtaaaccgggttaaacccggtaaaaacccggggttaacggtttacggggttacgggtacccgttacggtaccccgtaaacccgttaccgtttaccgtttacgtttacccctttccgtacccgttttaccccccgg

SEQ ID NO: 12287 - DNA, 668 bp, Homo sapiens
  misc_feature: GYAE6OF01CG82Y.10.71.G05.1.454.CMB.1.raw
  modified_base (201)..(201): a, c, t, g, unknown or other
  misc_feature (201)..(201): n is a, c, g, or t
  modified_base (230)..(230): a, c, t, g, unknown or other
  misc_feature (230)..(230): n is a, c, g, or t
  modified_base (493)..(493): a, c, t, g, unknown or other
  misc_feature (493)..(493): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaanagccaccctctcctgcagggccagtcagngtgttcgctactttcggtagggtgtatcaactataaactccggcacggcctcccaggcctcctcattctttgatcgtctttcaacgtacggcccctggccgtccaggctaggttcaggtgcaggtggtcgtgggacagtaccttcactctacgacctatacacgacacgacctagacgtaccgtagtaagttagttttgaccgtttaagtttactttacgttcgtacacggtctacggtcgtacgtaccctaggtttccgggngggtaacgggttcgacccgttacggtttcgggacggggtaacgggtacctaaaaagtcgggtaaacggtaaccgaaaaaccggttacgttcgggttacgggtacctacggtaacccaaccgttacgtttccgttacggtttaccttacccttaaccgttccccgttaacccccgg

SEQ ID NO: 12288 - DNA, 728 bp, Homo sapiens
  misc_feature: GYAE6OF01D088P.10.71.G05.1.454.CMB.1.raw
  modified_base (276)..(276): a, c, t, g, unknown or other
  misc_feature (276)..(276): n is a, c, g, or t
  modified_base (446)..(446): a, c, t, g, unknown or other
  misc_feature (446)..(446): n is a, c, g, or t
  modified_base (714)..(714): a, c, t, g, unknown or other
  misc_feature (714)..(714): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctcccagaccaccaccggagtaattgtgttgacacagtctccagccacgctgttctttgtcctaccgagggaagacgccctaccctctcctgcgacgggccagtcagagttcgtcgctacgttcggttaagggtgtatacaanaataaacgtcccggccaggcctacccgaggtccttcctctacttcgtttgacgtcgtctttaccgaaccgtcgggtaccccgtggcccgtcccgagggtcctacggttcgaggttcggacgtagggtcgggtcgtagggacctagtaccttccactcgtaccacccgtanctaacgccgtacgtaccgtacggacgtccgttaggtaacgtttacgtttagtacctttaaggttttactttaacgttggtacctacgtaccgtaacggtcgtaccgtcccgtaccggttttacggggccggtaacggtccgttacccgttaccgggtttacggggaccggtacgggaaacctaaaagggtaggtaaccggtaaacgaaacggtacgttacggtagggtcctaccgggtactacccgtattccggttacttaccctttnaacccctttccccg

SEQ ID NO: 12289 - DNA, 611 bp, Homo sapiens
  misc_feature: GYAE6OF01BF1QR.10.71.G05.1.454.CMB.1.raw
  modified_base (268)..(268): a, c, t, g, unknown or other
  misc_feature (268)..(268): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccnccgtaggttccaggccacgggctggaatgggtggcagatatacatatgatgaacaagtaaaatatactagtgagtactccttagagggccgtacttcacatcctaccagagaactaactaccgaagaacagtggtagtatcgtgaacaaatcgaaccgacgacctagacgacgacgagggacgtacggggttattacgttaacgtggtagggtaacaaacgttaccgtaaggttaggacgtaatccgtaccgttagggttaattggttacggtacccggttccccgggggtacgtaaccggggtaaccccgttgggtacccgtaccccggttcgttacccccg

SEQ ID NO: 12290 - DNA, 628 bp, Homo sapiens
  misc_feature: GYAE6OF01A12QJ.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgcccaccctctcctgcagggccagtcagagtgttcgctacgttcgttagggtgtatcaacataaatccggccaggctccaggctcctcatctttgatgtctttcaacgacgggcccctggccgtacccgaggctaacggttcaggtcggctaggttggggtacgtgggacacgtacttcgacttcctaccacctatccagaccacgtccgtaggacgccgttaggtaaagttattttacgacttaagttttacttacttagtcagtacgagtcgtcgtaccgttacgtttcgggacggtaggtcgtcccgttaggtttccgggacggtaacgggaaccgtaaagtaggtaaccggtaacgtaaacggtacgttaggacggtctacgacctaccgtacgttcgtacgttacttcgtacttccccg

SEQ ID NO: 12291 - DNA, 750 bp, Homo sapiens
  misc_feature: GYAE6OF01BHPZV.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcattctttaagtaaatcgtggcattcggtccgttcggggtcccgccgtacgggttcccggggcccacggggtcctagggaagtgggggtggccgagtataataacaatatagatgaactaaagttaaaatataacgtagtaggaactaccttacccgttacgaaacgggtccctaagtttaccaaccctacttacctaccgaaggtaactaaaccgtaaacttacccgaaacgtaaaccgtagttacgggtagttaacttcgtaagtaaccaaaacgtcgaacccagtaccgtaggaacggacggacccggagggtaaccgtaacggggtttagttttaacgttaccggtagggttaacgggtaacgtaaacgttccgtaggtacggactacgtaccgtaaccggttaggttacgtttgggtacggtacccgggttacccggggtacccggtaaaccggggtaacccggttcgggtaccccgttacccggttccgttcccggtttacccccggg

SEQ ID NO: 12292 - DNA, 616 bp, Homo sapiens
  misc_feature: GYAE6OF01CKLTE.10.71.G05.1.454.CMB.1.raw
  modified_base (213)..(213): a, c, t, g, unknown or other
  misc_feature (213)..(213): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgctccgaggggaanacgcccaccctctcctgcgagggccagtcagtagtgttcgctacgttcggttagggtgtatacaatataaacgtccggcaggcctccaggcctcctcattctttagatcgtctttacaacgacgggcccctggcccgtccgaggcgtaggttcaggtggacgtagggttcgggtcgtgggactacggtcttacgacttcncacatcgagtcacgcctaagacgcctagtaacgttagtttcgacgttaagtttatcgtgtacagtcagccgtagcctacgttcggcggtacggtcgtccgtacggttcgggacggtaaacgggaaacctaaaggtaacggtacggtaaacgtaaacggtacgttagggacggtaccgtacgacccgtaacctgttcgttaccg

SEQ ID NO: 12293 - DNA, 865 bp, Homo sapiens
  misc_feature: GYAE6OF01DNP8D.10.71.G05.1.454.CMB.1.raw
  modified_base (157)..(157): a, c, t, g, unknown or other
  misc_feature (157)..(157): n is a, c, g, or t
  modified_base (178)..(178): a, c, t, g, unknown or other
  misc_feature (178)..(178): n is a, c, g, or t
tcagcatagtagtgcacgaccggtgctcgatttagtgtcgtcgcaagagagagggggcctccattcggtgatcagcactgaacacagaggactcaccatggagtttggctgagcgtggtttcgtcgtagctctttaagagatgtcagtgtcagatgnagagtggtggagtcgtggggngtcgtggtccggcggtgggggtcctgacgtactcgtccgttgttctcggtcgtccgtggtatttacctaagtttactttaagttaaatcggtcggactagttcggtccgtcgggtccgtaccgtacggttccgagggccgacgggtcgtagggaagttggggtacgcgtaaggtatacgtaactaagtagtagtataggaaactaaagtaaataacgtattacggaacgacgtaaccttccgtaacggacggtaccgtacttaccaacgtactaccttaacgaacggtaacaacgttaattaacccgaaaagtaacctaggttacggttaacgtaacttacggttaccgaataaaaccggttccgtaaaccgaccggttaccgaacgttaaacgggtacccggaaccgggtaacggggtttaaacgggttacgggtttttaaacggttttaacggtttaaccgggttaaggggttaaaccgggttaaacggttaaaccggttacccggttaaaggggttccgtaaaccttcgggttaacccggtttaacgggtttaggttttaaccggttcggggttacccgggtttaccccggggttaacccgggggaacccgggtttaaaaccccggggtagggttaccccgggtttaacccggtttacccggttcccggttttaaaccccgggg

SEQ ID NO: 12294 - DNA, 853 bp, Homo sapiens
  misc_feature: GYAE6OF01AD1GK.10.71.G05.1.454.CMB.1.raw
  modified_base (203)..(203): a, c, t, g, unknown or other
  misc_feature (203)..(203): n is a, c, g, or t
  modified_base (301)..(301): a, c, t, g, unknown or other
  misc_feature (301)..(301): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaangcccacctctcctgcgagggccagtcagagtgttcgctacgtttcggttagggtgtatacaacataaactccggaccaggcctcccgaggcctcctanactttttttctagtattcgtcctttacgaaccgtaccgggtcccctcgggtcccgtaccccgtaggtccgtaacggttccgaagggtcggacgtacgggttcgggttacgtacggggaacgtacggttaccgttaccaccgttcctaccgaaccctagttaccgacggtaccgtaacggtacccgttaaggaccgtaccggttaaggtaaacgtttacgttttacggtaccttaacggtttttaaacttaccgttacggtaccaacggtcgtaacggttcccgttacgttacccgttacggttttccggggaacgggttacgggttaccgtacccggttaaccgggttttaccgggggaaccggggtaaacgggtaaacccgttaaaaaggttaccgggtaaaaccgggttaaaccgtaaaaacccggggttaaccgggttaagggttaccggggtacccgttaacccgggtaacccgttaaccccgtttaacggtttacccggttttaaccggttacccgttttaacccgttacccggttttaccccccgg

SEQ ID NO: 12295 - DNA, 769 bp, Homo sapiens
  misc_feature: GYAE6OF01AJ0A4.10.71.G05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgctccaggggaaanacgccacctctcctgcagggccagtcagagtgttcgctacgtttcggttagggtgtaactccgaactaacttaaaacgtcccggccgacggtccttccccgaaggtccttcccgtacagtttcctttacggattcggtcttttaccgaaaccgtacggggtcccccttagggcccgttaccccgagggtcctaacgggttcctacgggttcggtaccgtaacggttcggggttccgtaggggtaacctacgggtaaccttttaccgaaccgttccgttaccgaaacccgtagttaccgacgtaccacggtaccctaggtaccgtaccgttagaacgtttgttttacgacgttacgttttaactttaccgtacgttacgactaccgtacggtccgtcgtacccgtacgtttccgggacggtacggttccgaccgttacggtttacgggaccgggttaacggaacgtaaacgtagggtaacgttaccgtaaaacgtaacggttcggtacggtacgtcggacctaacccttacgtaccgttacgttaccttaccgtacgtttcccgtaccccg

SEQ ID NO: 12296 - DNA, 740 bp, Homo sapiens
  misc_feature: GYAE6OF01ETE4E.10.71.G05.1.454.CMB.1.raw
  modified_base (204)..(204): a, c, t, g, unknown or other
  misc_feature (204)..(204): n is a, c, g, or t
  modified_base (731)..(731): a, c, t, g, unknown or other
  misc_feature (731)..(731): n is a, c, g, or t
tcagcatagtagtgcacgaccggtgctcgatttagtgtcgtcgcaagagagaggggggaggaactgctcagttaggacccagagggaaccatggaagccccagctcagcttctcttcctctgctactctggctcccagacaccaccggagtaaattgtgttgacacagtctccagccacgctgtctttgctccgaaggggaaancgcccaccctctcctgcgagggccagtcagagtgttcgctacgtttcggttaaggggtgtatcaaactaataaacgtccggaccaggtcctcccgacggtccttcctctacttctttgacttgtcctttaccaacggtaccgggtcccctggccgtacccgaggccgtacggttcgacggtcggacgtacggtcgggtacgtacgggaactaggtaccttccacgtacctaccgacctagtaccacgcctaacgtccgtaaggtaccgtaccgtaggttaaagttcgttttacgacgtttaaagttttaaccttacgttgtacgtacgtacggtacggtaccgttaccggtacccgtttaacggggtttccgggaccggggttacggttccggtaacccgtttacgggtttaccgggaacgggaaaccggtaaacctaaaggtagggaaaccggtaaacgtaaacgtacgttagggtcggaccgttacggaacctaccggtctttaccgttaccgttacttacccgnttacccccg

SEQ ID NO: 12297 - DNA, 863 bp, Homo sapiens
  misc_feature: GYAE6OF01D19HG.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttggctgagctgggtttcctcgttgctctttaagagatgtccagtgtcagatgcagatggtggagtcgtgggggaggcggtcgggtcccggccggtcggggggtccctggacgtaccttcctccgttgttcgtgccgttcgtggtacttctattctttaagtaaactcgtggactagtcgtccgtgggtcccgtaccgtacggttccgacggcccgacgggtccgtaggtaagtcggggtgacgaaggtactaagtaacaattagtagagtagaaactaaagttaaaaatacttaacgtaagtacggaacttacccttacccgttaacggaacgggtacccgttaacttaccctaaccgtactaccctaccgaaacgtaacgtaaaccttaaaccgttaacccgaaaagtaacccgttaagttcgggttaacttaactcgtaacggtaacaaacgtccggaaccgtacggtccgtaaggaaccgtacgggaacccggtaaggtaaccgggttaacgggtttttagttttaaacgttaccgggtaagggttaacggggaaacgtttaaccgttacccggttaaggttaccgggtaaccttaaccgttaccggttaaacccggtttggtttaacggtttaccgggttaaccccgggttaacccgggttacccccggggggaaccggtttaaacccggggtaaaccccgggtttccggttaaaccccgttcccgggtttaaccccgtttaccccccggggg

SEQ ID NO: 12298 - DNA, 959 bp, Homo sapiens
  misc_feature: GYAE6OF01BN87T.10.71.G05.1.454.CMB.1.raw
tcagcatagtagtgcacgaccggtgctcgatttagtgtcgtcgcaagagagagggggagctctgggagaggagcccagcactagaagtcggcggtgcctccattcggtgatcagcactgaacacagaggactcaccatggtaggtttgggctgagtcgttgggttttcctcgttgcttacttttaagagtatgtccagtgtcagatgcagagtggtggaggtcggtgggggaggcggtcggggtcccgggccggtcggggggtccctggacgtaccgttccttccgttggttccgtcggtcggttcgttggtactttcgttaactttacgttttaaggttaaaacttccgtagggtaccttacgttcggttcccggtcggggttccccgtaccggtacgggttcccgacgggtcccggtaaggggtccgtagggtaacggttggggtacggtacgaaggtaagttaaacgtaactaaagttagtaacggtaatacggtaaaactaaaaggttaaaaacttaagttaaaccgttaaggttaaccgggtaacttaacccgttaccggttaaccgggtaaaccggggtacccgtttaacgtaaccctaacccgtacctttaaccccgtaccgtaaacgtaacccggtaaaaccgttaaacctttaaacccgaaaaacggttaaacgttaaggtttaacgggttaacgttaaaccgttacccggttaacgtaaaacccgttaaaacggtacccgttaaacccgggaaccgttacccgggtaaagggtaaaccgggttacccgggaaacccgggggttaaccgggttaaaccggggttttaaccggggttttaacggttttttaaacggttaacccggggtttaagggtttaaacgggggtaaaacggttttaaacccgggttaacccgggtttaacggggttacggaaccctttaaacccggg

SEQ ID NO: 12299 - DNA, 836 bp, Homo sapiens
  misc_feature: GYAE6OF01DN3NT.10.71.G05.1.454.CMB.1.raw
  modified_base (205)..(205): a, c, t, g, unknown or other
  misc_feature (205)..(205): n is a, c, g, or t
  modified_base (821)..(821): a, c, t, g, unknown or other
  misc_feature (821)..(821): n is a, c, g, or t
tcagcatagtagtgcacgaccggtgctcgatttagtgtcgtcgcaagagagaggggggaggaactactcagttaggacccagagggaaccatggaagccccagctcagcttctcttcctcctgctactctggctcccagacaccaccggagaaattgtgttgacacagtctccagccacgctgttctttgtctccgaggggaaanagcccaccctctcctgcgagggccagtcagagttgtcgctacgtttcggttaggggtgttactacaaacaattaaaacgtcccggaccaacgggtcccttaccccgaacgggtccttcccctctaacgtttccgttttagaacgtttcggtaccttttaccgaaaaccggtacccgggggtcccccttcggggacccgttcccccgaaggggtccgtaacggggtttccgaacggggttcgggaccgtaggggtttcgggggttaccgttacggggggaaacctaacgggttaccctttaccgtaaccttccgttacccaacccgtaacgttaccgacggtaccgaacggtaccctaaggaaccgtccgttaacggtaagtttacgttttcgtacgtttaaggttttaacttacgttacgtaccgaagtcgtacggtcggttacgtacccgtttaacgggtttccggggacgggttaacgggttccggtacccgttaacgggttttccggggaccgggtaaacggggaccctaaaaagggtacggtaacgggtaacccgaaaacggtcgtacgggtggaccgtcgaccgtaccgtaacttccgttacttcttaccncgtttccctaccccg

SEQ ID NO: 12300 - DNA, 704 bp, Homo sapiens
  misc_feature: GYAE6OF01BUH91.10.71.G05.1.454.CMB.1.raw
  modified_base (202)..(202): a, c, t, g, unknown or other
  misc_feature (202)..(202): n is a, c, g, or t
  modified_base (255)..(255): a, c, t, g, unknown or other
  misc_feature (255)..(255): n is a, c, g, or t
tcagcatagtagtgcacgaccggtgctcgatttagtgtcgtcgcaagagagagggggggaactgctcagttaggacccagagggaaccatggaagccccagctcagctttttcttcctcctgctactctggctcccagacaccaccggagaaattgtgttgacacagtctccagccacgctgtctttgctccgaaggggaanacgccaccctctcctgcagggccagtcagcgtgttcgctacgttggttagggngtatacaaactagtaaacgtcccggacacggtcctcccgaggtccttcctctatttctttgattcgtaccttttacgaaccggtaccggtcccccgtggtcccgtacccggacggcgtacgggttcaggtcggcgtaggttcgggtcgtaggggactagtacttcacctcgtaccaccgtatccacgaccgtacggtaccgtaaggacgtacccgtaggtaacgttacgtttttacgtacgtttaagtttaactttacgtcgtacgtagtcctacggtcgtaccgtacccgtttacggttacgggcggttacgggtccgtacccgtcggtttaccgggaacgggtacggtaacgaaagtacggaacggtaaaccgtaaacggtacgttacgcggtaccgtacgtccaccgttatccgttacttcttaccttcctttacccgtcctaccg

SEQ ID NO: 12301 - DNA, 653 bp, Homo sapiens
  misc_feature: GYAE6OF01EWCKR.10.71.G05.1.454.CMB.1.raw
  modified_base (214)..(214): a, c, t, g, unknown or other
  misc_feature (214)..(214): n is a, c, g, or t
  modified_base (249)..(249): a, c, t, g, unknown or other
  misc_feature (249)..(249): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccagctgtctttgtctccgaggggaaanagccaccctctcctgcaggccagtcagagtgttcnctacttcgttagggtggtatcaacataaatccggcaggcctccaggcctctcatctttgatgtctttcacgtacggcccctggccgtccgaggcaggttcaggtggctaggtgggtctgggacagtacttcacgtctacaccatcacgtcagtcctagacgtcctagtaagtatttgtcttaaggttttactttacgtcgttactaactacgttacggtaaccggtaggtaccgggtcccggttacccggggggtacccttaccggttttcccgggtccccggttaaccggggaacccgtaaaacgggtacgggtaacgttaacgtaccgtaaaaccgggtaacgttcgggtacgggtccgttacggaccgtaacccgtaacgttccgttcgttcctttacccg

SEQ ID NO: 12302 - DNA, 757 bp, Homo sapiens
  misc_feature: GYAE6OF01AFFE3.10.71.G05.1.454.CMB.1.raw
tcagcatagtagtgcacgaccggtgctcgatttagtgtcgtcgcaagagagagggggggggagaggagcccagcactagaagtcggcggtgcctccattcggtgatcagcactgaacacagaggactcaccatggaggtttgggctgagcttgggttttcctcgttgcttctttaagagatgtccagtgtcagatgcagagtgggtggaggtcggtgggggggaggcggtcgggtcccgggtccgggtcgggggggtcccctggacgtaccttccgtccgttgttccgtggccggttctgggtacttcattctttaagtaaactctggctattcggtcccgtggggtccccgccgtacggttcccgagggcccgacggggtctggggtaagtggggtggcagatatacaatatgatagactaagtaaaatataactagtaggacgtaaccttcccgttacgaacggggtccctaacgtttaccaacccgtactacccgtacccgaacggtaacgtaacctaaactttacccgaaaggtaaacctaacggtagggtttagtaacttcgtaaggtacctaaaaggtccgaacccgaggtaccctaggaaccgacgggaacccgggtaaggtcccgggttaacggggtttacgttttaacggtttacggtaggggttacggggtaaagttaaaccggttacccggttagggttaccggggtacctaagttacccggtaaccggtttaggggtttaacggg

SEQ ID NO: 12303 - DNA, 876 bp, Homo sapiens
  misc_feature: GYAE6OF01AINHF.10.71.G05.1.454.CMB.1.raw
  modified_base (190)..(190): a, c, t, g, unknown or other
  misc_feature (190)..(190): n is a, c, g, or t
  modified_base (242)..(242): a, c, t, g, unknown or other
  misc_feature (242)..(242): n is a, c, g, or t
tcagcatagtagtgcacgaccggtgctcgatttagtgtcgtcgcaagagagagggggaggaacgtgctcagttaggacccagagggaaccatggaagcccagctcagcttctcttcctcctgcctactctggctcccagacaccaccggagaaattgtgttgacacagtcctccagccacgctgtctttnctccgaaggggaactcgcccaccttctccgtgacgacgggccagtcgaacgngttcgttcgacctacgtttacgggttaggggtcgttaactaccgtaaaccgaacgttaaacgtcccgggaccgtaacgggtcccttacccgaacggggttccttacccgtaccgtactttccgtttacggacgttaccgttccgttttaaccgaaacccggtcgggttcccccgtacgggtccccgtacccggtacgggtccgtaagggttccgaacgggttcgggcggtacgggtttcgggttacggtacgggggaacctcgggtaaccttcgtaacccgtcgttaccaacccgtacttaccggacggacctacgtacccggttaagggaccgtccgttaagggtaacgtttagttttacggtactttaacggtttaatttccgttacggttacctaggtaccgttacggtaccggttcgtacccggttaccggtttacgggtaccgggtacggtacgggtacccgtttaaaggtttcccgggggaacgggtaaccggtaaaccggtaaaaggtaccgggtaacgggttaaaccgaaaaccgggttacgtaaggtaccgggtaccgtacgtaaacccggtacccttaaacgggttcgttaacccgtttacgtaaccggttcccgttaaccccg

SEQ ID NO: 12304 - DNA, 816 bp, Homo sapiens
  misc_feature: GYAE6OF01CVR3B.10.71.G05.1.454.CMB.1.raw
  modified_base (194)..(194): a, c, t, g, unknown or other
  misc_feature (194)..(194): n is a, c, g, or t
tcagcatagtagtgcacgaccggtgctcgatttagtgtcgtcgcaagagagagggggagagccctggggagaactgctcagttaggacccagagggaaccatggaacgccccagctcagtcctttctctttcctcctgcctactcgtggctcccagaccaccgaccggagaaattgtgttgacacagtcctcanccacgctgtctttgcctaccgaaggggaaacacgtcccacccttctcctgcgtaggtcagtcaggtacgtgttccgctagtttcggttagggttgtactacaacaacttaaacgtccggaccacgggtcctccccgaggtcccttcctacctaatttcgtttacgtagttacgttcccgttttaaccgaaaccgtaccccgggggtcccccgtacgggtaccccggtacccggtacgggacctttacggggttacgtagggtcggggccgttagggttcggggtccggttaggggaacccttacgggtacctttaccgacccttaccgtaccaacccgtaattcccggaaggacccgtaaccggtaacccgttaggaacccggttacccgtaaggttaaaaccggttcgttttttacggacgttttaacgggttttacttacgttcgttaaccgacgtacgtacggtccggttactacccggtttacgggtttccgggacgggttaccgtaccggtaccgttaccgggttaccgggaacgggtacggaaaccgtaaaggtacgtacggtaaaccgaacggtacgtacggttcggtacctacgtacctaactcggttcttccg

SEQ ID NO: 12305 - DNA, 667 bp, Homo sapiens
  misc_feature: GYAE6OF01B261I.10.71.G05.1.454.CMB.1.raw
  modified_base (214)..(214): a, c, t, g, unknown or other
  misc_feature (214)..(214): n is a, c, g, or t
  modified_base (496)..(496): a, c, t, g, unknown or other
  misc_feature (496)..(496): n is a, c, g, or t
  modified_base (605)..(605): a, c, t, g, unknown or other
  misc_feature (605)..(605): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctcccagaaactaccgcaagtaaattgtgttgacacagtctccagcccaccttgttctttgtctaccgaaggggaaacgcncccaccctctccgtgcgacggccagtcgagtacgttccgttcccgctacgttacgccgtacggtaaccaacgagtaacgccgtcggaccgacggcctcccgaggcctacctcatcgtatgatcgactacgtaccaacgacgggacctacgtgaccacctaccgactccggtagttcgaggtcggacgtgggtcggtcgtggaccgactacggtaccttacctaacgtccctaccgaacctacacctaaccgactaccgtaacgtaaccgttagtaacgtttntttaactcgttttacttttacgtttcacgttaccaacgtgtacgccacggtacgtcccggtcccgtacggtaccggttcgggaccgggtaacggaccggaggtacgganacgtacggaggaccgttagcggcggtctacgacctacgtacttcgtcgttccttcgtacccg

SEQ ID NO: 12306 - DNA, 619 bp, Homo sapiens
  misc_feature: GYAE6OF01ALFD5.10.71.G05.1.454.CMB.1.raw
  modified_base (214)..(214): a, c, t, g, unknown or other
  misc_feature (214)..(214): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctactttcggttagggtggtatcaacataaactccggccaggcctcccgaggcctcctcatctttgatgtctttcaacgcgggcccctggccgtccgaggctaggttcaggtggctaggtgggtctgggacagtacttcactctcacatcagcacgcctagacgccgtagtaagtattttcgacgttagtttacttactgtactagcgtagtcgtacgcccgttacgtttcgggacggtacggttcggtacccgttaccggtttcgggaccgggtaacgggtaaaccgtaaaaggtacgggtaacggttaaccgaaaaccggtaacgttagggtcgggtaccttacggacctaccgtacgttcgttacg

SEQ ID NO: 12307 - DNA, 723 bp, Homo sapiens
  misc_feature: GYAE6OF01E1RAZ.10.71.G05.1.454.CMB.1.raw
  modified_base (169)..(169): a, c, t, g, unknown or other
  misc_feature (169)..(169): n is a, c, g, or t
  modified_base (173)..(173): a, c, t, g, unknown or other
  misc_feature (173)..(173): n is a, c, g, or t
  modified_base (551)..(551): a, c, t, g, unknown or other
  misc_feature (551)..(551): n is a, c, g, or t
tcagcatagtagtgcacgaccggtgctcgatttagtgtcgtcgcaagagagagggggagagccctggggagaactgctcagttaggacccagagggaaccatggaacgccccagctcagcttctcttcctcctgctactctggcctccagacaccacgagaattgtgtnacanacgtctccagccacgtcttgttctttgctaccggaaggggaacacgccctaccttctccgtgcgacgggacctagcgaaggtgttcgttcgctacgtttcggtagggtacgtataccaagtaactaaccgtcccggacgtacggtccctccgacggtccttcccgtacttacttcgttttcgacttccgtaccttttaaccgaaccggtcccggggtcccctggtacccgtacccggacgtaccgttacggttacgtacgtcgggactagggtacggtcgtacgggactacgttactccacgtaccgtacaccgtatcgactcagactagactcgtaggtaacttgttacgctttaacgtttcgtagttcacggtacncgggtactccggttacctaacggtttccgggtcggtaaccgggtagttccggtacccggttaggttcccgggaaacggggtaccgttaaaaaccggtaggttaaccggaggtaaaacccgtaaggttacgtcgggtacgtcttaccggaactttaccgtagtcgtttaccgg

SEQ ID NO: 12308 - DNA, 744 bp, Homo sapiens
  misc_feature: GYAE6OF01C7QE6.10.71.G05.1.454.CMB.1.raw
tcagcatagtagtgcacgaccggtgctcgatttagtgtcgtcgcaagagagagggggcctccattcggtgatcagcactgaacacagaggactcaccatggagtttgggctgagctgggttttcctcgttgcttcttttaagagatgtccagtgtcagatgcagagtggtggagtcgtgggggaggcggtgggtccggccgtcgggggtccctgagactcctctgttctgcgtctggtattctattctttaagtaaatcgtggactagttcgttcccgtcggggtcccgtccgtaacgggttcccgacgggaccgtaccggggtcgttagggaaggttcggggtggacgtaagtaattaactaacgtaaagttagtagaactaggaaactaaaagtaaaacttaataacgttagtacggtaacgtaaccttaccgttacggaacgggtaccgtaacttaccgaacctaacgtcctacgaactacgtaaacctaacgttaccaaagtaaacgtacgttaggtattaccgttacgtaacggtaacaaaacgtcgtaacccacgtaccgtacgaacggaccggaacggaaccggtacggttacggtttagtttaggtaccgtaggggttaacggaacgttaactaccggtaggtcgacgtacgtaccgtaccgtaggtttagtcggttggtacccggtcccgggaacgtaccgggtaacgtcggacccttaccggttccttacccgg

SEQ ID NO: 12309 - DNA, 792 bp, Homo sapiens
  misc_feature: GYAE6OF01C8KRV.10.71.G05.1.454.CMB.1.raw
  modified_base (144)..(144): a, c, t, g, unknown or other
  misc_feature (144)..(144): n is a, c, g, or t
  modified_base (160)..(160): a, c, t, g, unknown or other
  misc_feature (160)..(160): n is a, c, g, or t
  modified_base (183)..(183): a, c, t, g, unknown or other
  misc_feature (183)..(183): n is a, c, g, or t
  modified_base (282)..(282): a, c, t, g, unknown or other
  misc_feature (282)..(282): n is a, c, g, or t
  modified_base (304)..(304): a, c, t, g, unknown or other
  misc_feature (304)..(304): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcgtcgcaagagagaggggggcctccattcggtgatcagcactgaacacagaggactcaccatggagtttgggctgagcgtggtttcgtcgtagcgtctttaagagntgtcagtgtcagatgnagagtggtggagtggtagggggnggtcggtgggtcccggcggtcggggggttccctagacgtccttctcccttgttccgtgcgttcgtggtacttacgtatttattaaagtatccgtggctnttcggttccgtgggtacccccncgttacggttccgacggaccccgaaggggtcgtagggtacggtggggtagcgaaagtataattaacggataagtgaaagttaanaaaacgtaaagttaaaattacgtaacgtaggtacggtaacctacccgtttaccgtaacgggacggtacccttaactacctactaccgttaaccaaccggtaaagaaactaacccgttaacgttaaaccgaacctaacgttaggttaggttaacgttaacttacgtaacgtaaacgtaaccgtaccgtaaccgtaccgtacgaacgggtaccgggtaacggaccggtaaccgggttacggtttaacggtttaggtttaacgtaagggttagggaacgtaagttaaccgttcggtaacggtactacctagttaccgtacggtttagttacggttacggttaccggggtacccggtacgggtaaccggtaccgggtaacttccggttaccgtccgttacccgtcccg

SEQ ID NO: 12310 - DNA, 547 bp, Homo sapiens
  misc_feature: GYAE6OF01D2RPK.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagtgttcgcactttcggttagggtgtatcaacataaactccggcaggctcccgaggctcctcatctttgatgctttacaacgcggccctggcgtcccagtcaggtcagtgctaggtggtctgggacagtacttcactctcacatcagcagcctagacgtcctagaatactttgacttagttttattacctgtctagctagtcgtgtccgtacgtttcggcggtaggtcgtaccgtacgtttcggcggtaacggacaaagtcggtagtacgaacgacgtgtaggctgacacacgttctagttactctatccttacccg

SEQ ID NO: 12311 - DNA, 943 bp, Homo sapiens
  misc_feature: GYAE6OF01EE0IE.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctctgctactctggctccagaccaccacggataattgtgttgacacagtcctcgagcccacgtctgttctttgtccgtaccggaaggggaaaacgccgccctacccctctccgtcgacgtacgggccctagtcgtaaggtacgttcggttccgacgttaccggttttagggttagggtcgttaactaccgaaactaaacgttaaaccggtcccggaccgacggtacccgtacccggtaacggtccttacccttcgtaaccgttttcgtttagtacgtttacgttaccgttttaacccggaaacccggtccccggggttccccgttccggggtacccgttccccggtaacggggtccgtttaacggggtttaccggtaacgggttccgggtacgggttaacggggtttcgggggttaccgggtaaggggttaaccccgtaacgtttaacccgtttaccccgtaacccgtttaccgtaacccggtaaccctaaggtaacccgtacggtacccggtaacgttaacccggtacggtaaccggttaccgttaacggtttaaacgggttttacttttacggttaacgtttaacgtttttaaccgttacgtttaccggtaacgtacggtacgtaacggttcccggttaacgtcccggtttaacggttcgggtaaccgggtacgtcccgttaccggttacgggttaccgggtaacgggtaaccgtaaacggtaaaggtaccggtaaacggtaaccgtaaacgggtcgttacgggtacgtaccgtacgtacccgtacgttacgttacgttagttcccttacgttcccttacccgg

SEQ ID NO: 12312 - DNA, 637 bp, Homo sapiens
  misc_feature: GYAE6OF01BNW3E.10.71.G05.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagcccacgctgtcttttgtctccgagggggaaanagcccaccctctcctgcagggccagtcagagtgttcgctacgttcggttaggggtgtatcaactataaactccggccaggcctcccgaggcctcctcattctttgatgtctttcaacgacgggcccctgggccgtccaggcaggttcaggtggcaggtgggtcgtgggacagcttcactctcaccatcagacacgtcctagacgtccgtagaagttacttttgacttagttttaacttacgttcggtacagtcgacggtcgtcgcccgttacgtttccgggacgggttaggtccgtccggttaccggtttcggggaccggggtaagggaacccgaaaagttacgggaacggtaaccgaaaaccggtacgttagggtcggtccgtacggtacccaccgtacgttccgttattccgttctacgtttcccccg

SEQ ID NO: 12313 - DNA, 602 bp, Homo sapiens
  misc_feature: GYAE6OF01EW11I.10.71.G05.1.454.CMB.1.raw
  modified_base (207)..(207): a, c, t, g, unknown or other
  misc_feature (207)..(207): n is a, c, g, or t
  modified_base (307)..(307): a, c, t, g, unknown or other
  misc_feature (307)..(307): n is a, c, g, or t
  modified_base (421)..(421): a, c, t, g, unknown or other
  misc_feature (421)..(421): n is a, c, g, or t
  modified_base (486)..(486): a, c, t, g, unknown or other
  misc_feature (486)..(486): n is a, c, g, or t
tcagcatagtagtgcacgaccggtgctcgatttagtgtcgtcgcaagagagagggggggggaggaactgctcagttaggacccagagggaaccatggaagccccagctcagcttctcttcctcctgctactctggctcccagacaccaccggagaaattgtgttgacacagtctccagcccacgctgtctttgtctccaggggaaangccaccctctcctgcgagggcccagtcagagtgttcgctacgttcgttaggggtgtactcgaaacataaactccggaccaggcctcccaaggctcccgtnattctttgatcgtctttacaacgtacgggtccccctgggccgtcccaaggtctaggttcaggtgcgaggtcgggtctgggactagtacttcactctcgaccatcagcacgctangtcctagaagtatttgcttagtttacttcgtgttcgagacgagcgttaccgcttacgttccgggnggtacgggtcgtaccgttacggtttcgggacggagggtaaaccaaaagtgaacggtacaaacggtactggttacggcgtacgacaaccgtacttcgtacgttccttctacttaccg

SEQ ID NO: 12314 - DNA, 780 bp, Homo sapiens
  misc_feature: GYAE6OF01DN0CK.10.71.G05.1.454.CMB.1.raw
  modified_base (208)..(208): a, c, t, g, unknown or other
  misc_feature (208)..(208): n is a, c, g, or t
  modified_base (278)..(278): a, c, t, g, unknown or other
  misc_feature (278)..(278): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagaccaccacggagtaaattgtgttagacacagtctccagcctacgcttgttctttgtctccgaaggggaaanacgcccaccctctcctgcgacgggccagtcagtagttcgttcgttacgttcggttagggtgtactcaaanaataaacgtcccggaccaggtcctacccgaggtcctcctacctatttcgtttagattcggttacctttacgaaccggtaccgggcccccgtcgggtcccgtacccggaggtaccgtacgggtttcgacggtggaccggtaggttcggggttacgtacggggacctacggttacctttccgaccgttaccctaccgtaaccctacgtacgacgtaccgaacgtccgtaacggtaccgttaccgtaggtaaacgtttacgttttaggtacccgtttaaagtttttaccgttaacgttcgttaccgacggttaccacgggttccgttaccgtaaccctttcggggttttacgggcggttacggtaccgtcccggttacggttcggggaaccgggaacggtaacctaagtacgggtaacgtaacgtaaacggtagtcggtacgaccgtacggacctaaccggttattaccgttagttacccttgtaacccttcccgtacccgtacc

SEQ ID NO: 12315 - DNA, 788 bp, Homo sapiens
  misc_feature: GYAE6OF01D7HLA.10.71.G05.1.454.CMB.1.raw
  modified_base (152)..(152): a, c, t, g, unknown or other
  misc_feature (152)..(152): n is a, c, g, or t
  modified_base (211)..(211): a, c, t, g, unknown or other
  misc_feature (211)..(211): n is a, c, g, or t
tcagcatagtagtgcacgaccggtgctcgatttagtgtcgtcgcaagagagaggggggaggaactgctcagttaggacccaggagggaaccatggaagccccagctcagcttctcttcctcctgctactctggctcccagacaccaccgganaattgtgttgacacagtcctccagccacgccttgttctttgtcctaccgaagggaaacncgtacccaccccgttctccgtgaccgacgggaccctaggtcaacggtagtttcggttcgactacgttttcggttaaggggtgtaactactaaactaagttaaaccgtcccgaccgaacggccctacccgaggtcctccttactattcgtttagacttcggttaccttaccgaaacgccggggtcccttcggaccgttcccgacggcgttaacgggttcagggttcggaccgtagggtcgggtttacgaggggaacctacgggtacccttacgtacctctacccgaacctatacgtacgccgtaacgaccgttacggaacgtcccgtaaggttaacgttacgttttacgacgtttaaggttttaactaccgtttacggtaccgtagtaccggtacgtcggtttaccggtccgttaaccgttttcggggaccggttacgggttcctacccgggttacgttccggggtaaccgggaacggtaaaccgaaaggtaaccggaacggtaaacgaaaccggtacggttacgtcggacctagtaacccgacgttacttacctcgttaccttccgtccttccccgg

SEQ ID NO: 12316 - DNA, 856 bp, Homo sapiens
  misc_feature: GYAE6OF01A9RRV.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgcttcttttaagagatgtccagtgtcagatgcagatggtggagtcgtgggggaggcgtggtccggccgtgggggtccctgagactctcctgttctgcgtctggtattcattctttaagtaaatcgtggctattcggtccgtcgggtcccgccgtacggttccgaggcccacggggtcctagggtaagtgggggtggccaaggtaattaacgtaactaaatagtagagtacgaaacgtaaagttaaaaattataacgtagtacggaacgtaccttacccgttaacggaaacggggtcccgtaactttacccgaaccctacgttaccctaacccgaaaggtaaaccgtaaaccttaaacgtttaacccgaaaacgtaaaccgttaaggtttacgggttactttaacttaccgttaacgaaaccttaaaagttccggaaacccgtaacggtaccccgttaggaacggtaaccgggacccgggaaaccgggtaaccgggtttaacggggttttaacggtttttaacgttaacccgggttaggggttaaaccggggtaaacgttaaacgttacccggttaaggtaccggtaactaaccgtttacccggtaaccggtttaagggtttattccgggttaacgggtaccccgggtttacccgggggaaccggttaaccgggggttaaaccccggttgggtaaccccgttacccgggttcccgttaaccccggg

SEQ ID NO: 12317 - DNA, 782 bp, Homo sapiens
  misc_feature: GYAE6OF01A9XOC.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgcctccgaggggaaancgccaccctctcctgccacgggccagtcagagtcgttcgctacgttcggttagggtgtaatccaactataaacgtccggaccagggcctcccgaggcctcctctacttcgtttagacttcggtacctttaccgaacgtaccgggtccccctacgggcccgtacccgacggtccgtaagggttcccgaaggttgggaccgtacggggtcggggtccgtacggggaacgtacggttaccgttaccgtaccttcctacccgtaacctacgttccgaacgaccgtacggacccttaacggacgtacccgtaagggtaacgtttagtttttacggacgtttaaggttttaactttacgtcgttacgtaacggtaccgtacggtccggtaccgtccgtaaccggttttccggggaacggggttaaccgggtccgtacccggtaccggtttacccggggaacgggtaaccgggtaaaccgaaaacggttacggaaccggtacccgtaaaacggtaccgtaggtaccgggcgttacggaccgtccgaacgttccgttacggttacctttacacccgttccgtaccccg

SEQ ID NO: 12318 - DNA, 571 bp, Homo sapiens
  misc_feature: GYAE6OF01A9Q1J.10.71.G05.1.454.CMB.1.raw
  modified_base (203)..(203): a, c, t, g, unknown or other
  misc_feature (203)..(203): n is a, c, g, or t
  modified_base (288)..(288): a, c, t, g, unknown or other
  misc_feature (288)..(288): n is a, c, g, or t
  modified_base (308)..(308): a, c, t, g, unknown or other
  misc_feature (308)..(308): n is a, c, g, or t
  modified_base (386)..(386): a, c, t, g, unknown or other
  misc_feature (386)..(386): n is a, c, g, or t
  modified_base (407)..(407): a, c, t, g, unknown or other
  misc_feature (407)..(407): n is a, c, g, or t
  modified_base (559)..(559): a, c, t, g, unknown or other
  misc_feature (559)..(559): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaagngccaccctctcctgcagggccagtcagagtgttcgcacttcgttagggtgtatcaacataaatccggccaggctcccaggctccncatctttgatgctttcaacncgggcccctggccgtcccaggcagggttcaggtggcgaggtcgggtctggggacaggtacttcactctcaccatcgancacgcctagcgcctgaacgtnttttagcttagtttacttacgtgtcagctagcgtcgcctacgtttcgggcggtacggtcgtccgtacgtttcgggcggtaacgggaaccaaagtaggaacggtaccaaacggacgttgtaggcgtgccaccgtactcgtacgttaccttctnttcccgttcccg

SEQ ID NO: 12319 - DNA, 720 bp, Homo sapiens
  misc_feature: GYAE6OF01EN15A.10.71.G05.1.454.CMB.1.raw
  modified_base (151)..(151): a, c, t, g, unknown or other
  misc_feature (151)..(151): n is a, c, g, or t
  modified_base (164)..(164): a, c, t, g, unknown or other
  misc_feature (164)..(164): n is a, c, g, or t
  modified_base (516)..(516): a, c, t, g, unknown or other
  misc_feature (516)..(516): n is a, c, g, or t
  modified_base (667)..(667): a, c, t, g, unknown or other
  misc_feature (667)..(667): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctccagacaccgacgganaaattgtgtgacncacgtctaccagccacgctgtctttgctaccgagggaacgcgccaccgtctcgtgcgagggcagtcgagtgtcgtcgctacgttcggttagggtggtaactcaaactataaacgtcccggcgacggcctaccgacggtacctccgttctacgttcgttgattcgtacctttacgaacggtaccggcccgtcgggtcccgtaccacgggtcgtacggttacggcgtagggaccggtaggttacggggtcgtacggggaactacggtacccgttaccaaccgttcgtacccgtaacctacgttaccgacgtacgtaccgtaccggttaacgaccggtacctaagtaacggtttntttacgggaactttaggttttactaccgtagtcgaacgtcgacgtctccggtacttaccggtacgggacggtacggtccgtcccgttacggtcgggaaccggtacggaaacttaaacgggagtaccggaacgtaaccggtacgttacgggngaccgttacgacctaaacgttcgtacttacggttactccgttccgttaccccg

SEQ ID NO: 12320 - DNA, 685 bp, Homo sapiens
  misc_feature: GYAE6OF01D4YRN.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagttgttcgctacgttcggttaggggtgtatcaacataaacgtccgcaggctccagcctctcattcttgatgtctttacacgcggccctggccgtccgagcgtaggttcaggtcggcgtaggtgggtcgtagggactagtacttcactctccactatcagcacgacctagacgtctagtaacgttcttttacgacttaagtttacttcgtagtactacgtcgtaggtccgttacgtccgttaacggtttccgggaacgggttacggttccgtacccgttacgggtttaccgggacgggtaacgggtaaaccccgtaaaaggttaccgggtaacgggttaaacccgtaaaaccggttacggttacgggttccgggtaccgttaccggacccgttaaacccgttacgtttacccgttaccgggtttaccctttaccgtaacccggttttcccccg

SEQ ID NO: 12321 - DNA, 965 bp, Homo sapiens
  misc_feature: GYAE6OF01B4LVO.10.71.G05.1.454.CMB.1.raw
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccacggataaattgtgttgacacagtctccagccacgtcttcgttcttttgtccgtaccggaagggggaaacgacgtcccctaacccgtcctccgtcggaccgacgggacccagtcaggtaggttcgttcgctacgtttcggtttagggttcggttaactacctaacgtaaacgtaaaacgttcccgggaccgtaacgggtaccccttaccccggaacggggtcccctttacccgtaccgtaacgttttaccggttttacggtacgtttaccggttccctttttacggaaaacccggttaccggggtacccccgttaggggtaccccggttacccggtaacgggtaccgtacgggtttacccggaagggttacggtaccggtacggtttcgggggtaccgttggggtaacccgttaacggtaacgtttcccgaaccgttccgttaacccgtaacccgtaccgttacgtaccggtaaccgtacggttaacccgtaaggtaacccggtaccggttaacggttaacgtttaacggttttacgtaccgttttaaggtttaaccgtttacgttaaccgttacgtacggttaccgtacggtaccggttaccggtacccggttaccgggtttacccggggacggggttaccggtaccggttacccgtacccgggttttaccgggggaccgggtaaaaccgggtaaaacccgtaaaacggtaaacggttaacggggtaaaccggtaaaaccggttaacggttaccggtacggtaccggttacggtaacccgttaaccgtaaggtttcccgtttaaccggg

SEQ ID NO: 12322 - DNA, 413 bp, Homo sapiens
  misc_feature: GYAE6OF01BRB4X.10.71.G05.1.454.CMB.1.raw
  modified_base (190)..(190): a, c, t, g, unknown or other
  misc_feature (190)..(190): n is a, c, g, or t
  modified_base (321)..(321): a, c, t, g, unknown or other
  misc_feature (321)..(321): n is a, c, g, or t
  modified_base (375)..(413): a, c, t, g, unknown or other
  misc_feature (375)..(413): n is a, c, g, or t
tcagcatagtagtgcacgaccggtgctcgatttagtgtcgtcgcaagagagagggggagagtgttagagggggcacttctccctctaacactctcccctgttgaagctctttgtgacagacttcactctcaccatcagcagcctagagcctgaagtattttgctagttttattactgtcagcagtcgtcncctacgttcgggcgggaggtcgcctacgtttcgggcgggaacggaaccaaaagtagaacggtacaaacgaactgtggctgacacctatctgtcttcacttccttcccgctatcctcgactacctattacgngtaccgtggacggtccgggtacgtggaccgaacgggcgaccgtaagtagcatcnnnnnnnnnnnnnnnnnnnnnnnnnnnnnnnnnnnnnnn

SEQ ID NO: 12323 - DNA, 687 bp, Homo sapiens
  misc_feature: GYAE6OF01DR461.10.71.G05.1.454.CMB.1.raw
  modified_base (215)..(215): a, c, t, g, unknown or other
  misc_feature (215)..(215): n is a, c, g, or t
  modified_base (668)..(668): a, c, t, g, unknown or other
  misc_feature (668)..(668): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctccagacaccacggagaaattgtgttgacacagtctcagccacgctgttctttgtcctccgaaggggaaanacgccctacccgtctcctgcgacgggccaggtcaggtagtgttcgctacgtttcggttagggtgtatacaaacaattaaactccggtactacggctcccgaggtccttccgtctattctttagacttcgtcctttacgaacgtaccgggtccccgtgggtcccgtacccgacggtcgtacggttacgaggtcggacgtagggttcgggtcgtacgggaacgtacgtaccttaccgacttccgtacgaacccgtagtacgacgacggaccgtacgaacgccgtaacggtaagttaacgtttcgttacgttaacgttttaagttacgttagtacgtacgtactacggtcggtccgtaccggttacgttcgggtccgggtaggtccgtccgtaccgtacgggtaccgggacggaaacgtaaagtacgaacggtaacgaacgtacggtagtgacgtnaccacgtatcgttcgtacg

SEQ ID NO: 12324 - DNA, 581 bp, Homo sapiens
  misc_feature: GYAE6OF01CGY0G.10.71.G05.1.454.CMB.1.raw
  modified_base (526)..(581): a, c, t, g, unknown or other
  misc_feature (526)..(581): n is a, c, g, or t
tcagcatagtagtgcacgaccggtgctcgatttagtgtcgtcgcaagagagaggggagagtgttagagggggcacttctccctctaacactcctcccctgttgaagcttctttgtgacagtacttcactctcacaatcagcacgcctaagacgtccctaggaaagttatttttgacttaagtttttaactttaccgtgttacgacgcacgccggttcgtcccgttaccggttttccggggcgggtaacgggttccgtaccccgtttaacggttttccgggggaaccggggaaaacgggtaaaaccctaaaaaaggtagggtaaaccgggttaaaccgaaaaacggtaacgttgggttacggaccgtcgaccctaaaccgttttacccgttgtttccttaccactttcccccgtttcccgaccttatttccgtaacacctaaccgtttaaccgtgtccggtacggttggggacggtcccggggttcgtaacgggaaccggaaccgggtcgtaacgtaacgtgagctnnnnnnnnnnnnnnnnnnnnnnnnnnnnnnnnnnnnnnnnnnnnnnnnnnnnnnnn

SEQ ID NO: 12325 - DNA, 766 bp, Homo sapiens
  misc_feature: GYAE6OF01BPGJA.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtcctcgaggggaaanagcccaccctctcctgcagggccagtcagagtgtcgctacttggttagggtgtatcaactataaactccggaccaggcctcccgaggcctcctcattcttgatcgtctttacaacgacgggcccctggccgtacccgaggtccgtaggttcaggtcggacgtaggtcgggtcgtaggggacctagtaccgtttcaaccgttcctaccacctactaccgacgtccgaacggtcccgtaaggaccgtccgttaagtaacgtaacttttcgacgttaccgtttaagttttaaccgttacgttcggttaccgacggttaccgacgggttcccgttccgtaccccggttacggtttacccggggtaccgggtaccgggttccgtaccccgttacccgggtttaccgggggaccgggtaaaccggggtaaaccgtaaaaaccgggttacgggtaaacgtaaaccccggtaaaacggtacggttacggggaccggttacggtacccgtaccccggtaaccttaaccgggtttcccttacggtttaccctttcgtacccgttttccccccgg

SEQ ID NO: 12326 - DNA, 620 bp, Homo sapiens
  misc_feature: GYAE6OF01A92MF.10.71.G05.1.454.CMB.1.raw
  modified_base (272)..(272): a, c, t, g, unknown or other
  misc_feature (272)..(272): n is a, c, g, or t
  modified_base (337)..(337): a, c, t, g, unknown or other
  misc_feature (337)..(337): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagactctcctgttctgcgtctggattcattctttagtaaatcgtggcatgtcctgggtccnccaggttccaggccacgggctggagtgggtggcagtatatacaatatgatgaactagttaaaatntaactagtaggataccttcgtacgaagggtcctaattccaactactcctacgagacactaattaccaaagaactagtggtatatctagacaaagtcgaacacgcctagaacgacggaccggaggaccggtagggttatttaacgtacgttagggttagggaaagttaaacgtcgttaaggtcgtacctagtacctacggttggttagtttggtaccggtacccggttaccggggaccggtaacggggtaacccgtcgggtaccctaccggttccgttcccggg

SEQ ID NO: 12327 - DNA, 728 bp, Homo sapiens
  misc_feature: GYAE6OF01DX6O4.10.71.G05.1.454.CMB.1.raw
tcagcatagtagtgcacgaccggtgctcgatttagtgtcgtcgcaagagagagggggagagccctggggaggaactgctcagttaggacccagagggaaccatggaagccccagctcagcttctcttcctctgctactctgctcccagacaccgacggagaaattgtgttgacacagtcctccagccacgcttgttctttgtcctaccgaaggggaagacgcccaccctcctacctcgcgacgggccagtcagtagttcgtcgcctacgtttcggtagggtcgtagtacaaactaagtaacgtccggaccgacggcctccgacggtcctccgtctcttctttgcttctaccgttacaaccggccggtccccgtcggcccgtcccgaggcgtacggttcgaggttcggacgtacgggttggtaccggtggtaccgtagtaccttaccgtaccttccgtaccgtaacctacgtcgtaacgccgtaccgtaccgtaacgggacttaccggtaaggttaacgtttacggttttacgtacttttaaggttttacttacgttccgactaggacctacggtccgttaaccggtaccgttacgggttacggacgggtttaccgtcgtacccggttaccggtccggggaaccgggaaccggtaaaccgtaaagtcgggaacggtaaacaaaccgggttacgtggtaccgtcgactaacgacccttgttcttaccggg

SEQ ID NO: 12328 - DNA, 761 bp, Homo sapiens
  misc_feature: GYAE6OF01AWFNW.10.71.G05.1.454.CMB.1.raw
  modified_base (314)..(314): a, c, t, g, unknown or other
  misc_feature (314)..(314): n is a, c, g, or t
tcagcatagtagtgcacgaccggtgctcgatttagtgtcgtcgcaagagagaggaggggggaggaactgctcagttaggacccagagggaaccatggaagccccagctcagcttctcttcctcctgctactctggctcccagacaccaccggagaaattgtgtgacacagtctccagccacgtctgttctttgtctaccgaggggaaacacgccaccctctcctgcgacggccagtcagtagttcgtcgctactttcggttagggtggtatacaacgtataaacgtccggaccacggcctaccgacgccttccnctacttctttgattcgtcctttaccgaaccgtaccgggtcccctagggcccgtacccgagggtaccgtaggttccagggtcggtacgacgggttcgggtcgtagggactacgtacgttacctccgtactaccaacctactaccgaagccgtaacgtaccgtaacgtacgaccgttaggtaacgttaacgtttcgttaactttaacgtttcgttaacgttcgtacggtagtacctacggtcggttacccgtaccggtaccggttttaccggggacgggtacgggttaccggtacccgtttaacccggttcggggtaaacccgggtaacgggaaaccgtaaaaggttaaccggtaacgggttaaaccgaaaacggttaccgttacggggtcggttactacccggaacgtaaccctacgttacccgggttctttaccgtccgttaacccg

SEQ ID NO: 12329 - DNA, 705 bp, Homo sapiens
  misc_feature: GYAE6OF01EFK97.10.71.G05.1.454.CMB.1.raw
  modified_base (203)..(203): a, c, t, g, unknown or other
  misc_feature (203)..(203): n is a, c, g, or t
  modified_base (525)..(525): a, c, t, g, unknown or other
  misc_feature (525)..(525): n is a, c, g, or t
  modified_base (531)..(531): a, c, t, g, unknown or other
  misc_feature (531)..(531): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagaccaccaccggagaaattgtgttgacacagtctccagccacgctgtctttgtctccgagggaangccaccctctcctgcgacgggccagtcagagtgttcgctacgttcggttagggtgtatcaacataaacgtccggaccaggcctccgagcctcctcactttcgtttgattcgtacctttacgaaccggtccgggtacccctcgggaccgtcccgaggtcacggtttcgaggttcggacgtacgggtggggttccgacggggaaccgtacgtacttccacttccctaccaacctatccgaacgcctaagtacccgttaaggaccgtaccgttaaggtaacgttttacgttttagaccgttaggtttttaacttacgttcgtacngtacgnggtccgttcgccgttacggttccgggacggtcggttcgtcccgtttacggttacgggacggtaaccgggaacctaaaggtacggtaaacggtaaccgtaaaccggtacgtggtcggtacctacggacctaaccgttcggttacttaccggttacttacccgtcggtttaccccg

SEQ ID NO: 12330 - DNA, 408 bp, Homo sapiens
  misc_feature: GYAE6OF01DDJMA.10.71.G05.1.454.CMB.1.raw
  modified_base (125)..(125): a, c, t, g, unknown or other
  misc_feature (125)..(125): n is a, c, g, or t
  modified_base (219)..(219): a, c, t, g, unknown or other
  misc_feature (219)..(219): n is a, c, g, or t
  modified_base (253)..(253): a, c, t, g, unknown or other
  misc_feature (253)..(253): n is a, c, g, or t
  modified_base (263)..(263): a, c, t, g, unknown or other
  misc_feature (263)..(263): n is a, c, g, or t
  modified_base (299)..(299): a, c, t, g, unknown or other
  misc_feature (299)..(299): n is a, c, g, or t
  modified_base (339)..(339): a, c, t, g, unknown or other
  misc_feature (339)..(339): n is a, c, g, or t
  modified_base (344)..(344): a, c, t, g, unknown or other
  misc_feature (344)..(344): n is a, c, g, or t
  modified_base (346)..(408): a, c, t, g, unknown or other
  misc_feature (346)..(408): n is a, c, g, or t
tcagcatagtagtgcacgaccggtgctcgatttagtgtcgtcgcaagagagagggggaacatggtgtatctgcaaatgaccagcctgagagccgaggacgacgggttgtttattactggtggganaaatcctagtggcatcacctggtattgtgacgttccggggcagggaaccgtggtcaccgtctcttcggcctcacaaggccatcggtcctccccngcgccctgctccaggacgcaccgtcgagacgcanaggccgcccngggcctgcctggtacaaaggcctactccactactangctggaggtcggctacggacaagggccactagaagcatcncgtangnnnnnnnnnnnnnnnnnnnnnnnnnnnnnnnnnnnnnnnnnnnnnnnnnnnnnnnnnnnnnnn

SEQ ID NO: 12331 - DNA, 837 bp, Homo sapiens
  misc_feature: GYAE6OF01DKIGK.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaactgctcagttaggacccagaggaaccatggaacgccccagctcagcttctcttcctcctgctactctgctcccagaccaccgaccggagtaattgtgttgacactagtcctcagccacgctgttctttgtctaccgagggaanacgcccaccctctcctgacgacgggccagttccagtgtcgttcgctacgtttcggtagggtgtatacaactagtaacgtcccggactacgccctaccgacggtcctccttactacttcgtttagaacttcggttactttacccgaaacggtacccgggtcccccgttcgggacccgttaccccggagggtaccggttaacgggttccgtacgggttacggtccggtaaggggttcgggttaccggtacgggaaccgttacggtaaccgtttccgaaccttaccctacccgaccgtaactcgaacggtccgaaccggttccgtaaggtaccgttacccggtaaaggttaacgttttacggttttacccggttaactttaacgggtttttaactacccggtttcgtaaccgtacggtaccgtacgggttccgttaacccgtcccgtttaaccggttttcgggaacgggttacggttaccgtacccggtttaccgggttaccgggacgggtaaaccggtacctaaaaggttacccgggagtaaacccgtaacggtacgttacggacggtacgttacgacccgttagttaccctacggttactttccgtttaaccctcccggttttcccaacccccgg

SEQ ID NO: 12332 - DNA, 935 bp, Homo sapiens
  misc_feature: GYAE6OF01DZH8F.10.71.G05.1.454.CMB.1.raw
tcagcatagtagtgcacgaccggtgctcgatttagtgtcgtcgcaagagagagggggcctccattcggtgatcagcactgaacacagaggactcaccatggagtttggctgagctgggttttcctcgttgctcttttaagagatgtccagtgtcagatgcagatggtggagtcgtgggggaggcgtgggtccggccgtgggggtccctggacgctctcctgttctgcgtctggacttcattctttaagtaaactcgtggctagttcggttccgttacggggtcccgtaccgtacggttcccacgggtaccccgacggggtcctaggggtaacgttggggggtacggaccgtaaggtaacttaacgttaaaccgtaaaagtttagttaagggtaaattaacgggaaaacttaaaaggttaaaaaaaaagtttacttaaaccgttaaagttacggggtaaaccgttaaacccgttttaccccgttaaccgggaaaacgggggtcccccgtaaattttaccccaaacccgtactttacccgtaaccccgaaaaggtaaaccgtaaacttaaaaccgtttaaccccgaaaaagttaaacccgtaaggtttagggttaaacgtttaacttaaccgttaacggaaacctaaaacgttacccggaaacccgtaaccgtaacccgttaggaaccggaacgggtaacccggtaacgggtaaccggttaacggggttttacttttaacggtttaaccgggttaggggttaacgggtaaacgttaaacgtcccggttaaaggtaccggtaccgtaaccgttacccggttaaccgtttcgggttaagttttcggtaacccgggttaaccccgggttacccggggaacccggttaacggggtaacccgttaccggggttaccctaccccgggttccgttacccccggg

SEQ ID NO: 12333 - DNA, 414 bp, Homo sapiens
  misc_feature: GYAE6OF01AMS6K.10.71.G05.1.454.CMB.1.raw
  modified_base (316)..(316): a, c, t, g, unknown or other
  misc_feature (316)..(316): n is a, c, g, or t
  modified_base (375)..(414): a, c, t, g, unknown or other
  misc_feature (375)..(414): n is a, c, g, or t
tcagcatagtagtgcacgaccggtgctcgatttagtgtcgtcgcaagagagaggggagagtgttaggagggggcacttctccctctaacactctcccctgttgaagctctttgtgacagacttcactctcaccatcagcacgcctagagcctggaatatttgctagttttattactggtcagcagcgtcgcctacgtttcgggcgggaggtcgcctacgtttcggtacgggagggaaccaaaagtaggaggtacaaacgaactggtaggctgcaccattctacgttcttctcttacccgtcccgactattccgtanaacctacgtactaacgtggcctggacggtccggcgtacggaggtaacggcaccgatagnnnnnnnnnnnnnnnnnnnnnnnnnnnnnnnnnnnnnnnn

SEQ ID NO: 12334 - DNA, 1168 bp, Homo sapiens
  misc_feature: GYAE6OF01CJ0MX.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccgaccggagaaattgtgttgacacagtctccagccacgctgttctttagtccgtccgaaggggaaacgacgacccacccgtcctccgtggaccgacgggccctagtcgtaagtacggtcgttaccgctcggtttaccggttaggggttgtaaacgtaccaaacgtaacgtaaaacgtccccggaccgtacgggtacccttaccccgaacgggtccccttaccccgttcctaaacgtttccgtttttacggtaccgttacccggtttaccgtttttaacccgtaacccggtaacccggggtcccccccgggtttacggggtacccccggttacccccggtaacggggtaccccggttaaccgggttttaccggtaacgggttccggggttaccggggttaacgggtttccggggggtttaaccggggttaaccgggggtaaacccgtaaccggtttaacccgggttttaaccctaacccccgtttacccgttaccccggttaaacccgtaaccgttcccgtaacccggtaccggtaacccgggtaaccccggttttaaccggggaaccgtttaaccccgggtaaacggggtttaaaccggtttttaacgttttttaccggtaaccggttttttaaaacgtttttaacggtttacccgtttaccggtttaaacccgtaccgggtttaacccgtaccgggtttcccgggttaccggtttaaccccgggtttaaccgggttttaccccggggttaaccccgggggtttaaccggggttacccccgggtttaaccccgggttttaacccggggtttttaccccgggggggaacccgggttaaacccggggttaaaccccggtaaaaccgggttaacgggtaacccggtaaaccggggtaaaaacccggtttacgggttaaccggggttaacccgggttcggttaaccccgggacccgtttaaccgtaaccgttttaccgtttacccgtttacccccggtttaaacgtttcccccggtttttaccccccgg

SEQ ID NO: 12335 - DNA, 635 bp, Homo sapiens
  misc_feature: GYAE6OF01D7OHI.10.71.G05.1.454.CMB.1.raw
tcagcatagtagtgcacgaccggtgctcgatttagtgtcgtcgcaagagagagggggcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggtattctatctttagtaaatcgtggctatcgtccgtgggtcccgccgtaggttccaggcccgacgggtctgggaagtggggtggcaagatatacgaatatgatagaactaagtaaaattataacgtagtagagtaccttccttacgaaagggcccgtaattaccgaaccacgtacctacgaagtaacgaacctaaacgttaaccctaaagaaccgtagttacggttacgttaattcgtagaactaaagtacgaacccgaagcccgtagaacggacggtaccggaagggtacgtaacgggtttatttaacgtagttggtaggaagtaactcgtagtgacactctacgtgttattggtcggtacgttccgggacgtaacgggtacgtggtaccctcgttcctccgg

SEQ ID NO: 12336 - DNA, 743 bp, Homo sapiens
  misc_feature: GYAE6OF01AHYWK.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctcccagacaccaccggagaaattgtgttgacacagtctccagccacgctgtcttgtctcgagggaaancgcccaccctctcctgcgaggccagtcaggtagtcgttccgctacgtttcggttagggtgtacacaaacactaacgtcccggaccgaggtcccttccgaggtcctcctactattccgtttagacttcgtactttaccgaacgtcccgggtcccctagggtcccgtacccgagggtccgtaacggttcgaggtcggcgtaggtgggtaccgtgggactagtaccttcgaccgtcctaccgaaccgtactacgacgtccgacgtcccgtaaggcccgtaccgtagttaacggttcttttacgacgttttaacgttttactacgttcggtacacggtacgacggttccgtacgtacccgttacggtttcgggacgggttacggtcccgtaacggttccgggtacgggtaacggtaaccggtaaacgtaaacggtcggttaaccggtaaaccgaaacggttaccggttagggtaccgacgttaccgaaccccgtaacgttactttaccggttacgttacccgtttcccgtaaccgtttacccccg

SEQ ID NO: 12337 - DNA, 877 bp, Homo sapiens
  misc_feature: GYAE6OF01EVJ7D.10.71.G05.1.454.CMB.1.raw
  modified_base (160)..(160): a, c, t, g, unknown or other
  misc_feature (160)..(160): n is a, c, g, or t
  modified_base (164)..(164): a, c, t, g, unknown or other
  misc_feature (164)..(164): n is a, c, g, or t
  modified_base (169)..(169): a, c, t, g, unknown or other
  misc_feature (169)..(169): n is a, c, g, or t
  modified_base (210)..(210): a, c, t, g, unknown or other
  misc_feature (210)..(210): n is a, c, g, or t
tcagcatagtagtgcacgaccggtgctcgatttagtgtcgtcgcaagagagagggggggaactgctcagttaggacccagagggaaccatggaacgccccagctcagcttctcttcctcctgctactctggctccagacaccaccggataattgtgttanacanagtcnccagtccacgtcttgttctttgtctaccggaaggggaaacnccgtccctacccttctccgtggccgtaggggccctaggtaccaaggtacgttcgttccggtactaccggtttgggtttaaggggtagtaactacctaaacgtaacgttaaaccgtcccgggtaccacgggtccctacccgtaacggtcccttcctacctacgttaccgttttgaacgtttccgttaccgttttacccgaaacccgggtccggggtacccccgttagggccccgttacccggaacgggttccgttaacgggtttcgtaaggggtcggacgtagggggttcggtccggtacgggaactacgttaccgtttccaaccgttcctaaccgtactaaccgtcaacggaccgtaacgacccgtaaggtaccgtaccggtagttaacgtttcgtttacgtaacgtttagttttacttaccgtggtacccaggtcgtaaccgggttctaccggttacccggttacgggttaccgggtcgggttaaccggttcgttaccccggttacgggtttaacgggggaacccgggtaacggtaaaccctaaagggttaacggaaccggttaaacccgaaaacgggttacggttacggtacggtcccgtacgaacccgtacgttaccgtttacggtccttttaactcccgtttaaacccgtccccggttaaccc

SEQ ID NO: 12338 - DNA, 761 bp, Homo sapiens
  misc_feature: GYAE6OF01BTWGT.10.71.G05.1.454.CMB.1.raw
  modified_base (210)..(210): a, c, t, g, unknown or other
  misc_feature (210)..(210): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctccagacaccaccggagtaaattgtgttgacacagtcctccagcccacgtcttgttctttgtctccgaaggggaanacggcccacccgtctcctgcgacgggcccagtcaggtagttcggttccgactaccgtttcgggttaggggtcggtaataccaaagtacttaaacgtcccggacgacggtccctcccgacggtcctaccctcgtaacttttcgtttagtacgttcgttacctttaccgaaccggtccggggtccccttacgggccccgtaccggacggtcggttaacggtccgtacgggtggtacgtgggttcggggtacgtacggggaccgtacgtacccgttccaaccttccgtacaaccctagtccgaacgtaccgaccggtaccgtaacggtaccgaccggttaattacggtttacgtttacgtaacgtttaacgttttacgtttacgttacgtacgagtccgtacggtccgttcctaccggttcggttacggggacgttacggtccgtaccgttcgggtacggacgggtaacgtaacgtaagtaacgggacgtaacgaacggttcgtaggtcgacgtcgacccgtattacgtcttaggtccttccgtaccgtttccc

SEQ ID NO: 12339 - DNA, 788 bp, Homo sapiens
  misc_feature: GYAE6OF01DFS4A.10.71.G05.1.454.CMB.1.raw
  modified_base (293)..(293): a, c, t, g, unknown or other
  misc_feature (293)..(293): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccagtggtagtttgggctgagcgttgggttttcctcgttgcttacttttaaaggagtatcgtccagtgtacagatgcagtagtggtggagtcggtaggggggacgtcggtcggtcccggccggttcggggggtaccctggacgtaccgtccttccggtgttccgnggtcgttcggtggtacttacgtatttacgtttaacgtaaacttcgtacggtacgttagtccggttccgtacgggtccgtacccgtaggttacccgacggccgaacgggtgtaggaacggtggggtagacgaataacgttagtaaacaaattaggtaacgtaagtaacggtaaaccgtaaaaaggttaaaaacttaacttaacgttaagggtaaccggtaaacgtaaccccgtttcggttaaccggaaacgggtaccttaaccgttaacccaaccttaaccgtacccttaaccgtaacggaaacgtaaaccgtaactttaaccggaaaacgtaacgtagttacggtaacttacgtaacgtacgaactaaacgtacaaccgtacgtaccgtagaaccggacggaaccgagggtaaccggtaacggtttagttaacgtacggttagagggtaaacttaaacgtcgtagtcgactaacgttacccgtaggtgttaacgg

SEQ ID NO: 12340 - DNA, 645 bp, Homo sapiens
  misc_feature: GYAE6OF01AWZM9.10.71.G05.1.454.CMB.1.raw
  modified_base (174)..(174): a, c, t, g, unknown or other
  misc_feature (174)..(174): n is a, c, g, or t
  modified_base (212)..(212): a, c, t, g, unknown or other
  misc_feature (212)..(212): n is a, c, g, or t
  modified_base (385)..(385): a, c, t, g, unknown or other
  misc_feature (385)..(385): n is a, c, g, or t
  modified_base (491)..(491): a, c, t, g, unknown or other
  misc_feature (491)..(491): n is a, c, g, or t
tcagcatagtagtgcacgaccggtgctcgatttagtgtcgtcgcaagagagaggaggggggaggaactgctcagttaggacccagagggaaccatggaacgccccagctcagcttctcttcctcctgctactctcggctccagacaccacggagaaattgtgttgacacagtcnccagccacgtcttgttctttgctaccgaggggaaagcnccaccctctcctgcgacggccagtcagagttcgttcactccgttggtagggtcgtatacaataattaaacgtcccgggactacggtcctacccgtaagtcccttaccttagctttcgtttagtactttcggtacctttaccgaaccgtccggggtcccctggtcccgtaccgnggtacgtaaggtttccgaggttcggacgtgggtcggtcgtaggaactcggtaccttcgactcccgtacacgctacgaagcctagctaacgcgacgtagtattgttnacgtttagttatctcgtacgtgctacgtcgtaccgtcggttacgttacgggcgtgggtaccctaccggtacggttacgggacgtaacgggactaaagtagaaccgtagaacgtagtggctacggcgacccagttacgtacgtctcgtagtcccg

SEQ ID NO: 12341 - DNA, 749 bp, Homo sapiens
  misc_feature: GYAE6OF01ANKEF.10.71.G05.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagtaaattgtgttgacactagtctcagccacgctgtctttgtctccgaggggaacngcctacccgtctacctgcgagggccagtcaggagtcgtcgctacgttggtagggtgtatacaacgaattaaacgtccggaccacgggtcctacccgacggtcctaccccgtctaactttcgttcggtactacgttccttaaccgaacgacccgggtccccgtacgggtcccgtaccccgaggtccgtaggttacgaggttccggcgtaagggttccgggtacggtcggggtaacctacggttacttccgtaaccgttccacccgtaaccctagtccgaacgtacaacgaccgtacggacgtaccggtaagtaacgttaactttcggaacttaaggttttaccagttacgtctaggtctacggtcgttcgtacccgttacggtccgggtacggttacggtccggtacccttacgggtttccgggaacgggtaacgtaaacccggtaaaaggcggtaaacggtaaccgtaaaccggtaggttaccgtacggaccgtagaacccgtactaccgttacgtccgttaccttccgtaacccgttacccgg

SEQ ID NO: 12342 - DNA, 795 bp, Homo sapiens
  misc_feature: GYAE6OF01EA02N.10.71.G05.1.454.CMB.1.raw
  modified_base (273)..(273): a, c, t, g, unknown or other
  misc_feature (273)..(273): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctcccagacaccaccggagaattgtgttgacacagtctccagccacgctgtctttgtctcgaggggaaagacgcccaccctctcctgcgacgggcctagtcagagttcgtacgctacgtttcggttagggtgtatacaanaataacgtcccggcacggtacctcccgaggtcctcctctatttcctttgacgttcgttacctttaccgaaccgtaccgggtccccgttacgggccccgtcccgaggtcgtacggttcgaggttcggcggtacggttcggggtaccgggtaggtacgtacgttacgttaccgtaccttacctacctactacgtaccgtaaccgaccgtaccgtaacccggtaacggtaccgtaccggtaagttaacggttttaactttacggtaacttttaacgtttaacgtttacgttacggtacgtaccgtacgtaccggtccgttaccggttaccgtttccggggtaccggtacggggttcgtacccgggtttacccggttaccgggtttaccggggaaccggggtaaacgtaaaaccgtaacgggtaacggtaaccggtaaaccggaaaccgttgggtacggttaccggtacgttaccgaaccgtaaccttcgttaccgttaccttaccttacgttcccttacccccgg

SEQ ID NO: 12343 - DNA, 752 bp, Homo sapiens
  misc_feature: GYAE6OF01A6C4I.10.71.G05.1.454.CMB.1.raw
  modified_base (149)..(149): a, c, t, g, unknown or other
  misc_feature (149)..(149): n is a, c, g, or t
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccgganaaattgtgttgacacagtctccagccacgctgtctttgtctccgaggggaaancgccacctctcctgcaggccagtcagagtgttcgctacttcggttaggtgtatacaaacgtataaaacgtccggacaacggtcctcccgaaggtcctccttctaattccgttagtactgtcctttacaaccggccgggtaccctggcccgtccgaacggcgtaagggtttccagggttcggacgtaggttcgggttcgtcgggaaactacggtacctttcgaacttccgtacaaccgtatcaaggcaacgtaccgtaagacgaccgttagaacgttacgttttcggaccttagttttaacttacgtcgtaccgaaggtcgtaacggtccgttcgtaacccgttaccggttcgggacggtaaccgggtcgtaaccccgttagggtttaccgggacccgggtaaacggtaacccgttaaaaagtacgggtaacggttaaaccgaaaaaccggtaacggttacgggttaccggaacccttccggaaccctaaaccgttccgttaaccgtacggtttacccctttaccgaaaccgttcccccgttaaaccccgg

SEQ ID NO: 12344 - DNA, 841 bp, Homo sapiens
  misc_feature: GYAE6OF01A57J8.10.71.G05.1.454.CMB.1.raw
tcagcatagtagtgcacgaccggtgctcgatttagtgtcgtcgcaagagagagggggagagccctggggaggaactgctcagttaggacccagagggaaccatggaacgccccagctcagcttctcttcctcctgctactctggctcccagacaccacggagaaattgtgttgacacagtctccagccacgctgttctttgtctaccgaaggggaaacacgcccacccttctccgtggaccacggggtccagtcgaggtagttcgttcgacgttacgttcggttagggtgtactacaaacgtataaacgtccggacacggccttcccaggccttcctactattcttttaggacgttcgtaccgttttacgaaccgtccggggtaccccttcggggtacccgtcccgacgggtacctacggggtttaccgacgggttacgggtcgttaacggggttcgggggtaccgttacggggaactacggttaccctttacctaacgttccctaaccgactacgtaccgaacgcgtaacccgtaccgtaacggtacgttacccgtaaggttaacggtttaaccgttttcggtaacgttttaacggttttaacttttacgtacggttaccggtaagttacccggtaaggttcccggtttaccgtacccgtttaccgggggtttacccgggtacgggttacgggttacccggttacccgttaacggggttttaccgggaacggggttaaaccgggtaaaccgtaaacgggtaacgggtaaccggtaaccggaaaacgggttaccgtgggtacccgtaccgtacggaacccgttacgttcgttccggttacg

SEQ ID NO: 12345 - DNA, 881 bp, Homo sapiens
  misc_feature: GYAE6OF01BU5IW.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagcttgggttttcctcgttgcttcttttaagagtatgtccagtgtcagatgcagtagtgggtggagtcggtgggggaggtcggtcgggtcccggccggtcggggggtccctaggacgtaccttccgttccttcggtttcctcggtccgttacgtcggttactttcctaacgtttacttttaagtaaacttcgtacggtctacgttcggttcccggtcggggtcccgtccgtaacggttcccgaacgggtacccgtacggggcgttaggaaggttcggggtcggacgtaggtaactaacgttaactaattacgtagtaattagaaacgttaaaagttaaaattaccgttaagtaagtacggtacgttaccttacccgtacggaaaccggtaccgtactttacccaaccctacttaccctaaccgaacgtaaacgtactaaaccttaaccgaaacgtaacgtacgttacgttacgttacgtacctacggtaaactaacgtaaccgtacccggtaacggtacccgtaagggtaaccgggtaaccggtaaccgggtaacgggttaacccggtttaacggggttttaacttttaaaccgggtttcgggttaaggggtaacgggttaaacgtaaccggttaccggttaggtacgtacgttacgtacccgtttaacgggttcggtttacggtttcggttccgggtacccgggttacccggggaacggttaccgggtaccggtacccggttcccgtacccgttcccggttacccgg

SEQ ID NO: 12346 - DNA, 810 bp, Homo sapiens
  misc_feature: GYAE6OF01ATUDG.10.71.G05.1.454.CMB.1.raw
tcagcatagtagtgcacgaccggtgctcgatttagtgtcgtcgcaagagagaggggggaactgctcaggttacggacccagagggaaccactgggaacgccccagctcgacgtcttcgtcttcctccgtgcctactcgtcggctccacgacaccgtaccgggacgtaaattgtcgtttcgacctacgtacgtcctcctagccacggctgtctttgctccgacgggtaagacgtccacccgtctcgtcgacgacggtacagtcgtacgacgtgttccgcgtacgttacggtagggtgtaactacgaaactacgtaacgtccggtcacggtcctccgacgtcctcttcgtacttcgtttggactcgtaccttaacggaaccggtcgggtacccgtcggtacggtcccggtaaggtccgttaagggttccgaggttcgggtaccgtacggggttcggtacgtacggggactacggttaccgtccgttaccgtaccttaccgacctactacccggaagtccgtacggttaccgtaacggtccgttaccgttaagaacgttttacgttaccgaaactttacggttttaactacgtacgtaccgttaaggcctacggtcgttcccggtaccttccggggttaggccgtaacggttcgtaacccgttcggggttaaccggaccggtaacggttaaccgtaacgtacgggtacccgtaaaacggaacgtttcggttaccgggtcgttaacccgtacgttaccccgaagtttacccgttacctcggtttaaccctacccgtagtttccccggtacccgg

SEQ ID NO: 12347 - DNA, 756 bp, Homo sapiens
  misc_feature: GYAE6OF01BGQB1.10.71.G05.1.454.CMB.1.raw
tcagcatagtagtgcacgaccggtgctcgatttagtgtcgtcgcaagagagaggggggaggaactgctcagttaggacccagagggaaccagtggaagccccagctcagcttctcttcctcctgctactctggctccagacaccgaccggagtaattgtgttgacacagtcctccacgccacgctgttctttcgtcgtccgaagggaacgcgccctaccctcctccgtgcggacggccagtaccgagtagttcgtcgactacggtttcggttagggtaggtaactacgaaactaacgttaaaccgtcccggaccgtacggtccctacccgacggtccttaccgtactacgtttcgtttagtacttacgttaccttaccgaaccggtccgggtcccgtcgggtccgtacccggagtcgtacggtcgtaggtcggtcggtcggtacggtacggtaggacgtacgttaccgttactaccgtacctacgaccgtacgtaccgagaccgtacgacgtacggaccgtgttaagttaacgtttgtttacgacgttttaagtttacgtacgtcggaacgtacgaccgtacgttccggttaccgtccggtttacgggtccggggaacgttccggtacccgttacgttaccggggttacggaaccgggtaaacgaaaccggttaagtacgggtaaaccgtaacgtaaacggtgttaccggcgctacgaccttaacgtctttccgtacttcctacgtccgtaccccg

SEQ ID NO: 12348 - DNA, 658 bp, Homo sapiens
  misc_feature: GYAE6OF01A49TO.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccgaggggaanagccaccctctcctgcagggccagtcagagtgttctctacttcggttagggtggtatacaactataaactccggccaggcctcccaggcctcctctattccttagactgtcctttacacgtacgggtcccctaggcctcccgaggccgtaggttcaggtcggcgtaggtcgggtctggggacaggtactttccacttcctccaaccatacgacgtccgacgtaccgtagtacgtccctagtaacgttattttcgacgttagtttacttactcgtacagctacgtccgttacgtcctaccggttttccgggacggtacgggttccgtacccgttacggtttcgggacgggtaacggtaaaccgtaaagttacggaacggtaaccgtaaaccgtaggtcggttagggctcgacctaccgtacgttacttacgttcttccgtaccgttccgttacccccgg

SEQ ID NO: 12349 - DNA, 762 bp, Homo sapiens
  misc_feature: GYAE6OF01A1PFN.10.71.G05.1.454.CMB.1.raw
  modified_base (567)..(567): a, c, t, g, unknown or other
  misc_feature (567)..(567): n is a, c, g, or t
  modified_base (574)..(574): a, c, t, g, unknown or other
  misc_feature (574)..(574): n is a, c, g, or t
  modified_base (592)..(592): a, c, t, g, unknown or other
  misc_feature (592)..(592): n is a, c, g, or t
  modified_base (608)..(608): a, c, t, g, unknown or other
  misc_feature (608)..(608): n is a, c, g, or t
  modified_base (618)..(618): a, c, t, g, unknown or other
  misc_feature (618)..(618): n is a, c, g, or t
tcagcatagtagtgcacgaccggtgctcgatttagtgtcgtcgcaagagagaggggagagtgttagaggggcacttctccctctaacactctcccctgttgaagctcttgtgacagacttcactctcaccatcagcagcctagagcctgaagtatttgctaagtttattactgtcagcagtcgtgcctacgtttccggcgggtaacggtgacccgtaacgtttcgggacgggtaacggggaaacctaaaaaagttacgggaaagggttaaccaaaaaccggtaaccgttaggttacgggacccgttacggaacctaaccctaaggttacctttaccggtttccttttaacccaacgttttccccttacccccggtaacctaactttaccgttaaccggaaaccgttaaaccgtttaaaccttaaacggttccgggtaccgtttacggggaaaccggggttcccggggggtaacctttacgggggaaccgtaaaaacggggcccggttaaccgaaaagtttaaccgggagtactagacgtacgtacgtacgtacacgtacgacgtacncgacganacgagacacagtacgtanacacgacgtacgatanacacgacganacgagtagacgtacgacgtacgtacgtcgtactacactacgagtacgtacgttaacgtacgtactaagtaacgtaagtacgaacgtagtacgtacgtactacacgtacgtaacgtacgtaagtaacgtaactaacgtactaacg

SEQ ID NO: 12350 - DNA, 682 bp, Homo sapiens
  misc_feature: GYAE6OF01AU2LL.10.71.G05.1.454.CMB.1.raw
  modified_base (203)..(203): a, c, t, g, unknown or other
  misc_feature (203)..(203): n is a, c, g, or t
  modified_base (323)..(323): a, c, t, g, unknown or other
  misc_feature (323)..(323): n is a, c, g, or t
  modified_base (637)..(637): a, c, t, g, unknown or other
  misc_feature (637)..(637): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaaggggaaancgcccaccctctcctgccagggccagtcaggtacgtgttccgctaccgtttggttacgggtgtactactaaacataaacgtccggaccaggccttcccgaggtcctccgtctattcttgntcgtctttacgaaaccgtcggccctggcccgtaccgacgtcgtaggtccgagtcggtctacgggtcgggtcgtacgggtactacgtacttaccgcctactaccacctatccgacgcacggtccgtaagccgtaccgtagtaagttacgtttgaccgttaagttttaagtaccgttgtacgtaacggtcctaggtaccgttacggtaccctttaccgggtttcgggacgggttacggtcctaacccgggttcggttaccggggaaggttaaccggaaaccgtaagtacggaccggttaaacaaccggtagtcggnggaccgtgaccctgtactcgtactacgttcctcgttcccgtaccc

SEQ ID NO: 12351 - DNA, 756 bp, Homo sapiens
  misc_feature: GYAE6OF01C7K5A.10.71.G05.1.454.CMB.1.raw
  modified_base (286)..(286): a, c, t, g, unknown or other
  misc_feature (286)..(286): n is a, c, g, or t
  modified_base (354)..(354): a, c, t, g, unknown or other
  misc_feature (354)..(354): n is a, c, g, or t
  modified_base (362)..(362): a, c, t, g, unknown or other
  misc_feature (362)..(362): n is a, c, g, or t
  modified_base (367)..(367): a, c, t, g, unknown or other
  misc_feature (367)..(367): n is a, c, g, or t
tcagcatagtagtgcacgaccggtgctcgatttagtgtcgtcgcaagagagaggggggcctccattcggtgatcagcactgaacaacagaggactcaccatggagtttgggctgagcttgggttttcctcgttgcttcttttaagagattgtccagttgtacagatgcagagtgggtggaggtcgtgggggaggcggtcgggtcccggtccgtggggggtccctgacgtacctcctcgttgttctcggacgtctaggtacttctagtttactttaagtaaattcgnggactatcgtccgtggtccgccgtacgggtccgggacgacgggtcgaggtagtgggtagcgaagatanaataatangatanaactaagtaaaatataacagtagactactacgttagaacggtccgtaattaccaacctactcttaccaaggaactaaacaacgttaaccaaagaacctagtagttaccgtaatccgtataagtaaactacgacccgtaacgtagtacggaacggaacggtaacccggtaaccgggtaacgggttaacgggtttaacgtttttaacgttaacgggtagggtttaaccgggaaacgttaaggtttacccgtagggtacgttacggtaacccttccgtaaaccggttggttaaaccggtagtttacccgggtccgggttaacccgggtacggtaaccccggggtaccgttacgggtaccctttaaaccggttccgttcccggttaccccggg

SEQ ID NO: 12352 - DNA, 637 bp, Homo sapiens
  misc_feature: GYAE6OF01ETYQC.10.71.G05.1.454.CMB.1.raw
  modified_base (207)..(207): a, c, t, g, unknown or other
  misc_feature (207)..(207): n is a, c, g, or t
  modified_base (237)..(237): a, c, t, g, unknown or other
  misc_feature (237)..(237): n is a, c, g, or t
  modified_base (298)..(298): a, c, t, g, unknown or other
  misc_feature (298)..(298): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaatttgtgttgacacagtctccagccacgctgtatttcgtctccgaggggaaanacgccaccctctcctgcagggccagtcagngtgttcgctacttcggttagggtgtactcaacataaactccggcaggcctccaggctcctnattctttgatgtctttcaacgtacgggcccctgggccgtccagggctacggttcaggttcggcgtaggtcggggttcgtacggggaactaggtaaccttccgtaacttccgtacccaaccctattcgacgacacggacctaaggacgtccgtagaaagtttctttagacttaagttttaacttacgttggtacctacgtcgtacggtcgttcgaccttacggttccgggacgggtacgtcgtacccgtaggtttccgggaccggaacgggaacctaaaagttcggaaggtaacaacgtacgtggtaggctcgaccacgtactcgtatccttgcttcccg

SEQ ID NO: 12353 - DNA, 756 bp, Homo sapiens
  misc_feature: GYAE6OF01CRQPE.10.71.G05.1.454.CMB.1.raw
  modified_base (359)..(359): a, c, t, g, unknown or other
  misc_feature (359)..(359): n is a, c, g, or t
  modified_base (375)..(375): a, c, t, g, unknown or other
  misc_feature (375)..(375): n is a, c, g, or t
  modified_base (630)..(630): a, c, t, g, unknown or other
  misc_feature (630)..(630): n is a, c, g, or t
tcagcatagtagtgcacgaccggtgctcgatttagtgtcgtcgcaagagagagggggcctccattcggtgatcagcactgaacacagaggactcaccatggagtttggctgagcttgggttttcctcgttgcttacttttaagagtagtgtccagttgtcagactgcagagtggtggtagtcggtgggggaggtcggtcgggtcccgggccggtcggggggtcccaggacgtacctcctccgttcgttcgtcggcgttcgtgtacttcgtaatttacgtttaagtaacgttcgtggactgtcgtccggtcgggtcccgaccggtcgggtcccgggccgacgggtcgtaggtagtcgggngacaagtataacgaanaatgagagtacgaacgtaaaagtaaactagtacgtagtacggacgtaccttcgtaacgaacggtaccctattaccgactactactacgaagaacctaactaacgttaaccgaaacgtacgtagttgggttaatacgttacgtagaaacctaacgtacccggaccgtaccgtcggaaggaacggacccggtacgggtaacggtaaccggttcgggtttttaattaacggtttcgggaaggttaacggtaaaccgtnttaccgggtagtacgtaccgttctaaccggtcggtttaggttctcggggttaacccgccggggttacccgggaggttaccgggtacccgtttcccgaccgtttcccgtcccggttcccgtccccgg

SEQ ID NO: 12354 - DNA, 676 bp, Homo sapiens
  misc_feature: GYAE6OF01EV3PY.10.71.G05.1.454.CMB.1.raw
  modified_base (524)..(524): a, c, t, g, unknown or other
  misc_feature (524)..(524): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgttctttgtctccgaggggaaagacgcccaccctctcctgcgacgggccagtcagagttcgttccgctacgtttcggttagggtgtatacaacataaactccggccaggcctcccaggcctccgtcattcttttgatcgtcctttacgaaccgaccgggtcccctggccggtacccgaggccgtaggttcgaggtcgggctaggtcggtcgtgggacaggtacttcactctaccaccatacgagccgacgtacctaggcgtccgtagtaagttacgtttcgaacgttagtttacgttacgtagtcgtacgtcgaggtccgtacgtcccgttacgttaccggggnggtacgggtccgtcccgttacgggtttccgggacgggtaacgggaaaccttaaaggacgggtaacgtaaccgtaaacggtaacgttggacgggtacgtcggacccgtaacgttactcgttacgttaccgttacttccgttccgttacccccg

SEQ ID NO: 12355 - DNA, 908 bp, Homo sapiens
  misc_feature: GYAE6OF01BDVCP.10.71.G05.1.454.CMB.1.raw
  modified_base (236)..(236): a, c, t, g, unknown or other
  misc_feature (236)..(236): n is a, c, g, or t
  modified_base (879)..(879): a, c, t, g, unknown or other
  misc_feature (879)..(879): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaaggggaaagacgccaccctctcctgcgagggccagtcagngtgttcgctacgttcggttagggtggtatcaactaataaacgtcccggaccacggccttcccgaggtcctaccctctaacttcgttttagatcgtcctttacgaacggtaccgggtcccctgggccgtcccgagggtcgtacggttaccgagggttacggccgtagggtttccggggtacgttagggggaaccgtagggtttaccctttaccgacccgttacccgtacctaaccctaacgttaccgaaccggtaccgtaaccggtcccgttaacggggacccgttaaccccgttaagggtaaaccggtttccttttttaacgggaaccggttttaaacggttttttaacgttaccccggtttaggtaaccgaacgggttaccggtaacgggtaccccggtttaccggtaccccgggttttaccggggtttaccgggggtaaccgggggttaggttaccccgggtacccggtttttaaccgggggttttaaccccgggggacggggttaaaaccggggtaaaccccgtaaaaaggggtaacggggttaaacgggtaaacccggttaaaaaccggttaaccggggttgggggttaccggtacccgtttacgggaccccttaaaccggttacttaccccgggtttnttacccgttttacctcccgttacccccgg

SEQ ID NO: 12356 - DNA, 725 bp, Homo sapiens
  misc_feature: GYAE6OF01BRMIS.10.71.G05.1.454.CMB.1.raw
  modified_base (203)..(203): a, c, t, g, unknown or other
  misc_feature (203)..(203): n is a, c, g, or t
  modified_base (712)..(712): a, c, t, g, unknown or other
  misc_feature (712)..(712): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaancgcccaccctctcctgcgagggccagtcagtagtcgttcgctacgtttcggttagggtgtatcaaacataaactccggacaggtcctcccgaggtcctcctactattcgtttgacttcgtctttacgaacgtaccgggcccctaggcccgtacccgagggtccgtaggtttaccgaggttcggacgtaggttcggggtccgttaggggaacctagtaccgttccgtacttccctaccgaaccctataccgaacgtccgaacgtaccccgtaagggacctaccgttaggtaaacgtttacgtttcgaacgtttaagttttacgtttacgtcggtaacgacggtacctaacgggccgtttaccgaccgttacggtttccggggacggttaccgggtccgtacccgttaacggtttccgggacgggaacggtaaacctaaaggtcggtaaacggtaccgtaaacggtcgtaggtacggctaccggacctaccgtacgtcgttatacccgttntacccgttccccg

SEQ ID NO: 12357 - DNA, 644 bp, Homo sapiens
  misc_feature: GYAE6OF01A8BHJ.10.71.G05.1.454.CMB.1.raw
  modified_base (199)..(199): a, c, t, g, unknown or other
  misc_feature (199)..(199): n is a, c, g, or t
  modified_base (234)..(234): a, c, t, g, unknown or other
  misc_feature (234)..(234): n is a, c, g, or t
  modified_base (250)..(250): a, c, t, g, unknown or other
  misc_feature (250)..(250): n is a, c, g, or t
  modified_base (252)..(252): a, c, t, g, unknown or other
  misc_feature (252)..(252): n is a, c, g, or t
  modified_base (285)..(285): a, c, t, g, unknown or other
  misc_feature (285)..(285): n is a, c, g, or t
tcagcatagtagtgcacgaccggtgctcgatttagtgtcgtcgcaagagagaggggggaactgctcagttaggacccagagggaaccagtggaagccccagcctcagcttctcttcctcctgctactctggctcccagacaccaccggagaaattgtgttgacacagtctccagccacgctgtctttgctcaggggaangccacctctcctgcaggccagtcagagtctagganctctagctgtatcaananaacctggccaggctccaggctccgtcagtctangatgcactccaagacgggcccagtcggacactacccagtcccaggttcaggtcggctaggtggtctagggactacggtacctttcaccgttactccgaacctagtacgaacgtaccgaacgaaccgttaaggaacgtcccgtaagtaaacgtttagttttacgaactttaacggttttacttacgtcgttacgaagtaccgtaaggtccgtaaggacctaacggttcccggtaccgttaccgggtaccgttaccgggaaccgaaacgggtaacccgtaaaaggtccggaacgtaacggtaacgtaacggacggtaaaccgttgggtacgtcgtacgtacccgaacttagtcccgttacg

SEQ ID NO: 12358 - DNA, 743 bp, Homo sapiens
  misc_feature: GYAE6OF01EB5ZY.10.71.G05.1.454.CMB.1.raw
  modified_base (170)..(170): a, c, t, g, unknown or other
  misc_feature (170)..(170): n is a, c, g, or t
  modified_base (221)..(221): a, c, t, g, unknown or other
  misc_feature (221)..(221): n is a, c, g, or t
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
  modified_base (354)..(354): a, c, t, g, unknown or other
  misc_feature (354)..(354): n is a, c, g, or t
  modified_base (422)..(422): a, c, t, g, unknown or other
  misc_feature (422)..(422): n is a, c, g, or t
  modified_base (473)..(473): a, c, t, g, unknown or other
  misc_feature (473)..(473): n is a, c, g, or t
  modified_base (670)..(670): a, c, t, g, unknown or other
  misc_feature (670)..(670): n is a, c, g, or t
tcagcatagtagtgcacgaccggtgctcgatttagtgtcgtcgcaagagagaggggggaactgctcagttaggacccagagggaaccatggaacgccccagctcagcttctcttccctcctgctactctggcctcccaagaccaccgaccggagtaaattgtgtgaccanacgtctccagtccacgtcttgtcttttacgtcctacgggaagggggaaacnccgtcccctaccccttctcccgtgaccgacgggtactacggtanaggttagttcgttaccgcttaaccggttgggtttaacggggtnactactaaacaactaaccgccggcctacggccctccgagccttccntattcgttgacttgtacctttaccaacggtcggcccctggcccgtacctgcgtacgtcgtaggtccgngtagggtgtccggagactcggtactccgtactcctcacccgtaatcgaacncgaacgtctacgaacgtccgtaagttaacgtttcggttacgtaccgtttaatttagttacggtcgtagtacggacgtacggtcgtccttaccggttaccgggttagggtccgtaagggttccctacggttaccgttacgggacccggaagggtaacctaacggggtaataccgggttaaccgaaacgggtttaccgngggtttacgcccggttcgacccttaacccgtagttccggttaactttccacgttaacccgtccccgttaaccc

SEQ ID NO: 12359 - DNA, 511 bp, Homo sapiens
  misc_feature: GYAE6OF02IRUZ2.10.71.G05.1.454.CMB.1.raw
  modified_base (428)..(428): a, c, t, g, unknown or other
  misc_feature (428)..(428): n is a, c, g, or t
tcagcatagtagtgcacgaccggtgctcgatttagtgtcgtcgcaagagagagggggcctccattcggtgatcagcactgaacacagaggactcaccatggagtttgggctgagcgtggtttcgtcgttaggctctttaagtagatgtccagtgtcagatgcagatggtggagtctggggaggcgtggtccggcctggggggtccctgagactctcctgttctgcgtctggattcatcttagtaaatctggcatgtcctgggtccgccaggttccaggccacgggctggaatgggtggcagatatacaatatgatgacagtaaaatatactatggagactccttcaagggccattcaccatctccagagacattccaagaacatgtgtatctgcaaatgaccagcctgagagccgaggacacgggttntttattactggtggagtaaatccgtagtggtcagtcaacgtgtattgtgacgttccgggctagggaccgtggcgtacgtctcg

SEQ ID NO: 12360 - DNA, 501 bp, Homo sapiens
  misc_feature: GYAE6OF02FKQRR.10.71.G05.1.454.CMB.1.raw
  modified_base (498)..(498): a, c, t, g, unknown or other
  misc_feature (498)..(498): n is a, c, g, or t
tcagcatagtagtgcacgaccggtgctcgatttagtgtcgtcgcaagagagaggggagagccctggggaggaactgctcagttaggacccagagggaaccatggaagccccagctcagcttctcttcctcctgctactctggctcccagacaccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtgcagtgggtctgggacagacttcactctcaccatcagcagactggagtctgaagattttgcagtgtattattgtcggtcaatatggttagtcacctgggtactttggccagggaccaaggctggagatacgaacgactgtggctgnacc

SEQ ID NO: 12361 - DNA, 319 bp, Homo sapiens
  misc_feature: GYAE6OF02FHTO0.10.71.G05.1.454.CMB.1.raw
  modified_base (316)..(319): a, c, t, g, unknown or other
  misc_feature (316)..(319): n is a, c, g, or t
tcagcatagtagtgcacgaccggtgctcgatttagtgtcgtcgcaagagagaggggagagtgttagaggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttcccgccatctgacactactatgctgagcgggctggcaaggcgcatagnnnn

SEQ ID NO: 12362 - DNA, 521 bp, Homo sapiens
  misc_feature: GYAE6OF02G8LNV.10.71.G05.1.454.CMB.1.raw
  modified_base (214)..(214): a, c, t, g, unknown or other
  misc_feature (214)..(214): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggcaggctcccaggctcctcatctttgatgctttcaacagggcccctggcgtccaggcaggttcagtgcagtgggtctgggacagacttcactctcaccatcagcagcctagagcctgaagtattttgctagttttattactgtcagcagcgtgcctacgtttcggcggtaggtcgcctacgtttcggcggagggaccaaagtggaagtacgaaacgaacgtgtaggctgcacctatctcg

SEQ ID NO: 12363 - DNA, 318 bp, Homo sapiens
  misc_feature: GYAE6OF02HUY87.10.71.G05.1.454.CMB.1.raw
  modified_base (313)..(318): a, c, t, g, unknown or other
  misc_feature (313)..(318): n is a, c, g, or t
tcagcatagtagtgcacgaccggtgctcgatttagtgtcgtcgcaagagagaggggagagtgttagaggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcacatctgtcttcatcttcccgcatctgacactactatgctgagcggctggcaaggcgcatagnnnnnn

SEQ ID NO: 12364 - DNA, 505 bp, Homo sapiens
  misc_feature: GYAE6OF02GZFVQ.10.71.G05.1.454.CMB.1.raw
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtggtctgggacagacttcactctcaccatcagcagcctagagcctgaagattttgctagtttattactgtcagcagcgtgccactttcggcggaggtgccacgtttcggcgagggaccaaagtgaggtcaacgacgtgtgctgcacatctgtcttcatctcccg

SEQ ID NO: 12365 - DNA, 640 bp, Homo sapiens
  misc_feature: GYAE6OF02JC1WP.10.71.G05.1.454.CMB.1.raw
  modified_base (296)..(296): a, c, t, g, unknown or other
  misc_feature (296)..(296): n is a, c, g, or t
  modified_base (299)..(299): a, c, t, g, unknown or other
  misc_feature (299)..(299): n is a, c, g, or t
  modified_base (321)..(321): a, c, t, g, unknown or other
  misc_feature (321)..(321): n is a, c, g, or t
tcagcatagtagtgcacgaccggtgctcgatttagtgtcgtcgcaagagagagggggcctccattcggtgatcagcactgaacacagaggactcaccatggagtttgggctgagcgtggtttcgcgtagctctttaagagatgtccagtgtcagatgcagatggtggagtctgggggaggcgtggtccggcctggggggtccctgagctctcctgttctgcgtctggattcatctttagtaatctggcatgtcctgggtccgccaaggttccaggccacgggctgggaatgggggnggngagatatacatatagtataganaagtaaataataatatagagtactactacgtaacggacgtactactactactactaccacgagaactaactacctaaacgaaactaacgttaggttacgttagttactacgtaacgtaaactacgtaaccgtacgtaccgtacgagacgacggacggacggtacgggttacggtttagttacgttacggtaggtaagtaaacgtaaccgtacggtacgtacgtacgtacgtacgtacggttagttacggttacggttaccggttaccgggtaccggtaaccgggtaaccggtacggtaccggtaccgttaccgttaccg

SEQ ID NO: 12366 - DNA, 321 bp, Homo sapiens
  misc_feature: GYAE6OF02GUH4Y.10.71.G05.1.454.CMB.1.raw
  modified_base (316)..(321): a, c, t, g, unknown or other
  misc_feature (316)..(321): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttcccgcatctgacactactatgctgagcgggctggcaaggcgcatagnnnnnn

SEQ ID NO: 12367 - DNA, 581 bp, Homo sapiens
  misc_feature: GYAE6OF02HKMDX.10.71.G05.1.454.CMB.1.raw
  modified_base (174)..(174): a, c, t, g, unknown or other
  misc_feature (174)..(174): n is a, c, g, or t
  modified_base (324)..(324): a, c, t, g, unknown or other
  misc_feature (324)..(324): n is a, c, g, or t
  modified_base (352)..(352): a, c, t, g, unknown or other
  misc_feature (352)..(352): n is a, c, g, or t
  modified_base (354)..(354): a, c, t, g, unknown or other
  misc_feature (354)..(354): n is a, c, g, or t
  modified_base (464)..(464): a, c, t, g, unknown or other
  misc_feature (464)..(464): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcggtgtttcgcgtaggctcttaagagntgtcagtgtcagatgcagatggtgagtcgtgggggagcgtggtccggcgtggggggtccctgagcttctccgtgttctgcgttctggattcattctttaagtaaatctggctatcgtccgtgggtcccgctaggttccaggccgacgggntggaagtgggtggcagatataacattananatagaactaagtaaatataatagtagacgtactaccgtagaacggtactactccactactacctacgaagtacaactaacttaacgaaagactagttgtatactacgtanaactaacgtacgacgacgacgtacgacgacgacgacggtacggtacggttagttacgttaggtaggtaggtaagtaacgtacgtacggtacgtacgtacgtacgtacgttagttacg

SEQ ID NO: 12368 - DNA, 317 bp, Homo sapiens
  misc_feature: GYAE6OF02IDW0Q.10.71.G05.1.454.CMB.1.raw
  modified_base (312)..(317): a, c, t, g, unknown or other
  misc_feature (312)..(317): n is a, c, g, or t
tcagcatagtagtgcacgaccggtgctcgatttagtgtcgtcgcaagagagaggggagagtgttagaggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttcccgcatctgacactactctgagcgggctggcaaggcgcatagnnnnnn

SEQ ID NO: 12369 - DNA, 321 bp, Homo sapiens
  misc_feature: GYAE6OF02GS6WA.10.71.G05.1.454.CMB.1.raw
  modified_base (316)..(321): a, c, t, g, unknown or other
  misc_feature (316)..(321): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttccgccatctgacactactatgctgagcgggctggcaaggcgcatagnnnnnn

SEQ ID NO: 12370 - DNA, 550 bp, Homo sapiens
  misc_feature: GYAE6OF02JGOCL.10.71.G05.1.454.CMB.1.raw
  modified_base (211)..(211): a, c, t, g, unknown or other
  misc_feature (211)..(211): n is a, c, g, or t
  modified_base (239)..(239): a, c, t, g, unknown or other
  misc_feature (239)..(239): n is a, c, g, or t
  modified_base (317)..(317): a, c, t, g, unknown or other
  misc_feature (317)..(317): n is a, c, g, or t
  modified_base (452)..(452): a, c, t, g, unknown or other
  misc_feature (452)..(452): n is a, c, g, or t
tcagcatagtagtgcacgaccggtgctcgatttagtgtcgtcgcaagagagaggggagagccgtgggaggaactgctcagttaggacccagagggaaccatggaagccccagctcagcttctcttcctcctgctactctggctcccagacaccaccggagaaattgtgttgacacagtctccagccacgctgtctttgtctccaggggaanagccacctctcctgcagggccagtcagngtgttcgcacttcgttagggtgtatcaacataaatccggcaggctcccaggcctcctcattctttgatgctttcaacngggcccctggctcccaggcaggttcagtggcaggtgggtctggggacagacttcgactctcaccatcagcagcctagacgtcctaggaacgtattttcgcttaagttttattaacttgtcagtcgaagtccggtncccgtactttccgggcggtaggtcgtcgtactttcgggacggtaggaaccaaagttgacggtacaaaccgtagtggtaggctcgacacgtatccgtag

SEQ ID NO: 12371 - DNA, 790 bp, Homo sapiens
  misc_feature: GYAE6OF02FYWN8.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcaggggccgtagtcgagtgttcgtcgacttacgtttacgggttagggtagtactaacaataaattaaccggtcccgacggacgtcccctaccggacgtcccttcctactacttttcgttagtagtccgttttccttaaccaaacggggtcccccggttcccggtcgggttcccccgtaaccgggacggtacggtttacggttacgtaggggtccggacggttaggggttccggtacgggtacggaacgtaacgtttacctacctactttccgtacccaacttactacggaccgtaccgacccgtaaccggtaaggacccgtcgtaaaggtaaagtttttagtttccgaacgttttaagtttaaccttacgtcgtacgacgtacgtacggttcgtccgtacccttttacgggttccggggacgggttggtccctaccgttttccgggttccggggaaccggggtaaaccgaaaactaaaggtaggggtaccgtaaaccgaaacgtcggttagggccgttacgtacgaccctaacgttcgttcggttaccgttcctacttaccgttccccgtacccg

SEQ ID NO: 12372 - DNA, 500 bp, Homo sapiens
  misc_feature: GYAE6OF02F58N8.10.71.G05.1.454.CMB.1.raw
  modified_base (198)..(198): a, c, t, g, unknown or other
  misc_feature (198)..(198): n is a, c, g, or t
  modified_base (389)..(389): a, c, t, g, unknown or other
  misc_feature (389)..(389): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaacactgcagaaatagttatgacgcagtctccagccaccctgtctgtgtctccagggganagagccaccctctcctgcagggccgtcagaatattgctaccaacttagcctggtatcaacaaaagcctggccaggctcccagactcctcatctctggtgcatcttcgagggccactggtgtcccagccaggttcagtggcagtgggtctggaacagagttcactctcacatcagcgctgcagtctgaagtnttttgctagtttattactgtcagtcagtataatgtacttgggttttattctactttcggccttagggacctaagtgtatttcgagtacgtaactgtgctgcactatctgtc

SEQ ID NO: 12373 - DNA, 532 bp, Homo sapiens
  misc_feature: GYAE6OF02HYBUY.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgctagtttattactgttcagcagcgtgcctactttcggcggaggtgccacgtttcggcggaagggaccaaagtggacggtacgaaacggaactggtaggtacttgcctacgactccgtggttacttccattcccg

SEQ ID NO: 12374 - DNA, 520 bp, Homo sapiens
  misc_feature: GYAE6OF02FURY8.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgctttcaacagggcccctggcgtcccaggcaggttcagtggcagtggtctgggacagacttcactctcaccatcagcagcctagagcctgaagtattttgctagtttattactgtcagcagcgtgcctacgtttcggcggtaggtcgccgtacgtttcggcggtaggaccaaagtagagtacgaaacgacgtggtacgctgcacgatctgtctctactctcccg

SEQ ID NO: 12375 - DNA, 537 bp, Homo sapiens
  misc_feature: GYAE6OF02G1OEO.10.71.G05.1.454.CMB.1.raw
  modified_base (413)..(413): a, c, t, g, unknown or other
  misc_feature (413)..(413): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcaggtgggtctgggacagacttcactctcaccatcagcagcctagagcctagaagatttgntagtttattactgtcagcagcgtcgcctacgtttcggcggtacggtgcctacgtttcgggcggtacgggaacgtaaagtaggaacgtacgaaacgaacgtagtcggcgtgacaccgtatcgtcg

SEQ ID NO: 12376 - DNA, 528 bp, Homo sapiens
  misc_feature: GYAE6OF02GWW0D.10.71.G05.1.454.CMB.1.raw
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtgtatcaacataaatccggcaggctccaggctcctcatctttgatgctttcaacagggcccctggccgtcccaggcaggttcaggtcggcaggtgggtctgggacagtacttcactctcaccatcagcagcctagagcctagaagtatttgcttagtttacttactgtcagcagcgtgcctacgtttcggcggtagggtcgccgtacgtttcgggcggaggaaccaaagtagaggtacaacgacgtgtacggctgcactatctcg

SEQ ID NO: 12377 - DNA, 505 bp, Homo sapiens
  misc_feature: GYAE6OF02GZ8J1.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgtaggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgctagtttattactgtcagcagcgtgccactttcggcggaggtgccactttcggcggagggaccaaagtagaggtcaacgaactgtggctgcacatctgtcttcattcc

SEQ ID NO: 12378 - DNA, 524 bp, Homo sapiens
  misc_feature: GYAE6OF02F46N3.10.71.G05.1.454.CMB.1.raw
  modified_base (203)..(203): a, c, t, g, unknown or other
  misc_feature (203)..(203): n is a, c, g, or t
  modified_base (518)..(518): a, c, t, g, unknown or other
  misc_feature (518)..(518): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggttagggtggtatcaacataaatccggccaggctccaggctcctcatctttgatgctttcaacagggcccctggcgtcccaggcaggttcagtggcagtgggtctgggacagacttcactctcaccatcagcagcctagagcctgaagtatttgctagtttatactgtcagcagcgtgcctactttcgggcggtaggtgccgtacgttttcgggcggtacgggaccaaagtagaggtacaaacggaactgtaggctgacacatctgtcttacnttcccg

SEQ ID NO: 12379 - DNA, 596 bp, Homo sapiens
  misc_feature: GYAE6OF02JIOCE.10.71.G05.1.454.CMB.1.raw
  modified_base (206)..(206): a, c, t, g, unknown or other
  misc_feature (206)..(206): n is a, c, g, or t
tcagcatagtagtgcacgaccggtgctcgatttagtgtcgtcgcaagagagagggggaggaactgctcagttaggacccagagggaaccattggaagcccagctcagcttctcttcctcctgctactctggctcccagacaccaccggagaaattgttgttgacacagttactccagccacgctgtctttgtctccgaggggaaanagccgaccctctcctgcacgggccagtcagagtgttcgcacttcgttagggtgtatcaactataaatccggcaggcctcccaggctcctcagttctttgatcgctttacgaacgagggcccctggcgtcccaggcaggttcaggtggcgaggtgggtctgggactaggacttcactctcaccgatcagcagcctagacgctagaagtatttgctagtttattactgtcagcagcgtcgctacgtttcggcggtaggtcgccgtacgtttccgggacgggtacggtaaccgtaaagtacggtacggtaaccgtaaacggtaacgttaggtacgggtaccgttacgaccgtaccgtaacgttccgttacggttacctttacgtacgttcccg

SEQ ID NO: 12380 - DNA, 571 bp, Homo sapiens
  misc_feature: GYAE6OF02I0Z0S.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctacagccacgctgtctttgtctccaggggaaanagccaccctctcctgcagggccagtcagagtgttcgcacttcgttagggtgtatcaacataaatccggccaggctccaggctcctcatctttgatgctttcaacagggccctggcgtcccagcaggttcagtgcagtggtctgggacagacttcactctcaccatcagcagcctagacgcctagaagtattttgctagtttattactgtcagcagcgtgcctacgtttcggcggtacggtcgccgtacgtttcgggcggtaacgggaccctaaaaagtacggaaggtaccgaaaacgtaacgttggtacggtcgtaggcctaacccgtaacgttccttacggttcctttactacgttcccgtttaccccg

SEQ ID NO: 12381 - DNA, 557 bp, Homo sapiens
  misc_feature: GYAE6OF02HUPQI.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggcaggctccaggctcctcatctttgatgctttcaacagggcccctggcgtcccaggcaggttcagtggcagtgggtctgggacagacttcactctcacatcagcagcctagagcctgaagattttgctagtttattactgtcagcagcgtgcctacgtttcgggcggtaggtcgccgtacgttttccgggcgggtaagggaacctaaaagtacggaggtaccgaaacggaacgtggtcgggaccttaggcctaaccgagttccttacggtttcttaccgatttccccg

SEQ ID NO: 12382 - DNA, 537 bp, Homo sapiens
  misc_feature: GYAE6OF02IAF52.10.71.G05.1.454.CMB.1.raw
  modified_base (216)..(216): a, c, t, g, unknown or other
  misc_feature (216)..(216): n is a, c, g, or t
tcagcatagtagtgcacgaccggtgctcgatttagtgtcgtcgcaagagagaggggggagagccctgggggaggaactgctaagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcactttcgttagggtggtatcaacataaatccggcaggctccaggctctcatctttgatgcttttcaacagggcccctggcgtcccaggcaggttcagtggcagtgggtctgggacagcttcactctcacatcagcagcctagacgcctgaagtattttgctagtttattactgtcagcagcgtcgcctactttcgggcggaggtgcctagtttccgggcgggagggaccaaaagtaggaaggtacaaacggacttaggtggctggcctaccgattccgtgttacc

SEQ ID NO: 12383 - DNA, 550 bp, Homo sapiens
  misc_feature: GYAE6OF02HJKLQ.10.71.G05.1.454.CMB.1.raw
  modified_base (203)..(203): a, c, t, g, unknown or other
  misc_feature (203)..(203): n is a, c, g, or t
  modified_base (356)..(356): a, c, t, g, unknown or other
  misc_feature (356)..(356): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggccaggctccaggctcctcatctttgatgctttcaacacgggcccctggcgtcccaggcaggttcagtggcagtgggtctgggacngacttcactctcaccatcagcagcctagacgcctgaagtatttgctagtttattactgtcagcagtcgtcgcctacgtttcgggacggtaggtcgcctacgtttcgggccgggaaggaaccaaaagtcgagggtacaaaccggtaacgtggtacgggctagaccaccgtactcgttcgtccttactacttcccg

SEQ ID NO: 12384 - DNA, 324 bp, Homo sapiens
  misc_feature: GYAE6OF02JHHME.10.71.G05.1.454.CMB.1.raw
  modified_base (310)..(310): a, c, t, g, unknown or other
  misc_feature (310)..(310): n is a, c, g, or t
  modified_base (316)..(324): a, c, t, g, unknown or other
  misc_feature (316)..(324): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttccgccatctgacactactatgctgagcgggctggcaaggcncatagnnnnnnnnn

SEQ ID NO: 12385 - DNA, 532 bp, Homo sapiens
  misc_feature: GYAE6OF02JT9NK.10.71.G05.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
  modified_base (528)..(528): a, c, t, g, unknown or other
  misc_feature (528)..(528): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccacctctcctgcagggccagtcagagtgttcgcacttcgtagggtgtatcaacataatccggcaggctccaggctcctcatcttgatgtcttcaacncgggccctggcctccaggctaggtcagtgcaggtcggtctgggacaggtacttcactctcacctatcagcacgcctagacgcctagaagtagtttgacttagtttattacgtgtactagctagcgtcgcctacgtttcggacggtaggtcgccgtacgtttcggcggtagtacgaacctaaagtgaggtacgaaacgtacgtgtacgcgtgacactatcgtgtccttntacg

SEQ ID NO: 12386 - DNA, 515 bp, Homo sapiens
  misc_feature: GYAE6OF02HVSOF.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtggtatcaacataaatccggccaggctcccaggctcctcatctttgatgctttcaacagggcccctggcgtccaggcaggttcagtgcagtgggtctgggacagacttcactctcaccatcagcagcctagacgcctgaagtattttgactagtttattactgtcagcagcgtgcctacgtttcggcggtaggtcgcctacgtttcggcggaggaaccaaagtagagtacaaacgaactgtgctgcaccatctgtcttcatcc

SEQ ID NO: 12387 - DNA, 524 bp, Homo sapiens
  misc_feature: GYAE6OF02HQ1G1.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacacgggcccctggcgtcccaggcaggttcagtggcagtgggtctgggacagacttcactctcaccatcagcagcctagacgcctgaagtatttgctagtttattactgtactagcagcgtcgcctacgtttcggcggaggtcgccgtacgtttcggcggaggaccaaagtgagtacgaaacggactagtggactgcaccatctagtcttcatcccg

SEQ ID NO: 12388 - DNA, 587 bp, Homo sapiens
  misc_feature: GYAE6OF02HF848.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccgaggggaaanagcccaccctctcctgcagggccagtcagagtgttcgctacttcgttagggtgtatcaacataaatccggccaggctccaggctcctcatctttgatgctttacaacgcgggcccctggccgtcccaggctaggttcaggtggcaggtcgggtctggggacacggtactttcgacttctacacctatcagtccacggtcctagacgtcctagaagtattttcgacttagtttattactgtacagctagtcgtcgtcctacgtttcggcggtaggtcgtaccgtacgtttcgggacggtaacgggaaccaaaagtagaacggtacaaacggtacgtggtacggactagacctacgtacttcgtacgttccttctacttccttacccg

SEQ ID NO: 12389 - DNA, 537 bp, Homo sapiens
  misc_feature: GYAE6OF02IPQKD.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagcccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagagcctgaagtattttgctagttttattactgttcagcagcgtgcctacgtttcggacgggtaggtcgccgtacgtttccggacgggagggaaccaaagtacggaggtacgaaacggtactaggtggctgacacctatctgtcttcattcccg

SEQ ID NO: 12390 - DNA, 545 bp, Homo sapiens
  misc_feature: GYAE6OF02GDSSF.10.71.G05.1.454.CMB.1.raw
  modified_base (213)..(213): a, c, t, g, unknown or other
  misc_feature (213)..(213): n is a, c, g, or t
  modified_base (426)..(426): a, c, t, g, unknown or other
  misc_feature (426)..(426): n is a, c, g, or t
tcagcatagtagtgcacgaccggtgctcgatttagtgtcgtcgcaagagagaggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttaggtggtatcaacataaatccggcaggctccaggctcctcatcttgatgctttcaacagggcccctggccgtccaggcaggttcagtgcagtgggtctgggacagacttcactctcaccatcagcagcctagagcctagaagtattttgcttagtttacttactgtcancgagcgtgcctactttcgggcggtaggtcgccgtacgtttccgggcggacggaaccgaaaagtacggaacggtacgaaaccggtaacgtaggtacggtctagaccaccgtagtcttacg

SEQ ID NO: 12391 - DNA, 584 bp, Homo sapiens
  misc_feature: GYAE6OF02GXV41.10.71.G05.1.454.CMB.1.raw
  modified_base (203)..(203): a, c, t, g, unknown or other
  misc_feature (203)..(203): n is a, c, g, or t
  modified_base (376)..(376): a, c, t, g, unknown or other
  misc_feature (376)..(376): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagngccaccctctcctgcagggccagtcagagtgttcgcacttcggtagggtgtatcaacataaatccggcaggcctcccaggctcctcattctttgatgtctttcaacgcgggcccctggccgtcccgaggctaggttcaggtggctaggtgggtctgggacagtacttcactcncacatcacgcacgcctagacgcctaggaactatttgacttagtttattacgtgttacagctagtcgtcgccttacgttcgggcgggtaggtcgccttaccggtttcgggacgggaacggtaacctaaagtacggtaggtaaccgaaacggtaacgtcggtacggtacgttcgactaccgtagtccgttacgttccttacacgttcccg

SEQ ID NO: 12392 - DNA, 519 bp, Homo sapiens
  misc_feature: GYAE6OF02JHNUB.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgctagtttattactgttcagcagcgtgccacgtttcggcggtaggtgcctacgtttcggcggtagggaccaaagtagaggtcaaacggaactggtggctgcaccatctgtcttcattcccg

SEQ ID NO: 12393 - DNA, 560 bp, Homo sapiens
  misc_feature: GYAE6OF02F68VC.10.71.G05.1.454.CMB.1.raw
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgctagtttattaacttgtcagcagcgtgcctacttttcgggcggtagggtgccgtacgttttcgggccggagggtaaccaaaagttacggaggttaccaaaaccggtaactacggtagggcctaggaccaccgtattccgttaggtcctttcactttccccg

SEQ ID NO: 12394 - DNA, 556 bp, Homo sapiens
  misc_feature: GYAE6OF02I3DOX.10.71.G05.1.454.CMB.1.raw
  modified_base (268)..(268): a, c, t, g, unknown or other
  misc_feature (268)..(268): n is a, c, g, or t
  modified_base (393)..(393): a, c, t, g, unknown or other
  misc_feature (393)..(393): n is a, c, g, or t
  modified_base (436)..(436): a, c, t, g, unknown or other
  misc_feature (436)..(436): n is a, c, g, or t
  modified_base (457)..(457): a, c, t, g, unknown or other
  misc_feature (457)..(457): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccnccaggttccaggccacgggctggaatgggtggcagatatacaatatgatgacagtaaaatatactatggagactcttcgaagggccgattcaccatctccagagacaattccaaagaacatggtntatctgacaaatgaccagcctgacgagccgaggacacgggttntttacgtacgtggtagggaanaaattccgtaagtggacatccaccgtgggtaactttggtacgtaccgtttccggggacctaacggggaacccgttgggtaccaccgggttcttacccgg

SEQ ID NO: 12395 - DNA, 600 bp, Homo sapiens
  misc_feature: GYAE6OF02G9J2C.10.71.G05.1.454.CMB.1.raw
  modified_base (201)..(201): a, c, t, g, unknown or other
  misc_feature (201)..(201): n is a, c, g, or t
  modified_base (343)..(343): a, c, t, g, unknown or other
  misc_feature (343)..(343): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggctcccaggctcctcatctttgatgctttcaacaggccctggcgtccaggcaggttcagtggcagtggtcngggacagactttcactctcaccatcagcagcctagacgcctagaagtattttgactagtttattacgtgtcagtcagtcgtgtcctacgtttcgggacggtaggtcgtccgtacgtttccgggacgggtaacgggtaaacctaaaagttacggtaacgggtaccgaaaaccggtaacgttaggtacgggtaccgtacggacccgtaacccgtacgttccgttacggttaccctttacgacgtttcccgttacccccg

SEQ ID NO: 12396 - DNA, 540 bp, Homo sapiens
  misc_feature: GYAE6OF02GB3A1.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggccaggctccaggctcctcatctttgatgctttcaacagggcccctggccgtcccaggcaggttcagtggcaggtgggtctgggacagacttcactctcaccatcagcagcctagacgcctgaagtattttgctagtttattactgttcagcagcgtgcctacgtttcgggcgggtaggtcgcccgtacgtttccgggacggacgggaaccaaaagtaggaggtacaaacggtaactaggtcggctgcacctatcgtgtcttcattcccg

SEQ ID NO: 12397 - DNA, 573 bp, Homo sapiens
  misc_feature: GYAE6OF02I5T8B.10.71.G05.1.454.CMB.1.raw
  modified_base (200)..(200): a, c, t, g, unknown or other
  misc_feature (200)..(200): n is a, c, g, or t
  modified_base (360)..(360): a, c, t, g, unknown or other
  misc_feature (360)..(360): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcgttagggtggtatcaacataaatccggccaggctcccaggcctcctcatctttgatgcctttcaacacggccctcggccgtcccaggcaggttcaggtgcaggtggtcgtggggacnggtacttcactctcaccatcagcacgcctagacgcctagtaagtattttacgctagtttattacgtgtacagtcgagcgtcgcctacgtttcgggcggtacggtcgccgtacgtttcgggacggtaacgggaaccgaaagtagaacggtacgtaaacggtacgtggtaggctcggaccaccgtagtcgtcgttacttctacttcccttacccg

SEQ ID NO: 12398 - DNA, 781 bp, Homo sapiens
  misc_feature: GYAE6OF02J1N69.10.71.G05.1.454.CMB.1.raw
  modified_base (216)..(216): a, c, t, g, unknown or other
  misc_feature (216)..(216): n is a, c, g, or t
tcagcatagtagtgcacgaccggtgctcgatttagtgtcgtcgcaagagagaggggggggagggaacgtgctcagttaggacccagagggaaccatggaagccccagctcagcttctcttcctcctgctactcgtggcctcccagaccaccgaccggaagaaacttgtgttgacacagtcctccagccacgctgtctttcgtctaccgaagggaanacgcccaccctctcctgcgacgggccaggtccaggacgtgttccgctacttcggttagggtgtactacaacgtaataacgtccggtccgacggtcctaccgacggtcctccgtctacttcttagctcgttactttacaacggtaccgggtccccgtagggtcccgttcccgacggtcgtacggtttccaggtcgggacgacggttggggtccgtaggggactaggtaccgttcacggtccttaccgacctactcgacgtcctacggtacctacggaccgtccgtacggtaaacgttacgtttacgtaccgtttaaggttttaacttaccgtttacggtacgtacggttaccgacggtcgtacggtacccgtaccggttttccgggaccgggttacgggtccggtacccgttacgggttttaccgggaaccggggttaaccggggaaaccgttaaaggtaaccgggtacggttaaacccgtaaacggggtaaaccgttaccgggttacggaccggttacgaaccgtacgttacgtaccgttcggtaccttaccgtacttaccccgg

SEQ ID NO: 12399 - DNA, 775 bp, Homo sapiens
  misc_feature: GYAE6OF02FE0PM.10.71.G05.1.454.CMB.1.raw
  modified_base (211)..(211): a, c, t, g, unknown or other
  misc_feature (211)..(211): n is a, c, g, or t
  modified_base (221)..(221): a, c, t, g, unknown or other
  misc_feature (221)..(221): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtcttgctcgagggaaancgccaccctntcctgcagggccagtcagagtcgttcgctacttcgttagggtggtatcgaaacataaacgtcccggaccgaggcctccccgaggtccttccctctaacttccgttttggaacttcggtaccttttacgaaccgtacggggtcccccttgggcccgttaccccgaggtccgtacgggtttccaggttcgggcgtacgggttggggtaccgtaggggaccacgtacccgttcctaaccgttccttacccaaccgtaacgtccgaacggccacggtacccttaaggaccgtacccgttaggtaaacgttacgtttttacggtaccgtttaacgtttttaacgttaaccgttacggtaccgtaacggtaccgtaacggtccggttacggtaccccgtttacggttttccggggaaccgggttacgggtcctacccggttaccgtttccggggaccgggtacgggaaacccgtaaaaggtcgggtaaacggttaaccgtaaaaccggtacgttacggtacggtaccgtacgtacccaaccgtacgtttccgttaaccgg

SEQ ID NO: 12400 - DNA, 521 bp, Homo sapiens
  misc_feature: GYAE6OF02G8WG6.10.71.G05.1.454.CMB.1.raw
  modified_base (203)..(203): a, c, t, g, unknown or other
  misc_feature (203)..(203): n is a, c, g, or t
  modified_base (518)..(518): a, c, t, g, unknown or other
  misc_feature (518)..(518): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggctcccaggctcctcatctttgatgctttcaacagggctcctggcgtcccaggcaggttcagtggcaggtgggtctgggacagacttcactctcaccatcagcagcctagagcctagaagtatttgctagtttattacttgtcagcagtcgtcgcctacgtttcggcggtaggtcgccgtacgtttcggcggaagggaccaaagtagaggtacgaaacgaactgtggctgcaccgatctgtctntac

SEQ ID NO: 12401 - DNA, 672 bp, Homo sapiens
  misc_feature: GYAE6OF02IDNG6.10.71.G05.1.454.CMB.1.raw
  modified_base (554)..(554): a, c, t, g, unknown or other
  misc_feature (554)..(554): n is a, c, g, or t
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaaggggaaagagccacctctcctgcagggccagtcagagtgtcgctacttcggttagggtgtatacaaactaataaacgtccggcaggcctccaggcctcctcattctttagattcgtcttacaacgcggcccctggccgtaccaggctaggttcaggtgacgtaggtggtcgtagggactagtactttacaccgtctacaacctatacgacgacacgtaccgtagacggtaccttagaaaacggttaatttttcggactttaacgttttaacttacgtacggttaacaggtaccgtacggaccgttcggtaccctttaacggtttcggggacgggtaagggttcccncccggtttaacggttccggggaacgggtaacggaaaacctaaaggtaacggtaaccggtaacctaaaaccggttacgtagggtacgtaccgtacgaacccgtaacttacgttcttacg

SEQ ID NO: 12402 - DNA, 587 bp, Homo sapiens
  misc_feature: GYAE6OF02H87A1.10.71.G05.1.454.CMB.1.raw
  modified_base (200)..(200): a, c, t, g, unknown or other
  misc_feature (200)..(200): n is a, c, g, or t
  modified_base (304)..(304): a, c, t, g, unknown or other
  misc_feature (304)..(304): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcgttagggtgtatcaacataaatccggcaggctcccaggctcctcatctttgatgctttcaacnggccctggcgtcccaggcaggttcagtggcagtggtctgggacagacttcactctcaccatcagcagcctagagcctagaagtattttgactagtttaattcgtgtcagcagctgcctacgtttcggacggtaggtcgaccgtacgtttccgggacggtaacggggaaccaaaaagttacgaacgggttacctaaaacggtaccgttaagggtacggtacgtacggtaaccaccgtaacttccgttacggtttacctttaccgtacgttccgtttacccccgg

SEQ ID NO: 12403 - DNA, 509 bp, Homo sapiens
  misc_feature: GYAE6OF02H3VP1.10.71.G05.1.454.CMB.1.raw
  modified_base (205)..(205): a, c, t, g, unknown or other
  misc_feature (205)..(205): n is a, c, g, or t
  modified_base (372)..(372): a, c, t, g, unknown or other
  misc_feature (372)..(372): n is a, c, g, or t
  modified_base (491)..(491): a, c, t, g, unknown or other
  misc_feature (491)..(491): n is a, c, g, or t
  modified_base (507)..(507): a, c, t, g, unknown or other
  misc_feature (507)..(507): n is a, c, g, or t
tcagcatagtagtgcacgaccggtgctcgatttagtgtcgtcgcaagagagagggggaggaactgctcagttaggacccagagggaaccatggaagccccagctcagcgtctcttcctcctgctactctggctcccagatataaccgccggagaaattgtgttgacacagtctccagccaccctgtctttgtctccaggggaaanagccaccctctcctgcagggccagtcagagtgttagcactaacttagtctggtaccaacagaaacctggccaggctcccaggctcctcatctatgatgcatccacgacggccacgtggcactcccagccaggttcagtgcaggtgggtctgggacagacttcactcncaccatccgaccgcctacgacccctagaacgtatttgacttagtttattacttgtcagcagcgtagcagctcgccctctccctctcgttcggcgaggacaggtgagatacaacgactgnggtctcgccacatctntc

SEQ ID NO: 12404 - DNA, 592 bp, Homo sapiens
  misc_feature: GYAE6OF02ISDBL.10.71.G05.1.454.CMB.1.raw
  modified_base (261)..(261): a, c, t, g, unknown or other
  misc_feature (261)..(261): n is a, c, g, or t
  modified_base (367)..(367): a, c, t, g, unknown or other
  misc_feature (367)..(367): n is a, c, g, or t
  modified_base (387)..(387): a, c, t, g, unknown or other
  misc_feature (387)..(387): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagagattgtgttgacgcagtcgccagcccaccctgtctttttctccaggggacagagtcaccctctcctgtagggccagttatggtgttggcgcctatttaaactggtaccaanagaaacgtggccaggctcccaggctcctcatctacgaagcatcccaccagggccactggctcccagccaggttcgatggcaggtgggtctggacagacttcactcncaccatcagcagcctggacncctgaagatattgctagtttattattgtctagctagcgtagcgtaggtcgtcctttcgtaccgtttccgggacccggggtaaccaaagggttacggaaaactaccgaaaacgaacgttggtacgggtactacggacctaacccgtagttccgttacgttacctttacgttaacttccctttaccgtccggttaccctagttaccg

SEQ ID NO: 12405 - DNA, 569 bp, Homo sapiens
  misc_feature: GYAE6OF02GYYGJ.10.71.G05.1.454.CMB.1.raw
  modified_base (204)..(204): a, c, t, g, unknown or other
  misc_feature (204)..(204): n is a, c, g, or t
  modified_base (398)..(398): a, c, t, g, unknown or other
  misc_feature (398)..(398): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanagccaccctctcctgcagggccagtcagagtgttcgcacttcggttagggtgtatcaacataaatccggccaggctccaggcctcctcatctttgatgtctttcaacacgggccctggcgtcccaggcaggttcaggtggcaggtgggtctgggacagacttcactctcaccatcagcagctagcgctgaagtntttgctagtttattacgtgtcagtcagtcgtcgtcctacgtttcgggcggtaggtcgccgtacgtttcggcgggtaacggaacctaaagtacggacggtacaaaccggtaactggtacggtctacggacctaaccgtacgttaccgttgttaccttacgtacgtttccccg

SEQ ID NO: 12406 - DNA, 503 bp, Homo sapiens
  misc_feature: GYAE6OF02JW8UN.10.71.G05.1.454.CMB.1.raw
  modified_base (202)..(202): a, c, t, g, unknown or other
  misc_feature (202)..(202): n is a, c, g, or t
  modified_base (211)..(211): a, c, t, g, unknown or other
  misc_feature (211)..(211): n is a, c, g, or t
  modified_base (481)..(481): a, c, t, g, unknown or other
  misc_feature (481)..(481): n is a, c, g, or t
  modified_base (496)..(496): a, c, t, g, unknown or other
  misc_feature (496)..(496): n is a, c, g, or t
  modified_base (500)..(500): a, c, t, g, unknown or other
  misc_feature (500)..(500): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccacctntcctgcagggccagtcagagtgttcgcacttcgttagggtgtatcaacataaatccggcaggctcccaggctcctcatctttgatgctttcaacacgggcccctggccgtcccaggcaggttcagtggcaggtggtctgggacagacttcactctcaccatcagcagcctagagcctgaagtatttgctagtttatactgtcagcagctgcctacttcggcggtagtcgccgtacgtttcggcggacggacaaagtgagtcaacgactgnggctgcatcatcgtntctntac

SEQ ID NO: 12407 - DNA, 539 bp, Homo sapiens
  misc_feature: GYAE6OF02F6PHS.10.71.G05.1.454.CMB.1.raw
  modified_base (215)..(215): a, c, t, g, unknown or other
  misc_feature (215)..(215): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccagggggaaanagccaccctctcctgcagggccagtcagagtgttcgcacttcgttagggtggtatcaacataaatccggcaggctcccaggctcctcatctttgatgctttcaacagggcccctggcgtcccaggcaggttcagtgcagtgggtctgggacagacttcactctcaccatcagcagcctaggacgcctagaacgtattttgcttagtttattactgtcagcagcgtgcctacgtttcgggcggtagtcgcctacgtttccggcggacgggaaccaaagtaggacggtacgaaacgtacgtttggaccttgccaccattctgttcc

SEQ ID NO: 12408 - DNA, 560 bp, Homo sapiens
  misc_feature: GYAE6OF02GAY42.10.71.G05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctntcctgcagggccagtcagagtgttcgcacttcgttagggtgtatcaacataaatcggccaggctcccaggctcctcatctttgatgctttcaacaggcccctggcgtcccaggcaggttcagtggcagtggtctgggacagacttcactctcaccatccagccagcctagacgcctagaagtattttgctagtttattactgtcagcagcgtgccctacgtttcggcggtaggtcgccgtacgttttccgggacgggtacgggaaccaaaagtaggaacggtacaaacggtaacgtggtacggtacgtcgacaaccgtacgtcgtagtccttcgtacttcccttaccccg

SEQ ID NO: 12409 - DNA, 590 bp, Homo sapiens
  misc_feature: GYAE6OF02GF5F1.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccaagctgtctttgtctccaggggaaangccaccctctcctgcagggccagtcagagtgttcgctacttcggttagggtgtatcaacataaatccggcaggctccagctcctcatcttgatgctttcaacgcgggtcccctggccgtccgaggcaggttcaggtggcaggtgggtctgggacaggacttcactctcaccatcagccagcctagacgtccgtagaagttatttgacttaagtttacttacgtgttacacgtactaagttaatatgtacgtttgggtttacttccgtacgttttccggacccgttagggtaacctaaaggttgtactttacgaggtaaccgtaacggttggttcggtacgtcgacctaccgtacttcgttcgttccttacgtacttcccttaccccg

SEQ ID NO: 12410 - DNA, 560 bp, Homo sapiens
  misc_feature: GYAE6OF02HJKK8.10.71.G05.1.454.CMB.1.raw
  modified_base (357)..(357): a, c, t, g, unknown or other
  misc_feature (357)..(357): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtatttgtctccaggggaaagagccaccctctcctgcagggccagtcagagtgttcgcacttcggttagggtggtatcaacataaatccggccaggctcccaggctcctcatcttgatgctttcaacagggcccctggcgtcccaggcaggttcagtggcagtgggtctgggacngacttcactctcaccatcagcagcctagagcctgaagtattttgactagtttattactgttcagcagcgtcgcctacgtttcggcggtacggtcgccgtacgtttcgggcggtaacgggaaccgaaagtacggacgggtaccaaaccggtaactgggtacggcgtaggcctaacgactccttaggtccttacgtacttccccg

SEQ ID NO: 12411 - DNA, 351 bp, Homo sapiens
  misc_feature: GYAE6OF02J0U46.10.71.G05.1.454.CMB.1.raw
  modified_base (339)..(351): a, c, t, g, unknown or other
  misc_feature (339)..(351): n is a, c, g, or t
tcagcatagtagtgcacgaccggtgctcgatttagtgtcgtcgcaagagagagggagagtgttagaggggcacgttctcctctaacactctccctgttgaagctcttgtgacagacttcactctcaccatcagcagcctagagcctgaagatttgctagtttattactgtcagcagcgtgccactttcggcggaggtgccctactttcgggcggtaagggaccaaaagtcgaggtacaaaacgactggtggctggcaccgtatcctagtcttacattcctcccgccagttcctagactaccttactatcgctggacgcgggctcggcaagggcacatgnnnnnnnnnnnnn

SEQ ID NO: 12412 - DNA, 562 bp, Homo sapiens
  misc_feature: GYAE6OF02FUX51.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttaggggtgtatcaacataaatccggccaggctcccaggctcctcatctttgatgctttcaacagggcccctggcgtcccaggcaggttcagtggcagtggtctggggacaggtacttcacttctcaccatcagcagcctagagcctgaagtattttgctagtttattactgtcagcagcgtgcctacgtttcggcggtaggtgccgtacgtttcgggaccgggaacgggacctaaaagtacggtaggtacaaacggaacgtggtaggtcctggacctaccgacttccgttcgttacctttctacttaccttccccgg

SEQ ID NO: 12413 - DNA, 578 bp, Homo sapiens
  misc_feature: GYAE6OF02HJJOL.10.71.G05.1.454.CMB.1.raw
  modified_base (370)..(370): a, c, t, g, unknown or other
  misc_feature (370)..(370): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggccgtgggggtccctgagactctcctgttctgcgtctggattcatcttagtaatctggcatgtcctggtccgccaggttccaggccacgggctggaatggggtggcagatatacaatatgatgacagtaaaatatactatggagactccgttacgaagggccgattcaacctatccnccagagacaattaccaagaacagtggtagtatctagactaaatcgaccagcctagagacgtaccggaggacgtacgggtagtttacgtacgtggtaggggaataaacgtccgtaaggtgacgacttcgaccgtgggttacttgggtacgaccggtttccggggacctaacgggggtaacccgttgggtcctacccggttcttacccgg

SEQ ID NO: 12414 - DNA, 589 bp, Homo sapiens
  misc_feature: GYAE6OF02HRASE.10.71.G05.1.454.CMB.1.raw
  modified_base (203)..(203): a, c, t, g, unknown or other
  misc_feature (203)..(203): n is a, c, g, or t
  modified_base (395)..(395): a, c, t, g, unknown or other
  misc_feature (395)..(395): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaangcccaccctctcctgcagggccagtcagagtgttcgcactttcggtagggtggtatcaacataaatccgccaggctccaggctcctcatctttgatgctttcaacaggcccctggcgtcccaggcaggttcagtggcaggtgggtcgtgggacaggtacttcgactctacaccaatcacgcgacgctagacnccgtagaagttatttagacgttagttttattactcgtacgacgtactaacggcgtacgcccgtacggtttcggcgggtacgtcgtaccttaccggttcggacggggaaacggaaccaaagtaggacggtaacgaaaccggtaactcggtacgcgtcgacgtacctacgtccgttacgtacttccatttaccccg

SEQ ID NO: 12415 - DNA, 578 bp, Homo sapiens
  misc_feature: GYAE6OF02GN94C.10.71.G05.1.454.CMB.1.raw
  modified_base (390)..(390): a, c, t, g, unknown or other
  misc_feature (390)..(390): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatcttagtaaatctggcatgtcctgggtccgccaggttccaggccacgggctggaatgggtgcagatatacaatatgatgacagtaaaatatactatggagactccttcaagggccattcaccatctccagagacaattccaaagaacatggtntatctagcaaatgaccagcctgagagccgaaggacgacgggttagttttacttacgtggtagggaagtaaacttccgtaagtcggacagtacctaccgtgggttaatttcggtagtacccgtttacccggggggaccctaacgggggtaacccgttcgggttacccgtacccggttccgttaccccgg

SEQ ID NO: 12416 - DNA, 565 bp, Homo sapiens
  misc_feature: GYAE6OF02GKDPK.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcggttagggtggtatcaacataaatccggccaggctcccaggctcctcatctttgatgctttcaacacgggcccctggccgtcccgaggcaggttcaggtggcaggtgggtctggggacaggacttcactctcaccatcagcagcctagacgcctagaagtattttgctagtttattactgtacagtcagtcgtcgtcctacgtttcgggcggtaggtcgtccgtaccgtttcgggcgggaacggtaacctaaagtagacggtacgaaacgaacgtggtcggactgaccaccgattcgtgttccttactactccttaccccg

SEQ ID NO: 12417 - DNA, 577 bp, Homo sapiens
  misc_feature: GYAE6OF02I990E.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtgggtccggccgtggggggtccctgagactctcctgttctgcgtctggattcatctttagtaaatctggcatgtccgtgggtcccgccaggttcccaggcccgacggggctggaatggggtggcagatatacaatatgatagacaagtaaaatataactagtggaagaccttccttacgaacgggccgtaacttccacctatcctccagacgaacctaattaccaaagaacagtaggtatatcgtagactaaatcgaacccagcctagaacgacgacccgaggacgtacggggttatttacgttacgtggtagggaataaacgttcgtaaggtggtacctagtactaccgtggttacg

SEQ ID NO: 12418 - DNA, 583 bp, Homo sapiens
  misc_feature: GYAE6OF02F8E8S.10.71.G05.1.454.CMB.1.raw
  modified_base (204)..(204): a, c, t, g, unknown or other
  misc_feature (204)..(204): n is a, c, g, or t
  modified_base (401)..(401): a, c, t, g, unknown or other
  misc_feature (401)..(401): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagaatattgctacaacttagcctgtatcaacaaaagcctggccagctcccagactcctcatctctggtgctatcgtcggaggccacgtggtcgtcccagccaggttcaggtggcgtaggtggtctaggaacagagttcactctacaccatcagcggctgcagtctagaagtntttgcttagtttactactcgtacagtactaagttaataagtagtacgttttaggggtttttacttccgttacgttttccggacccgttagggtaacccgtaaaggttcgtaactttacgaacggtaacggtaactggttacggtcgtacgtccgtaaccgtattccgttacgttccttaccg

SEQ ID NO: 12419 - DNA, 551 bp, Homo sapiens
  misc_feature: GYAE6OF02GEK4B.10.71.G05.1.454.CMB.1.raw
  modified_base (202)..(202): a, c, t, g, unknown or other
  misc_feature (202)..(202): n is a, c, g, or t
  modified_base (310)..(310): a, c, t, g, unknown or other
  misc_feature (310)..(310): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccagggaaangccaccctctcctgcagggccagtcagagtgttcgctacttcgttaagggtggtatcaacataaatccggccaggctcccaggctcctcatctttgatgctttcaacnggcccctggcctccagcaggttcagtggcagtgggtctggacagacttcactctcaccatcagcagcctagacgcctagagtatttgactagtttattacgtgtcagcagtcgtgtcctacgtttcgggcggtaggtcgccttacgtttccgggcggtagggaaccaaagtagtacggtaacgaaacggtaacgtaggtacggcttacgactaaccgtatccgttcgtcttaccattcccg

SEQ ID NO: 12420 - DNA, 605 bp, Homo sapiens
  misc_feature: GYAE6OF02HGL3O.10.71.G05.1.454.CMB.1.raw
  modified_base (314)..(314): a, c, t, g, unknown or other
  misc_feature (314)..(314): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgctacttcggttagggtgtatcaacataaatccggccaggcctcccgaggctcctcattcttgatgtctttcaacncgggcccctggccgtccaggcaggttcaggtggctaggtgggtctgggacagtacttcgactctcaccatacagcacgcctaggacgcctaggaaagttatttgacttagtttattactgtacagcagtcgtcgcctacgtttccgggcggtacggttcgacccgttacgtttccgggacgggtaacgggaaccgtaaagtacgggacggtaacgaaaccggtaacgtaggtacggaccttcggaccctaaccgtacgttaccttacggttacctttacgactttaccccg

SEQ ID NO: 12421 - DNA, 537 bp, Homo sapiens
  misc_feature: GYAE6OF02GOE21.10.71.G05.1.454.CMB.1.raw
  modified_base (339)..(339): a, c, t, g, unknown or other
  misc_feature (339)..(339): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaatctggcatgtcctgggtccgccaggttccaggccacgggctggaatggggtggcagatatacaatatgatgacagtaaaatatactatgganactccttcaagggccattcaccatctcaganacaattccaagaacatggtntatctgcaaatgaccagcctagacgagccgaggacacgggttatttattacgtggtagggaagaatccgtagtgcatccaccgtggttattggtgtaccgttccggggacctacggggaaccgttgggtacctaccggtcttaccgg

SEQ ID NO: 12422 - DNA, 617 bp, Homo sapiens
  misc_feature: GYAE6OF02IB9XG.10.71.G05.1.454.CMB.1.raw
  modified_base (200)..(200): a, c, t, g, unknown or other
  misc_feature (200)..(200): n is a, c, g, or t
  modified_base (312)..(312): a, c, t, g, unknown or other
  misc_feature (312)..(312): n is a, c, g, or t
  modified_base (332)..(332): a, c, t, g, unknown or other
  misc_feature (332)..(332): n is a, c, g, or t
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
  modified_base (407)..(407): a, c, t, g, unknown or other
  misc_feature (407)..(407): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaancgccacctctcctgcagggccagtcagagtgttcgcactttcggttagggtggtatcaacataaactccggccaggctcccaggcctcctcattctttgatgtctttcaacncggtcccctggccgtcccgnggctaggttcaggtggcgtaggtcggtcgtgggactagtctttcncttctccaccntccgagcacgtcctagacnccgtagaacgttattttgacgttaagtttacttacttcgtactacgtcgtagtcgtcgtacctacgtttcgggcggtaggttccgaccgttacgttccgggacggtacgggtaaactaaagtaggaacggttacgaaacggtacgtcggtacggtaccgtcggacctaccgtacgttacgttccgttactttctaccttcccgttacccg

SEQ ID NO: 12423 - DNA, 550 bp, Homo sapiens
  misc_feature: GYAE6OF02F7KPG.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccaccctctcctgccagggccagtcagagtgttcgcacttcgttagggtgtatcaacataaatccggccaggctccaggctctcatctttgatgctttcaacagggcccctggcgtcccaggcaggttcagtcggcagtgggtctgggacaggacttcactctcaccatcagcagcctagacgcctgaaacgtattttgctagtttattactgtcagcagtcgtgcctacgtttcggacggtaggtgccctacgtttcgggcggacggaaccaaagtaggacggtaacgaaacgtaacgtggtacggcgttcgaccaaccgtagtccgtgtcctttacacttcccg

SEQ ID NO: 12424 - DNA, 569 bp, Homo sapiens
  misc_feature: GYAE6OF02GE0MZ.10.71.G05.1.454.CMB.1.raw
  modified_base (202)..(202): a, c, t, g, unknown or other
  misc_feature (202)..(202): n is a, c, g, or t
  modified_base (307)..(307): a, c, t, g, unknown or other
  misc_feature (307)..(307): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccacctctcctgcagggccagtcagagtgttcgcacttcgttagggtgtatcaacataaatccggccaggctcccaggctcctcatctttgatgtctttcaacncgggcccctggccgtccaggcaggttcagtggcaggtgggtctgggacagacttcactctcaccatcagcagcctagacgcctagaagtatttgctagtttacttacttgtctagcagtcgtcgtcctacgtttcgggcggtaggtcgccgttacgtttcggggacggtacgggaaacctaaagtcggtacggtaccaaacggtactaggtacggtacgtacgacccgaccgtacgttccgtagttccttacgattaccccg

SEQ ID NO: 12425 - DNA, 560 bp, Homo sapiens
  misc_feature: GYAE6OF02FRCM7.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcggttagggtgtatcaacataaatccggccaggctcccaggctcctcatctttgatgctttcaacacgggcccctggccgtcccaggcaggttcaggtggcaggtggtctggggacagacttcactctcaccatcagcagcctagacgcctgaagtattttgctagtttattactgtcagcagcgtgcctacgtttcggcggtaggtcgccctacgtttccgggcgggtaacgggaaccaaaagtacgaggtacaaacggtaacgtggtacggctggacctaccgtattcgttgttcctttctacttccttacccccg

SEQ ID NO: 12426 - DNA, 823 bp, Homo sapiens
  misc_feature: GYAE6OF02IUIWD.10.71.G05.1.454.CMB.1.raw
tcagcatagtagtgcacgaccggtgctcgatttagtgtcgtcgcaagagagagggggcctccattcggtgatcagcactgaacacagaggactcaccatggagtttggctgagctgggttttcctcgttgctctttaagagatgtccagtgtcagatgcagatggtggagtcgtggggagcgtggtccggcgtgggggtccctgagtactcgtccgtgttcgtgcgtcgtggattcgtagttcgtttaagtaacttcgtaggtactagttcgtaccgtggtcccgtaccgtaacggttcccgaggtacccgtacgggtctagggtaacgttcggggacgtaccgtagtaacgtaacgttaacgtaaagtacgtaggtacgtacggtaacgtaagttaaaacgtagttaaccgtaggtaggtaacgtaaccgttccgtaacgaacggggtcctaacgtttaccgaacccgttagttacccgtaaccgtaacggtaactaaacccgttaaacgttaaccccggtaaaagtaacccgtaacgggtttacggttaacgttaaacgttccgtaaacggtaaaccgttaaaacggttccgtaaaccgtacgtaccgttaaacggtaccggtaaccgggtaacccggttaaacgggaaccggttaccggggttttaacgtttaaacgttaccgggtacggttaaaccgggagttaaaaccgttccgtaaacgggttacgtacctacgttaccgtaaccggtcgttaagtccggtacgtaccggttacggacgtacgggtaacccttggtacctaccggttcgttacccgg

SEQ ID NO: 12427 - DNA, 610 bp, Homo sapiens
  misc_feature: GYAE6OF02G7G84.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagagattgtgttgacacagtctccagccaccctgtcctttgtctccgaggggaaagagccaccctctcctgcaggccagtcagagtgttggcgcctagagcctggtaccaacagaaacctggcccaggcctcccgacggccccctcactctagtgggtcgcactacccaacgacgggccacgtcggcactcccagccgtaggtcagtggcaggtgggtctagggacaggtccttcactctaccaccgtatcatcacgtccgtggacgccgtagaagtagttgttgacgttagttttacttacgttgtacaacgtagttaccgtacgtacggtccggtacccggtccggggcccttaccgttccgggcccgtacgggaacctaagggtacgtagtacgtacgtaaaccgtaacgttcggtacggtactacgacctacgtacttacgtacgttactactaccg

SEQ ID NO: 12428 - DNA, 548 bp, Homo sapiens
  misc_feature: GYAE6OF02HK8ZA.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggcaggctccaggctctcatctttgatgctttcaacacgggccctggccgtcccaggcaggttcagtggcaggtggtctgggacagacttcactctcaccatcagcagcctagacgcctgaagtatttgctagtttattactgtcagcagcgtcgccacgtttcggcggtaggtcgaccgtacgtttcgggacggtacgggaacctaaaagtacggacggtacgaaacgaacgttaggtcggcgtacgaccacgtactcgtcgttctctacttcctacccg

SEQ ID NO: 12429 - DNA, 718 bp, Homo sapiens
  misc_feature: GYAE6OF02G0Z9L.10.71.G05.1.454.CMB.1.raw
  modified_base (526)..(526): a, c, t, g, unknown or other
  misc_feature (526)..(526): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccaggggacaccaccggagaaattgtgttgacacagtctccagccacgtctgtctttgtctccgaaggggaaagacgccaccctctcctcgcgacgggccacgtcgagtagttcgttcgctacgtttcggttaggggttggtatcgaaactaattaaacgtcccggaccaaggtcctaccccgacggtccttccctacacttcgtttgtatcgtaccttttaccaacgtaccgggtccccgtcgggtcccgtccccgacgggtccgtacgggtttcaacgggtcggacgtacggggttggggttcgtacggggactacggtacctttcgactcctaccaacctactcgacgcacgtccgtaagcgtccgtaagaaagttntttgacttagtttattactgtcagtctagcgttcgtacccgtacggtttcgggacggtaggtccgtacccgttacggttccgggaccgggtaacgggtaaaccaaaacggttacgggaaaccggttaaaccgaaaaaccgggtaccgtttagggtacgggtcgttaacgacccgtaacttacgtcgttaccg

SEQ ID NO: 12430 - DNA, 708 bp, Homo sapiens
  misc_feature: GYAE6OF02IL3M0.10.71.G05.1.454.CMB.1.raw
  modified_base (198)..(198): a, c, t, g, unknown or other
  misc_feature (198)..(198): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtcttgctcaggggaanagccaccctctcctgcagggccattcagagtgttcgctacttcggtagggtggtatcaacgataaatccggcaggctcccaggcctcctcattctttgatcgtcttttacaacgtaccgggccccttgggacccttccccgagggtcctagggttccgaaggtcgggactacgggtcggggttccgtaggggaactacggtaactttccgaaccgttccttaccgaacccgtaattccgaacgtcgaaccgtacccgttaaggaacgacccgttagtaaacggttacgtttttcggaccgtttaaggttttaactttacgttacggttaccgaacggtaccgtacgtcgttacgacccgttacgtttccgggacgggttacggtcgtcccttaacggtttccggggaccggtaacgggaacctaaaaggttcggaacggtaaccgaaacggtaaccgtggtacggcgttacgacgaccgtactaccgttgttaccttaccgatttacccg

SEQ ID NO: 12431 - DNA, 751 bp, Homo sapiens
  misc_feature: GYAE6OF02JIS1C.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcaacactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaatctggcatgtcctgggtccgcctaggttccaggccacgggctggaatgggtggcagatatacaatatgatgacaagtaaaatatactataggaagacttccttacgaacggggaccctaagtttaccaaccctaattccctacccgaaggaacgtaacctaaaaccgtttacccaaaagtaaaaccgtacgttacgggttacgttaacttaccggttacggaacctaaaaacgttccggaaaaccccgtaacgggtacccccgttagggaaacgggtaaccgggtaccccgggaaaggggtaacccggttaaccgggggggttttacgtttttaaacggtttaacccggtttagggggttaacggggggtaaaacgttaaaaccggttacccggtttaaaggggttccggggtaaccttaaccgtttacccggtaaccccggttttagggggtttaacgttttaaccggggg

SEQ ID NO: 12432 - DNA, 526 bp, Homo sapiens
  misc_feature: GYAE6OF02HWO1K.10.71.G05.1.454.CMB.1.raw
  modified_base (202)..(202): a, c, t, g, unknown or other
  misc_feature (202)..(202): n is a, c, g, or t
  modified_base (399)..(399): a, c, t, g, unknown or other
  misc_feature (399)..(399): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaanagccaccctctcctgcagggccagtcagagtgttcgcacttcgttagggtgtatcaacataaatccggcaggctcccaggctcctcatctttgatgtctttcaacgacgggcccctggccgtcccaggcaggttcagtggcaggtgggtctgggacagacttcactctcaccatcagcagcctagacgcctgaagtnttttgactagtttattactgttcagcagcgtcgtcctacgtttcggcggtaggtcgcctacgtttcggcggacggaccaaagtagagtacaaacgactggtcggctgcacatctgtcttcattcccg

SEQ ID NO: 12433 - DNA, 649 bp, Homo sapiens
  misc_feature: GYAE6OF02G7928.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggttagggtgtatcaacataaatccggccaggctccaggctcctcatcttgatgtctttcaacacgggcccctggccgtcccaggcaggttcaggtggcaggttgggtctgggacagtacttcactctcactatcagcacgtaccgtagacgtccgtaggtaaacgttagttttcgacgttaagtttttaacttaaccgttggttaccaaggtccgtaacggtccggttcgacccgttaaccggttttcggggaccgggttaacggggttccgacccgttaccggttttccggggaccggggtaacgggtaaaccctaaaagtacgggtacggttaacgaaacggtaacgttaggtaggtcgtacgaccgtaccgtacgttcgttagttccttactaccttcccg

SEQ ID NO: 12434 - DNA, 319 bp, Homo sapiens
  misc_feature: GYAE6OF02G69C0.10.71.G05.1.454.CMB.1.raw
  modified_base (315)..(319): a, c, t, g, unknown or other
  misc_feature (315)..(319): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctgtcttcatcttccgccatctgacactactatgctgagcggctggcaaggcgcatagnnnnn

SEQ ID NO: 12435 - DNA, 674 bp, Homo sapiens
  misc_feature: GYAE6OF02J0DON.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagaggggggaacgtggctcagttaggacccagagggaaccaatggaagccccagctcagcttctcttcctcctgctactctggctcccagacaccaccggagaaattgtgttgacacagtctccagccacgctgtcttgtctccaggggaangccacctctcctgcagggccaggtcagagtgttcgcacttcgttagggtgtatcaacataaatccgacaggctcccgaggctcctcattcttgatgctttcaacacgggtccctggcgtcccgaggcctaggttcaggttcggctaggtcgggtctggggaacctagtaccgtttcacgtctaccgtaccatccgaagcctaagccccgtaagacgccgttagtaaacggtacttttcggacctttaagggtttacttaccgtttacgttccgtaacggtacgtacggtcccggttacgtcccggtaaccgttttccggggacgggtaacggtccggtaccgtacgggttttccgggaccgggtaacgggaaccctaaaagttacgggtaacggtactaaacggtaacggtcggttacggctcggtaccgtacccagttacgtcgttactttaacgttcccgtaccgtacccg

SEQ ID NO: 12436 - DNA, 578 bp, Homo sapiens
  misc_feature: GYAE6OF02F88HO.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagngccaccctctcctgcagggccagtcagagtgttcgctacttcggttagggtgtatcaacataaatccggccaggctcccaggctcctcatctttgatgctttcaacagggcccctggccgtcccaggcaggttcagtggcagtgggtctgggacagtacttcactctcacctatcagcagcctagcgcctgaagtatttcgactagtttatacgttgtactagtctagtataatgtacgtttgggtttactttcgtacgttttccggacccgttagggaacctaaaggttcggtactttacgaggtacgtaacgttggtcggtactgtacctaccgtacttccgttcgttccttactacgttcccgttaccccgg

SEQ ID NO: 12437 - DNA, 590 bp, Homo sapiens
  misc_feature: GYAE6OF02HA6CN.10.71.G05.1.454.CMB.1.raw
  modified_base (199)..(199): a, c, t, g, unknown or other
  misc_feature (199)..(199): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgctccaggggaangccacctctcctgcagggccagtcagagtgttcgcacttcggttagggtgtatcaacataaatccggccaggctccaggctcctcatctttgatgctttcaacacgggccctggcgtcccaggcaggtcagtgcagtggtctgggacagacttcactctcactatcagcagtcctagacgctagaagtntttgactagtttatactgtcagctagcgtgcctacgtttcggacggtacggtcgtaccgtacgttttcgggaccgggtaacgggtaacccaaaagtacggaacggttaccgaaaacggtaaccgttagggtaccgggtacgtacggaccgtaaccgtacgttccgttacgttccgtttaccgtaccgttcccttacccccgg

SEQ ID NO: 12438 - DNA, 555 bp, Homo sapiens
  misc_feature: GYAE6OF02HIT5U.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagcaccaccggagaaattgtgttgacacagtctccagccacgctgtctttgtctccaggggaaangccaccctctcctgcagggccagtcagagtgttcgcacttcgttagggtgtatcaacataaatccggccaggctcccaggctcctcatctttgatgctttcaacagggcccctggcgtcccaggcaggttcagtggcagtgggtctgggacagacttcactctcaccatcagcagcctagacgcctgaatatttgctagtttattactgttcagcagcgtgcctacgtttcgggcggtaggtcgccgtacgtttccgggcggtaacgggaacctaaaagtagacggtacgaaacggtaacgttggtacggacgtcgaccaccgtagtccttaggtacctttcgacgtttcccg

SEQ ID NO: 12439 - DNA, 600 bp, Homo sapiens
  misc_feature: GYAE6OF02HTUTS.10.71.G05.1.454.CMB.1.raw
  modified_base (202)..(202): a, c, t, g, unknown or other
  misc_feature (202)..(202): n is a, c, g, or t
  modified_base (283)..(283): a, c, t, g, unknown or other
  misc_feature (283)..(283): n is a, c, g, or t
  modified_base (301)..(301): a, c, t, g, unknown or other
  misc_feature (301)..(301): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccagctgtctttgtctccaggggaaangccacctctcctgcagggccagtcagagtgtcgcacttcgtagggtgtatcaacataaactccggcaggctccaggctctnatcttgatgcttcaacgnggcccctggcctccaggctaggttcagtcggctaggtgggtctgggacagtactcactctcaactatcagcacgctagacgcctagaagttatttgactagtttaacttactgtacgacgacagtcgtcgaccttacgtttcgggaccggtaggtacgtccgtacgtttcgggaaccgggtaacggaaaccgtaaaagtacgtaacgggtaaccgtaaaaccgggtaacgttacggtaacggtacgttacggacccgtaacctacggtaccgttacggttccttacgtaccttaccccg

SEQ ID NO: 12440 - DNA, 606 bp, Homo sapiens
  misc_feature: GYAE6OF02GIW7W.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaancgccaccctctcctgcagggccagtcagagtgttcgcactttcggttagggtgtatcaacataaatccggcaggctcccaggctcctcattctttagatgtcctttacaacacgggcccctggccgtcccaggcaggttcaggtggcaggtggtcgtagggacagtacttcgactctacaccatcagcacgcctagacgtctagaagtagttttcgctagtttattactgtcagcagcgtcgcctacgtttcggcggtaggtcgaccgttacgtttcgggacggtaacggaaacctaaagtacgggtacggtaccgtaaaccggtaacgttcgggtacggtcgtacggaccgtacccgtacttaccggtttaccgttcctttacgtaccgtttcccttaccccgg

SEQ ID NO: 12441 - DNA, 548 bp, Homo sapiens
  misc_feature: GYAE6OF02FH315.10.71.G05.1.454.CMB.1.raw
  modified_base (213)..(213): a, c, t, g, unknown or other
  misc_feature (213)..(213): n is a, c, g, or t
  modified_base (222)..(222): a, c, t, g, unknown or other
  misc_feature (222)..(222): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctntcctgcagggccagtcagagtgttcgcacttcgttagggtggtatcaacataaatccggccaggctcccaggctcctcatctttgatgctttcaacaggcccctggcgtcccaggcaggttcagtggcagtgggtctgggacagacttcactctcaccatcagcagcctagagcctagaacgtattttgactagtttatttactgtcagtcagtcgtgcctacgtttcggcgggtaggtcgccgtacgtttcgggcggacgggaccctaaaggtaggacggtacgaaaccgtaacgtggtacggctcggaccaccgtatccttacg

SEQ ID NO: 12442 - DNA, 576 bp, Homo sapiens
  misc_feature: GYAE6OF02IJQQS.10.71.G05.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagcccacgctgtctttgtctccgaggggaaanagccaccctctcctgcagggccagtcagagtgttcgcacgttcgtagggtgtatcaacataaatccggccaggctccaggctcctcatctttgatgctttcaacacggccctggccgtcccaggcaggttcagtcggcagtgggtctgggacagtacttcactctcaccatcagcacgcctagacgcctagaagtatttgctagtttacttacgttgtctagctaggtcgtcgcctacgtttccggcgggacggttcgcccgtacgtttcgggacgggtaacgggaacctaaaagtacggacgggtaacgaaacggtaacgtggtacggtacgtcgacgacctagtaccgttgtacttccgtattaccccg

SEQ ID NO: 12443 - DNA, 564 bp, Homo sapiens
  misc_feature: GYAE6OF02HZB5E.10.71.G05.1.454.CMB.1.raw
  modified_base (358)..(358): a, c, t, g, unknown or other
  misc_feature (358)..(358): n is a, c, g, or t
  modified_base (398)..(398): a, c, t, g, unknown or other
  misc_feature (398)..(398): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctcagccacgctgtctttgtctccaggggaaagagccaccctctcctgcagggccagtcagagtgttcgcacttcgttagggtggtatcaacataaaatccggccaggctcccaggctcctcatctttgatgcctttcaacagggcccctggccgtcccaggcaggttcagtggcagtgggtctgggacngacttcactctcacatcagcagcctagcgccgtagaagtnttttgactagtttacttacgtgtcagcagtcgtgccctacgtttcggacggtaggtcgccgtaccgtttcgggacggaacgggacctaaaagtcgaaggtacaaacggtaacgtggtacggtctggacctaccgtagtccgttacggtacctttcgactttccccg

SEQ ID NO: 12444 - DNA, 534 bp, Homo sapiens
  misc_feature: GYAE6OF02F28M4.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttagcactaacttagtctggtaccaacagaaacctggccaggctcccaggctcctcatctatgatgcatccacgaggccatggcatcccagccaggttcagtgcagtcggtctgggacaggacttcgactctcacctatccaccggcctacgacccctagaacgtattttcgactagttttatacgttgttcagctagcgtacgcacggctcggtcccctctccctctaccgtttccggcggacgggacctaagggtggagacgtacgaaacgacgtggtcgcgtcgcaccatctcgtcttc

SEQ ID NO: 12445 - DNA, 596 bp, Homo sapiens
  misc_feature: GYAE6OF02IZAB7.10.71.G05.1.454.CMB.1.raw
  modified_base (214)..(214): a, c, t, g, unknown or other
  misc_feature (214)..(214): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtggtatcaacataaatccggcaggctcccaggcctcctcattctttgatgtctttcaacgacgggcccctgggccgtcccaggccaggttcagtggcaggtgggtctgggacagacttcactctcaccatcagcacgcctagacgtcctagaacgtacttttgacttaagttttacttacgtgtacagtcagtccgtcgtcctacgtttcgggacggtacgggttcgaccgtacgtttccggggaccgggtacgggaaccgtaaaagtacggaagggtaacaaaaccggtaacgttggtacggacgtacggacctaaccgtacttcgttacgg

SEQ ID NO: 12446 - DNA, 561 bp, Homo sapiens
  misc_feature: GYAE6OF02IOPEP.10.71.G05.1.454.CMB.1.raw
  modified_base (310)..(310): a, c, t, g, unknown or other
  misc_feature (310)..(310): n is a, c, g, or t
  modified_base (340)..(340): a, c, t, g, unknown or other
  misc_feature (340)..(340): n is a, c, g, or t
tcagcatagtagtgcacgaccggtgctcgatttagtgtcgtcgcaagagagagggggggaactgctcagttaggacccagagggaaccatggaagccccagctcagcttctcttccctcctgctactctggctcccagacaccaccggagaaattgtgttgacacagtctacagccacgctgtctttgtctccaggggaagagccaccctctcctgcagggcccagtccagagtgttcgcacttcgttagggtgtatcaacataaatccggccaggcctccaggctcctcatctttgatgtctttcaacngggcccctggcctccagcagttcagtggcngtggtctgggacagtactttcactctcacatcacgcagcctagcgtcctagaagtattttgctagtttattactgtcagtcagtcgtcgcctacgtttcgggacgggtaggtcgtccctacgtttccggcgggtaacggaacctaaaagtacgaaggttaccaaacgtaacgtggtacggtcgtgaccacctattcgtcgttcttacgtacttccttcccg

SEQ ID NO: 12447 - DNA, 583 bp, Homo sapiens
  misc_feature: GYAE6OF02GEVRP.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggcctggggggtccctgagactctcctgttctgcgtctggattcatctttagtaaatctggcatgtcctgggtccgccaggttcccgggccacggggctggaatggggtggcagatatacaatatgatgacagtaaaatatactatggagactccttacgagggccgattcaccatctccagacgacaattccaagaacatggtagtactctgacaaatcgaccagcctgacgacgccgaggaccgtacgggttagtttaacgttacgtggtagggaacgtaaacgttccgtaaggtgacgacttaccgacgttggttattggttcggaccggtttccggggaccgtacggggtaaccggtcgggttaccacccggttcctcgttccccgg

SEQ ID NO: 12448 - DNA, 581 bp, Homo sapiens
  misc_feature: GYAE6OF02G0I5Y.10.71.G05.1.454.CMB.1.raw
  modified_base (201)..(201): a, c, t, g, unknown or other
  misc_feature (201)..(201): n is a, c, g, or t
  modified_base (399)..(399): a, c, t, g, unknown or other
  misc_feature (399)..(399): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcggttagggtgtatcaacataaatccggccaggcctcccgaggcctcctcatctttgatgtctttcaacgcgggcccctggccgtcccaggcaggttcagtggcaggtggtctgggacagacttcactctcaccatcagcagcctagcgctagaatntttgctagtttattacgtgtcagcagtcgtcgcctacgtttcggcggtaggtcgtaccgtcgttcgggcgggtaacgggaacctaaaagtacggaacggtacctaaacggtacgttcggtacggtacgtacggaccctaccgtacttcgtcgttaccgtttactaccgttcccgttaccccg

SEQ ID NO: 12449 - DNA, 595 bp, Homo sapiens
  misc_feature: GYAE6OF02HNCGN.10.71.G05.1.454.CMB.1.raw
  modified_base (202)..(202): a, c, t, g, unknown or other
  misc_feature (202)..(202): n is a, c, g, or t
  modified_base (399)..(399): a, c, t, g, unknown or other
  misc_feature (399)..(399): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaangccaccctctcctgcagggccagtcagagtgttcgcacttggttaggggtgtatcaacataaactccggcaggcctcccgaggcctcctctattctttgatcgtctttacaacgtcggtcccctggccgtcccgaggcgtaggttcaggtcggcgacggttgggtcgtgggacaggtacttcactctacaccatcancacgtctagacgacgtagaagttagtttgacttagtttacttacgttgtactagcgagtcgtcgccttacgttcgggacggtaggtccgtccgtacggttcggacgggtacggaaactaacgtaggtacgtaacgaaacgtacgtacggtcgacgtacgaccgtacgtactcgttacgttccttacgtacttcccg

SEQ ID NO: 12450 - DNA, 524 bp, Homo sapiens
  misc_feature: GYAE6OF02G4A4Q.10.71.G05.1.454.CMB.1.raw
  modified_base (201)..(201): a, c, t, g, unknown or other
  misc_feature (201)..(201): n is a, c, g, or t
  modified_base (505)..(505): a, c, t, g, unknown or other
  misc_feature (505)..(505): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggcaggctcccaggctcctcatctttgatgctttcaacaggcccctggccgtcccgaggcaggttcagtggcagtggtctgggacagacttcactctcaccatcagcagcctagacgctgaagtatttgctagtttacttactgtcagcagcgtgcctacgttcggcggaggtcgcctacgttcggacggagggaaccaaagtgagtacaacgaactggtagctacgcaccactcgttntcttacacttccttacccg

SEQ ID NO: 12451 - DNA, 769 bp, Homo sapiens
  misc_feature: GYAE6OF02HC8X5.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcgttgggttttcctcgttgcttcttttaagagatgtccagtgtcagatgcagagtggtggtagtcgtgggggaggcgtggtccggcgtcgggggtccctgacgctctcgtgtctgcgtcgtggtacttctattctttaagtaaactcgtggctagtcgttcccgtacgggtcccgccgtacggttcccgacggcccgacgggtcgtagggtaacggttgggggttacggacgtacggtaattaacgtaaacgtaaattaagttgaaagtttacgaaacgttaaaagttaaaaaacttacttaaacgttaaaggtacggtaaacgttaacccgttttacccgttaaaccgggaaacgggtcccgttaaaaccgtttacccaaaccccgtacgttaccctaaacccgtaagggaaaaccgttaaaccctaaaccgttaacccgaaaacgtaaactaaggttacggttaagttactaccgttaacgaactaaaacgtaccgaaccgaacggtaccgtagaacggtaccggaacgtacggaacggttacggttacgtttaacgtcggtagggtaacggtaacgaacgttccgtaaggcgtaactacgtacgtaccgttaggttacg

SEQ ID NO: 12452 - DNA, 594 bp, Homo sapiens
  misc_feature: GYAE6OF02H6CBZ.10.71.G05.1.454.CMB.1.raw
  modified_base (348)..(348): a, c, t, g, unknown or other
  misc_feature (348)..(348): n is a, c, g, or t
  modified_base (400)..(400): a, c, t, g, unknown or other
  misc_feature (400)..(400): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagcgccaccctctcctgcagggccagtcagagtgttcgcacttcgttagggtgtatcaacataaatccggccaggctccaggctctcatcttgatgctttacacacgggcccctggccgtccaggcaggttcagtggcagtgggtcngggacagtacttcactctcaccatcagcagctagcgcctagaagttattttnacttaagttttatacttgtacagctagccgttgacccttacgtttccgggacgggtacgggtcgtacccgtagttttccgggaccgggtagggtaaacccgtaaagttacgtacgggtaaccgaaacggtaacgttggtcggtaacgtccgtaccgaaccgtacttcgttcgttacctttcgtaactttccccg

SEQ ID NO: 12453 - DNA, 657 bp, Homo sapiens
  misc_feature: GYAE6OF02F1N88.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtggtccggccgtggggggtccctgacgactctcctgttctgcgtcgtggattcattctttaagtaaatcgtggctagtcgttcccgtcggggtcccgccgtacggttcccgacgggcccgacgggcgtagggaagtggggtcgacgagtaatataacaatatagatagaactaaagtaaaatataactagaggtaataccttacctacggaacgggtaccgtattacccgaacctactccgtaccaagacgtaacctaacttaccgaaaagactagttaggtactatctacgaactaatcgaaccgacgtacgtagaacgacgaccgggaacggtaccggttacgggttatttaacgttacggtagggttaacgggaaacgttaacgttccggttaagggtaccgtaccgttacgtacccgttacggttaggtttacg

SEQ ID NO: 12454 - DNA, 683 bp, Homo sapiens
  misc_feature: GYAE6OF02FFNNL.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaangcccaccctctcctgccagggccagtccagtagtcgttttcccgcttacttacgcctggtaccaacagaacgcctggccaggcctcccgaggcctcctcatgtatgatgacactaccaacgacgggcccacgtggaccactccccgagtccgtaggttccaggtcggcgtaggtcgggtctggaccgaacgtacgtaccttcgaccttcctaccaccactacaactacgaccctaacgaacctagtaacgttactttacgactttacttttacttcttacgtaccaacctaggtacgtaccgtaccgtaaccggttccggtacccgttacccggtaccggtttaccgggacccggtaaacggggtaaccgaacggggtcggaacgtacgtaccggaaacggtaaccggtaaaccggttcggtacggtaccgttacggacccgtaaccgttacgtttccgttacggtttaccctttacccg

SEQ ID NO: 12455 - DNA, 618 bp, Homo sapiens
  misc_feature: GYAE6OF02IKZWX.10.71.G05.1.454.CMB.1.raw
  modified_base (204)..(204): a, c, t, g, unknown or other
  misc_feature (204)..(204): n is a, c, g, or t
  modified_base (313)..(313): a, c, t, g, unknown or other
  misc_feature (313)..(313): n is a, c, g, or t
  modified_base (409)..(409): a, c, t, g, unknown or other
  misc_feature (409)..(409): n is a, c, g, or t
tcagcatagtagtgcacgaccggtgctcgatttagtgtcgtcgcaagagagagggggggaactgctcagttaggacccagagggaaccatggaagccccagctcagcttctcttccctcctgctactctggctcccagacacccaccggagaaattgtgttgacacagtctccagccacgctgtctttgtctccgaggggaaangccaccctctcctgcagggcccagtcagagtgttcgctacttcggttagggtgtatcaacataaatccggccaggctcccaggctcctcatctttgatgtctttcaacngggcccctggccgtcccaggctaggttcaggtggcaggtggtcgtggggacagtacttcgactctacaccatcagcacgctagacgcctagaagtnttttgctagtttattattcgtacagtcagtcgtagcgtaggtcggtccttttcgaccggttttccggggaccccggggtaactaaacgggttcggtaaaaccttaccggaaaaccgtaacgttggtacgggtaccgtacggacctaacctaacgtttccgtacggtttccttaccgtaccgttcccgtttaccccgtcctagttacccg

SEQ ID NO: 12456 - DNA, 532 bp, Homo sapiens
  misc_feature: GYAE6OF02HXHFA.10.71.G05.1.454.CMB.1.raw
  modified_base (215)..(215): a, c, t, g, unknown or other
  misc_feature (215)..(215): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaagngccaccctctcctgcagggccagtcagagtgttcgcacttcgttagggtggtatcaacataaatcggccagctccagctctcatcttgatgctttcaacacgggcccctggccgtcccaggcaggttcagtggcagtgggtctggacagacttcactctcacatcagcagcctagacgcctagaacgtattttgacttagttttattacttgtcagcagcgtgtccacgtttcggcggaagtgtccacgtttcggcggagggaccaaaagtcggaaggtacgaaacgtaactgtaggcgtacgctaccgtatcttcg

SEQ ID NO: 12457 - DNA, 541 bp, Homo sapiens
  misc_feature: GYAE6OF02FXUEI.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtgtatcaacataaatccggcaggctcccaggctcctcatctttgatgctttcaacacgggcccctggccgtcccaggcaggttcagtggcaggtgggtctgggacagacttcactctcaccatcagcagcctagacgcctgaagtatttgctagtttatactgtcagcagcgtgcctacgtttcgggcggtaggtcgccgtacgtttcgggacggtacggaaccaaagtaggaggtacgaaacggtaacgtaggtcggctcgacaccagttccgtgttcttcattcccg

SEQ ID NO: 12458 - DNA, 657 bp, Homo sapiens
  misc_feature: GYAE6OF02JHGPE.10.71.G05.1.454.CMB.1.raw
  modified_base (363)..(363): a, c, t, g, unknown or other
  misc_feature (363)..(363): n is a, c, g, or t
tcagcatagtagtgcacgaccggtgctcgatttagtgtcgtcgcaagagagaggggggccgtccattcggtgatcagcactgaacacagaggactcaccatggagtttgggctgagctgggttttcctcgttgctcttttaagagatgtccagtgtcagatgcagatggtggagtcgtgggggaggcggtgggtccggccgtggggggtccctggagactctcctgttctgcgtcgtggattcatctttagtaatctggcatgtccgtggggtcccgccgtacggttcccaggcccgacggggctgggaagtggggtgcgagatatacaatatgatgaactaagtaaaatatactagtagganaactcctagaacgggccattcacctatcctaccagagacaacttacccgaaagaaaccagttacgggtagttaacttcgtagacgtaaaataccgaaccacggaccctagggaacgacggaccggacgggtaacgtacggggtttagttttaaccgtacgttaggggtagggaattaaacgtccgtaagtcgactagtacctaccggttaggttacttggttacgacccgggtttcccggggaccggtaacgggggtacccgttcggggttacccgtacccgttcgttacccgg

SEQ ID NO: 12459 - DNA, 524 bp, Homo sapiens
  misc_feature: GYAE6OF02FHRHZ.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggttagggtggtatcaacataaatccggcaggctcccaggctcctcatctttgatgctttcaacagggcccctggcgtcccaggcaggttcagtcggcaggtgggtctgggacagcttcactctcaccatcagcagcctagacgcctgaagtatttgctagtttattactgtcagcagcgtgcctacgtttcggcgggtaggtcgccgtacgttttcgggcggacgggaaccaaagtagaggtacaacgaactgtggctgcacatctgtcttcattcccg

SEQ ID NO: 12460 - DNA, 553 bp, Homo sapiens
  misc_feature: GYAE6OF02F0UPC.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgcacttcgttagggtggtatcaacataaatccggccaggctcccaggctcctcatctttgatgctttcacagggcccctggccgtcccaggcaggttcagtggcaggtgggtctgggacagacttcactctcaccatcagcagcctagacgcctgaagtatttgctagtttattacttgtcagcagcgtgtcctacgtttcggcggtacggtgccgtactttcgggcggacgggaaccaaaagtacggaggtacaaaccggtaacgtaggtacggtccgttacgactaccgtagttcctgttccttctacttccccg

SEQ ID NO: 12461 - DNA, 602 bp, Homo sapiens
  misc_feature: GYAE6OF02I2NML.10.71.G05.1.454.CMB.1.raw
  modified_base (203)..(203): a, c, t, g, unknown or other
  misc_feature (203)..(203): n is a, c, g, or t
  modified_base (351)..(351): a, c, t, g, unknown or other
  misc_feature (351)..(351): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaanagccaccctctcctgcagggccagtcagagtgttcgctacttcggttagggtgtatcaacataaatcccggccaggctccccaggctcctcatctttgatgtctttcaacgacgggcccctggccgtcccaggctaggttcagtggcnggtgggtctgggacagtcttcactctacacatcagcagcctagacgctgaagtattttgactagtttatactgtcagctagcgtcgtccgtacgtttccgggcggagggttcgacccttaccgggtttccgggacggggtaaaccgggaaccgtaaaagtacgggtacggttaccgtaaaaccggtaacgttacggtagggaccttaggaccctaaccgtattccgtacggttccttacctacgttccccg

SEQ ID NO: 12462 - DNA, 713 bp, Homo sapiens
  misc_feature: GYAE6OF02J0IGD.10.71.G05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccagctgtcttgtctccgagggaancgccacctctacctgcgacgggccagtcagacgtgttcgctacttcggtaggtcgtatcgaacataaactccggacaggctaccgaggcctcgtcattcttgactgtctttacaacgtaggcccctgggcccgtacccgaggcctagggttaccaggtggcgtacggtcggggtaccgttaggggactaacggtacgttcaactccgtacacctaagttaccacggacagtacctacggaacgtcctaggtaacgttattttacgacttaggttttacgttacgttagttaccgagtacacggtacgttcggaccttacggtttacggcgggtaacggtccgtaccggttaaccgtttaccgggacgggttaacggaaccgtaaaaggtaccggtaacggttaccgtaaaacggtaacccgtttaagggtccggttaaccggtacggtaacccgtacggttaaccgttacccgttcgggttttacccgtttacccgtaagttttaaccccccgg

SEQ ID NO: 12463 - DNA, 594 bp, Homo sapiens
  misc_feature: GYAE6OF02JF3YD.10.71.G05.1.454.CMB.1.raw
  modified_base (153)..(153): a, c, t, g, unknown or other
  misc_feature (153)..(153): n is a, c, g, or t
  modified_base (204)..(204): a, c, t, g, unknown or other
  misc_feature (204)..(204): n is a, c, g, or t
  modified_base (206)..(206): a, c, t, g, unknown or other
  misc_feature (206)..(206): n is a, c, g, or t
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
  modified_base (405)..(405): a, c, t, g, unknown or other
  misc_feature (405)..(405): n is a, c, g, or t
  modified_base (450)..(450): a, c, t, g, unknown or other
  misc_feature (450)..(450): n is a, c, g, or t
  modified_base (460)..(460): a, c, t, g, unknown or other
  misc_feature (460)..(460): n is a, c, g, or t
tcagcatagtagtgcacgaccggtgctcgatttagtgtcgtcgcaagagagaggggggagggaacgtgctcagttaggacccagagggaaccatggaagccccagctcagcttctcttcctcctgctactctggctcccagacaccaccgganaaattgtgttgacacagtctccagccagctgtctttgctccgaggggaaancnccaccctctcctggcacgggccaggtccaggacgttgttccgcacttcggttaggggtcgtatcaacataaacgtcccggcaggcctcccgaggcctccnctactcgtttagatcgctttcaacgtcgggcccctgggcctccgnggctaggttcaggtcggcaggtcggggtctgggacacgcttcgactctccaccntccagcacgcctagcgctagagtagtttgacttagttatctgtcngtacagcgtnccgtacgttcggcggtagtcgtaccgtacgtttcggacgggtaacggaccgtaaagtacggacgtacgtaacggtaacgtcggtacggtcgtacggccgtaaccgtactccgttagttccttcgtacttcccgg

SEQ ID NO: 12464 - DNA, 576 bp, Homo sapiens
  misc_feature: GYAE6OF02IDLXD.10.71.G05.1.454.CMB.1.raw
  modified_base (199)..(199): a, c, t, g, unknown or other
  misc_feature (199)..(199): n is a, c, g, or t
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgctcgaggggaangccaccctctcctgcagggccagtcagagtgttccgctacttcggttagggtgtatcaacataaatccggccaggctccaggctcctcatcttgatgctttcacnggccctggctccaggcaggttcagtggcagtcggtctgggacagtactcactctcacatcagcacgccgtagacgcctagaagtnttttgacgtagtttacttactgtcagtcagtcgtcgccgtacgttcgggcggtacggtcgcccgtacgtttcgggacggtaacgggaaacctaaaaggtacggacggtaccgaaacggtaacgtcggtacggtcgtacggacctaccgtacttccgttagttccgttactacgttcccgttaccccg

SEQ ID NO: 12465 - DNA, 632 bp, Homo sapiens
  misc_feature: GYAE6OF02IMJQW.10.71.G05.1.454.CMB.1.raw
  modified_base (200)..(200): a, c, t, g, unknown or other
  misc_feature (200)..(200): n is a, c, g, or t
  modified_base (285)..(285): a, c, t, g, unknown or other
  misc_feature (285)..(285): n is a, c, g, or t
  modified_base (599)..(599): a, c, t, g, unknown or other
  misc_feature (599)..(599): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgctccaggggaaangccaccctctcctgcagggccagtcagagtgttcgctacttcggtagggtgtatcaacataaatccggcaggcctccaggctccnctatcgttgatgcttttacgaacgacggcccctggccgtcccaggctaggttcaggtggctaggtcggtctggggacagtaccttcactctcgaccctattaccgacgtcagtaccctagacggtacccgtagaaacgttagttttacgacgttaaggtttatttaacgtgttaccagtcgacgtcggtacgccctacgtttcgggccgggtaagtcggaccttaacggttcgggaccgggtacgggaaacctaaaaggttacgaggtaccgtaaaacggtacgtggtacggtacctacggtacccaaccggtntaccgttggttaccttcacgtttccctaccccg

SEQ ID NO: 12466 - DNA, 716 bp, Homo sapiens
  misc_feature: GYAE6OF02IAFNG.10.71.G05.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgttctttgtcctcgaggggaacncgccaccctctccgtgcgagggccagtccaggagtgttcgctacgttcggttagggtgtatcgaaactagttaaactccggacgaggcctaccgacggctccctctacttcttttgattcgtcctttacaacgtccgggtcccctggccccgttccgagggtccgtaacggttcgagggttcgccggtaggttcgggggttactacggggaactacgtaacctttccgaacgttccgtaccaacctacgtcgacgaccgtacgtacgtacgaccgtccgtagaaacgttgtttcgaccttaagttttctacgttcgtaacgtgcgtacgtcgttacaccgttacgtttccgggaacggttcggtccggtacccgttacggtttccggggaccggtaaacgggtaaacccgtaaaggttcgggaaccggttaaccggtaaacggtaacggtggtaccggtacctaggacccgtaacctagtccgtttccgtactttcccgactttaccccgg

SEQ ID NO: 12467 - DNA, 555 bp, Homo sapiens
  misc_feature: GYAE6OF02HSZ1K.10.71.G05.1.454.CMB.1.raw
  modified_base (203)..(203): a, c, t, g, unknown or other
  misc_feature (203)..(203): n is a, c, g, or t
  modified_base (253)..(253): a, c, t, g, unknown or other
  misc_feature (253)..(253): n is a, c, g, or t
  modified_base (309)..(309): a, c, t, g, unknown or other
  misc_feature (309)..(309): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccaggtcagagtgttcgcacttcgttagggngtatcaacataaatccggcaggctcccaggctcctcatctttgattgctttcaacngggcccctggctcccaggcaggttcagtgcagtgggtctgggacagacttcactctcaccatcagcagcctagagccttagaagtattttgctagtttatactgtcagcagcgtgcctacgtttcgggcggtacggtcgcctacgtttcgggcggagggaacccaaaagtacggaaggtccaaaacggactacggtaggactcggacctaaccgacttccgttagttccttacgtactttaccccg

SEQ ID NO: 12468 - DNA, 606 bp, Homo sapiens
  misc_feature: GYAE6OF02HE42Z.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaagngccacctctcctgcagggccagtcagagtgttcgcctacgttcggttagggtgtagtcaacataaatccgccaggctccagctcctcatctttgatgtcttttcaacgacggcccctggccgtcccaggctaggttcaggtggcgaggtgggtcgtgggacagtacttcactctacacctatcagcagacctagacgccgtagtaacgttattttgcttaagttttactttacgtgttacgtaagcgtaagtcgttgaccttacgtttcgggcggtacggtcgtaccgtaccgtttcgggacgggtaacggaaccgtaaagttacggacggtaaccgaaacggtaacgtacggtacggaccgttgaccgaccgtatccgttcgttcttaccgtcgtttacccg

SEQ ID NO: 12469 - DNA, 642 bp, Homo sapiens
  misc_feature: GYAE6OF02I2O3Z.10.71.G05.1.454.CMB.1.raw
  modified_base (201)..(201): a, c, t, g, unknown or other
  misc_feature (201)..(201): n is a, c, g, or t
  modified_base (427)..(427): a, c, t, g, unknown or other
  misc_feature (427)..(427): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcagagtgtcgctacgttcggtagggtgtatcaacataaactccggcaggcctccgaggctcctctattctttacgatcgtctttacgaacgtcggccctggccgtcccaggctaggttcagtcggctaggtcggtcgtagggactaggtaccttcgactctaccaactctacacgcacgtacctagacgtcgtagtaagtntttacgactagtttactacgttcgtactacgtcgtacgtcgttcgtccgttaccggtttcgggaccggtacggtcgtacccgttacggtttaccggggcgggtaaacgggtaaacctaaaacggtacgtaaccggtacgaaacggtaacggtggtacggtactaccggtacctacgtacttcggttacgtaccgttccgtacgttcccgtacccg

SEQ ID NO: 12470 - DNA, 588 bp, Homo sapiens
  misc_feature: GYAE6OF02HD2YN.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcggttagggtgtatcaacataaatccggcaggctccaggctcctcatcttgatgtctttcaacgacgggcccctggccgtccgaggcaggttcagtggcaggtggtctgggacagtacttcactctacaccatccagcagcctagacgcctagaagtatttgactagtttatactgtacagctagcgtcgtcctacgtttcggcggtaggtcgaccgttacggtttcgggaccgggtaagggaaaccctaaaaggtacggtaacggtaaccgaaacggtacgtagggtacggactacggacctaccgtacttccgtagttcctaccgttacttcccgttaccccg

SEQ ID NO: 12471 - DNA, 596 bp, Homo sapiens
  misc_feature: GYAE6OF02GNWX3.10.71.G05.1.454.CMB.1.raw
  modified_base (203)..(203): a, c, t, g, unknown or other
  misc_feature (203)..(203): n is a, c, g, or t
  modified_base (406)..(406): a, c, t, g, unknown or other
  misc_feature (406)..(406): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgcacttcgttagggtgtatcaacataaatccggccaggctcccaggctcctcatctttgatgtctttcaacgacgggcccctggccgtcccgaggcgaggttcagtcggcaggtgggtcgtgggacagacttcactctcacatcacgcagcctagacgcctagaagtnttttgacgttagtttacttacttgtacagtccagtccgtagccgtacgtttcgggacggtacggtcgaccctacgtttccgggacgggacggaaaccctaaagtagtacggtaacgaaaccggtaacttgggtacggtacgtacgaccgtaccgtacttccgttcggttacctttacgtacgttaccccg

SEQ ID NO: 12472 - DNA, 739 bp, Homo sapiens
  misc_feature: GYAE6OF02IZ9PA.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggcctcccagaccaccaccggagaaattgtgttgacacagtcctccagccacgctgtctttgtctccgaggggaaagacgcccaccctctcctgcgacgggccagtcagaggtgttcgctacgttcggttaggggtcgtatcaaactaataaacgtcccggaccaaggcctccccgaaggccttcctcattcctttaggacttcgtccgttttacaaaccggtaccggggtccccctgggcccgtccccgaggaccgtacgggttacgagggtcggcgtacggttcggggtcgtaggggaactaggtacctttcaaccttcctaccaccagttcacgtcgacgcccgtaagaccgtaccgtaggtaagttacttttcgactttaggtttaacttacgttacggttacacgtacgtacgtcgttaccggacccgttacggtttccggggacgggtacggtcgtacccgttacggtttccgggacggggaaccggtaaaccgtaaaagttacgggaacggttaaccgaaaacggtaaccgtagggttaccggtacggtaccgaccgtaccgtacgtttccgtacggtttccttacgttaccctttacccgg

SEQ ID NO: 12473 - DNA, 658 bp, Homo sapiens
  misc_feature: GYAE6OF02GVYBK.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangcccaccctctcctgcagggccagtcagagtgttcgctacgttcggttagggtgtatcaacataaatccggcaggctcccaggctcctcattctttgatgtctttcaacgcgggtccctggccgtccaggctaggttcaggtcggcgtaggtcgggtcgtaggggactagactttcgactctcacctatcagcagcctagacgtcctagaatagtttgacttagtttacttacgtgtacagctaacgtccgtagtaccctacgtttccgggacgggtacggttccgtacccgttaccgtttcggggaaccggggtaacggtaaacccgtaaaagtacgggtaacgggttaccgtaaaaccggtaacgttcgggttaacggacccgttaaggaccccgtaaaccgtacgtttaccgtcggtttaccctttaccgtaccgtttaccccgttacccccgg

SEQ ID NO: 12474 - DNA, 580 bp, Homo sapiens
  misc_feature: GYAE6OF02GB1OH.10.71.G05.1.454.CMB.1.raw
  modified_base (202)..(202): a, c, t, g, unknown or other
  misc_feature (202)..(202): n is a, c, g, or t
  modified_base (407)..(407): a, c, t, g, unknown or other
  misc_feature (407)..(407): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgctacttcggttaggggtgtatcaacataaatccggccaggcctcccaggcctcctcattcttgatgtctttcaacacgggcccctggccgtcccaggcaggttcaggtggcaggtggtcgtggggacagacttcactctcacatcagcacgcctagacgtcctagaagtntttcgcttagtttacttacgtgttcgagctagtcgtcgccttacgttcgggcggaggttcgccgtacgtttcgggacggtaacgggaaccaaagtacgaggtacaaacggtacgtggtacggacgtcggacctaccgtagttccgttagttccttctacttcccgttaccccg

SEQ ID NO: 12475 - DNA, 578 bp, Homo sapiens
  misc_feature: GYAE6OF02IC68H.10.71.G05.1.454.CMB.1.raw
  modified_base (203)..(203): a, c, t, g, unknown or other
  misc_feature (203)..(203): n is a, c, g, or t
  modified_base (570)..(570): a, c, t, g, unknown or other
  misc_feature (570)..(570): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanacgccaccctctcctgcagggccagtcagagtgttcgctacttcggttagggtgtatcaacataaatccggccaggctccaggctcctcattcttgattgtctttcaacagggcccctggccgtacccaggctaggttcagtcggcgtaggtgggtctgggacagacttcactctcacactcagcacgctacgacgcctagaagtattttcgacttaagtttacttactgttacagcagcgtcgaccttacgtttcggcgggtagtcgtaccttacgtttccgggacggacggtaaccaaaagtacgacggtaccaaacggtaactacggtggtctacggtacacctactcttcggttcttaccgtnttaccccg

SEQ ID NO: 12476 - DNA, 321 bp, Homo sapiens
  misc_feature: GYAE6OF02HP6LV.10.71.G05.1.454.CMB.1.raw
  modified_base (315)..(321): a, c, t, g, unknown or other
  misc_feature (315)..(321): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggagtgccactttcggcggagggaccaaaatagaggtcaaacgaactgtggctgcaccatctgtcttcatcttcccgccatctgacactactatgctgagcgggctggcaaggcgcatgnnnnnnn

SEQ ID NO: 12477 - DNA, 545 bp, Homo sapiens
  misc_feature: GYAE6OF02GZ80U.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgtagggtgtatcaacataaatccggccaggctcccaggctcctcatctttgatgctttcaacagggcccctggcgtccaggcaggttcagtggcagtggtctgggacagacttcactctcacatcagcagcctagagcctgaagtattttgctagtttattactgtcagctagcgtgcctacgtttcggcggtaggtcgccgtacgtttcggacgggacggaaccgaaaagtacggaggtacaaacggtaacgtaggtaggtacgtacgacgtaccacgttactagtcttactattcccg

SEQ ID NO: 12478 - DNA, 321 bp, Homo sapiens
  misc_feature: GYAE6OF02HOHWD.10.71.G05.1.454.CMB.1.raw
  modified_base (314)..(321): a, c, t, g, unknown or other
  misc_feature (314)..(321): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatgaggtcaaacgaactgtggctgcaccatctgtcttcatcttcccgcatctgacactactatgctgagcggctggcaaggcgcatagnnnnnnnn

SEQ ID NO: 12479 - DNA, 529 bp, Homo sapiens
  misc_feature: GYAE6OF02HK6DF.10.71.G05.1.454.CMB.1.raw
  modified_base (342)..(342): a, c, t, g, unknown or other
  misc_feature (342)..(342): n is a, c, g, or t
  modified_base (525)..(525): a, c, t, g, unknown or other
  misc_feature (525)..(525): n is a, c, g, or t
tcagcatagtagtgcacgaccggtgctcgatttagtgtcgtcgcaagagagagggggggcctccattcggtgatcagcactgaacacagaggactcaccatggagtttgggctgagctgggtttcctcgttgctcttttaagagatgtccagtgtcagatgcagatggtggagtcgtgggggaggcgtggtccggccgtggggggtccctgagactctcctgttctgcgtctggattcatctttagtaaatctggcatgtcctgggtccgccaggttccaggccacgggctggaatgggtggcagatatacaatatgatgacagtaaaatatactatagganactcctacgaaggccatcaccatcctacagacgactaataccaaagaactagtggtagtatctagactaaatcgaccagctggacgcgccgaggacgtagggttatttagtacgtggtaggataacgtctaggtgacatctacgtgtatgtcgtacgtccgggcagggaccgtgtctaccgtntccg

SEQ ID NO: 12480 - DNA, 576 bp, Homo sapiens
  misc_feature: GYAE6OF02JCD3S.10.71.G05.1.454.CMB.1.raw
  modified_base (202)..(202): a, c, t, g, unknown or other
  misc_feature (202)..(202): n is a, c, g, or t
  modified_base (301)..(301): a, c, t, g, unknown or other
  misc_feature (301)..(301): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctctcctgcagggccagtcagagtgttcgctacttcggtagggtgtatcaacataaatccggccaggctcccagacctcctcatctcgtggtnctatcgttcgagggcctacgtggtctcccagccgaggttcaggtggcgtaggtcgggtctagggaactaggtacgttcactcctaccacctactcgacgcggcctgcgagtctagtaagtatttcgactagtttacttacgtgtcagctagtatagtgtacgttaggtttacttcgtacgtttccggaccgttacggtaaccgtaaggttggtactttacgacggtaacgtaacgttggtcggtactcgacaccgtagtcgtcgttcttctaccg

SEQ ID NO: 12481 - DNA, 320 bp, Homo sapiens
  misc_feature: GYAE6OF02H73YM.10.71.G05.1.454.CMB.1.raw
  modified_base (317)..(320): a, c, t, g, unknown or other
  misc_feature (317)..(320): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaaatagaggtcaaacgaactgtggctgcaccatctgtcttcatcttcccgccatctgacactactatgctgagcgggctggcaggcgcatagnnnn

SEQ ID NO: 12482 - DNA, 622 bp, Homo sapiens
  misc_feature: GYAE6OF02HLMJA.10.71.G05.1.454.CMB.1.raw
  modified_base (373)..(373): a, c, t, g, unknown or other
  misc_feature (373)..(373): n is a, c, g, or t
tcagcatagtagtgcacgaccggtgctcgatttagtgtcgtcgcaagagagagggggggggagaggagcccagcactagaagtcggcggtgcctccattcggtgatcagcactgaacacagaggactcaccatggagtttgggctgagcttgggttttcctcgttgctcttttaagagatgtccagtgtcagatgcagagtggtggagtcgtggggggaggcgtggtccggccgtgggggtccctgagactctcctgttctgcgtctggtattcattctttaagtaactcgtggctattcggtcccgtcggggtcccgccgtacggttccgacgggcccgacgggctgggaagtgggtggcagatatacaatntagatagaactaaagtaaaatataactagtacggactaccttccgttacgaacgggtacctacttccaacctatcctaccaagaacgtaacctaactaccaaagaactagttggtactatctagactaaagtcgaaccagtacctaggacgtacggccggaaggtacggtacgggtttagttttacgtaaggtacggtaagggtaataaccgttacgtaggtcggactacgttacctacggttgtacgg

SEQ ID NO: 12483 - DNA, 665 bp, Homo sapiens
  misc_feature: GYAE6OF02JR8ZA.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgagggaaangccaccctctcctgcagggccagtcagagtgttcgctacttcgttagggtgtatcgaactataaatccggcaggctccaggctcctcattctttgatgtctttcaacgtcgggtcccctggccgtcccaggctacggttcaggtcggctaggtcggtctgggacagtacttcgactctcaccattacagtcacgtacctagacgtcctaggaacgttagttttcgacgttaagttttacttacgttgttacgtagtcgtacgtcgttacgtacccgttacgtttccgggacggtacggttccgtacccgttaccggttttccgggacgggtaaacgggtaaaccgtaaaacggttacggaacgggttaaccgtaaaaccgggtaacgtttcggtacgggttaccgttacggacccgtaaccgtacgttccgttacgtttcccgttacgtaccgtttaccccgg

SEQ ID NO: 12484 - DNA, 285 bp, Homo sapiens
  misc_feature: GYAE6OF02HP4VW.10.71.G05.1.454.CMB.1.raw
  modified_base (276)..(285): a, c, t, g, unknown or other
  misc_feature (276)..(285): n is a, c, g, or t
tcagcatagtagtgcacgaccggtgctcgatttagtgtcgtcgcaagagagagggggtgagccatcaaattgctgacagacttcactctcaccatcagcagactggagcctgaagattttgcagtgtattactgtcagcaatttgatggctcacctccgtacacttttggccaggggaccaaactggagatcaaacgaactgtggctgcaccatctgtcttcatcttcccgccatctgacactactatgctgagcgggctggcaaggcgcatacgnnnnnnnnnn

SEQ ID NO: 12485 - DNA, 551 bp, Homo sapiens
  misc_feature: GYAE6OF02GQI4J.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccaggggaaanagccaccctctcctgcagggccagtcagagtgttcgcacttcggttagggtgtatcaacataaatccggcaggctcccaggctcctcatcttgatgctttcaacagggcccctggcgtccaggcaggttcagtggcagtgggtctgggacaggtacttcacttctcacctatcagcagcctagagcctagaagtattttgactagtttattactgtacagcagtcgtcgcctacgtttcggcggtaggtcgccgtacgtttccgggacgggacgggtaaccaaagtacgaggtaccgaaacggaactggtacggactcgacaccgtattcctagttccttcacttcccg

SEQ ID NO: 12486 - DNA, 574 bp, Homo sapiens
  misc_feature: GYAE6OF02GKQQE.10.71.G05.1.454.CMB.1.raw
  modified_base (215)..(215): a, c, t, g, unknown or other
  misc_feature (215)..(215): n is a, c, g, or t
  modified_base (327)..(327): a, c, t, g, unknown or other
  misc_feature (327)..(327): n is a, c, g, or t
  modified_base (375)..(375): a, c, t, g, unknown or other
  misc_feature (375)..(375): n is a, c, g, or t
  modified_base (397)..(397): a, c, t, g, unknown or other
  misc_feature (397)..(397): n is a, c, g, or t
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgctacttcggttagggtggtatcaacataaacgtccggccaggctcccaggcctcctcattcttgatgtctttcaacncgggcccctggccgtcccgaggcaggttcaggtggcgtaggtgggtcngggacagtactcactctcactntcgagcacgctagacgccgtagtagttatttgacttagtttacttacgttgtacagctagccgtcgtacctacgttcggcggtacgtcgccgttacggttcgggacggtacggaaccgtaaaggtacggtaacggtacaaaacggtacgtaggtcggctcgaccacgtatcgttacg

SEQ ID NO: 12487 - DNA, 539 bp, Homo sapiens
  misc_feature: GYAE6OF02FIV9O.10.71.G05.1.454.CMB.1.raw
  modified_base (202)..(202): a, c, t, g, unknown or other
  misc_feature (202)..(202): n is a, c, g, or t
  modified_base (388)..(388): a, c, t, g, unknown or other
  misc_feature (388)..(388): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggcctcccaggctcctcatctttgatgctttcaacagggcccctggccgtcccaggcaggttcagtggcagtgggtctgggacaggacttcactctcaccatcagcagcctagacnctagaagtatttgctagtttatactgtcagcagtcgtgccctagtttcggcgggtagtcgtcctacgtttccgggcggaagggaccaaaagttggaggtaccgaaacggtaactggtacggctagacctaccattctgtccttcattcccg

SEQ ID NO: 12488 - DNA, 802 bp, Homo sapiens
  misc_feature: GYAE6OF02H30Y9.10.71.G05.1.454.CMB.1.raw
  modified_base (201)..(201): a, c, t, g, unknown or other
  misc_feature (201)..(201): n is a, c, g, or t
  modified_base (264)..(264): a, c, t, g, unknown or other
  misc_feature (264)..(264): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaanacgccacctctcctgcagggccagtcagtagtgttcgctacgttcggttagggtgtatacaanataaacgtccggaccaggcctaccgaggcctcctcattctttgacttcgttcctttacgaaccgaccgggtcccctaggccgtcccgaggcgtaggttcgaggtcggcgtagggtcggtccgtaggggactagacctttcgacttccgtcaacctatccgacgacctacgtaccttaaggacgtccgtaaggtaaacgttgttttacggtacgtttaaacgttttaacgttaacgttcggttaacgtaacggtaccgtaggtacccggttacgtcccgtttaaccgggttttaccggggacggggttaacgggttccggtacccggttaccgggttttccgggggaacccggggtaacgggtaaaaccgtaaaaaacgggttaacggggtaaaccgggttaaccggtaaaaaccgggttaaccggttacggggttaaccgggtacccgttaaccgggtaacccgtaacccgttacggtttacccgttaaccggtttacccgtttaacttaccccggtttcccccgttttaacccccgg

SEQ ID NO: 12489 - DNA, 605 bp, Homo sapiens
  misc_feature: GYAE6OF02I9J1L.10.71.G05.1.454.CMB.1.raw
  modified_base (200)..(200): a, c, t, g, unknown or other
  misc_feature (200)..(200): n is a, c, g, or t
  modified_base (265)..(265): a, c, t, g, unknown or other
  misc_feature (265)..(265): n is a, c, g, or t
  modified_base (287)..(287): a, c, t, g, unknown or other
  misc_feature (287)..(287): n is a, c, g, or t
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
  modified_base (429)..(429): a, c, t, g, unknown or other
  misc_feature (429)..(429): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgtctccgagggaaanagccaccctctcctgcagggccagtcagagtgttcgctacttcgttagggtgtatcaacataaanccggcaggctcccaggctcctnatcttgatgtctttcaacncgggcccctggccgtcccaggcctaggtcaggtcgcaggtggtctgggacngtacttcactctacacatcagcagcctagcgcctgaagtgtttcgacttagtttattacgtatcgacgtcgngaccgttcgacccgtacgttttccgggacgggtagtcgtacccgtacgtttccgggacgggtaaccggaaccaaaagttacgggaacggttaccgaaacggtaacgtgggtacggtaccgttggacctacccgtaagttccttacgttaccttaccgttacgtcccgttaccccgg

SEQ ID NO: 12490 - DNA, 793 bp, Homo sapiens
  misc_feature: GYAE6OF02HUIA0.10.71.G05.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaacgccccagctcagcttctcttcctcctgctactctggctcccagacaccaccggagaaattgtgttgacacagtctccagccacgctgtctttgtcctccgaggggaanacgccaccctctctgcgagggccagtcagagtcgttcgctacgttggttagggtggtatacaaactataaacgtcccggacgtacggcctcccgaggcctcctctagttctttgacttcgttcctttacgaacgtaccggtccccgtgggtcccgtacccgagggtccgtacgggttcgaggttcggacgtacgggttcggggtcgttacggggaacctacggtaacctttccgaaccgtttcctaccccgtaaaccctacgttccgaacggtacccgaacggtacccgttaacggacggtccccgtttaaagggtaacgtttacgtttttacgaccgtttaacggtttttaacttacgttacgttacgacgtccgtacggtccgtacggtacccgtttacggtttccggggacgggtacggtcccgttaccgttaccggttttacccggggaccggggtaaacggaaaaccgttaaacgtaggtaaccggttaaccgtaaacgggtaacgttacgggtacggacgtttaccggaaccctacccgttagttcccgttacgtttaccccgttactacctttacccccgg

SEQ ID NO: 12491 - DNA, 678 bp, Homo sapiens
  misc_feature: GYAE6OF02HFI5U.10.71.G05.1.454.CMB.1.raw
  modified_base (203)..(203): a, c, t, g, unknown or other
  misc_feature (203)..(203): n is a, c, g, or t
  modified_base (463)..(463): a, c, t, g, unknown or other
  misc_feature (463)..(463): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaanacgccacctctcctgcagggccagtcagagtgttccgctacttcggttagggtgtactacgaacataaagtcccggccaggcctcccgaggtcctcctcgtattctttgattcgtctttacgaaacgtcgggcccccttggccgtacccgagggtccgtaggttccaggttcggcgaggttcgggtctagggacacggtacgttccaactccgtaccaccgtatacgacgcaacggcctaggacgtacctaggtaacgtntttcgactttaagttttacttacgtgttaccaggtacctaggtccgttcgaccgttaccggtttccgggacggttacggtcgaacccgtttggttacccgggacggggaaacggtaaaccgtaaaagttccggaacggttaaccaaacggttcgtacgggttaggcccgtacgaccctaactacgtccgttcgttaccttactaccgtttacccg

SEQ ID NO: 12492 - DNA, 572 bp, Homo sapiens
  misc_feature: GYAE6OF02I0R21.10.71.G05.1.454.CMB.1.raw
  modified_base (201)..(201): a, c, t, g, unknown or other
  misc_feature (201)..(201): n is a, c, g, or t
  modified_base (300)..(300): a, c, t, g, unknown or other
  misc_feature (300)..(300): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgctccaggggaaangccacctctcctgcagggccagtcagagtgttcgcacttcgttagggtgtatcaacataaatccggcaggctccagctctcatcttgatgctttcaacnggcccctggccgtcccaggcaggttcagtgcagtggtctgggacagacttcactctcacatcacgcagcctagacgcctagaagtatttgactagtttattactgttacagcagcgtcgcctacgtttcggacggtaggtcgtccgtacgtttcggacggtacggaacctaaagtacggtacggtaccgaaaacggtaacgttcggtacggtaccgttacgacccgtaaccgtacgttaccgttacgtttaccgttacctacgtttaccccg

SEQ ID NO: 12493 - DNA, 866 bp, Homo sapiens
  misc_feature: GYAE6OF02G360G.10.71.G05.1.454.CMB.1.raw
tcagcatagtagtgcacgaccggtgctcgatttagtgtcgtcgcaagagagaggggggccgtccattcggtgatcagcactgaacacagaggactcaccatggagtttgggctgagctgggttttcctcgttgctcttttaagagatgtccagtgtcagatgcagatggtggagtcgtgggggaggcgtgggtccggccgtgggggtccctggagactctcctgttctgcgtctggtattcattctttagtaatctggcatgtccgtgggtccgctaggttccaggccgacgggctgggactggggtggcagtatactacaatagtgtatgaactaaagtaaaacttagtaactagtaggaacgtaccttaccgttacgaaacggggtccttaacgtttaccaacctattacccgtacccgaaaggaaccgtaaaccttaaaccgttaaccgaaaacggtaaacgtaacggttacgggtttacggtaaattccgttaacgaaaccgttaaaactccggtaaacccacgggttacccgtaacggtaacgggaaccggtaacccggggtaaacgggtaaacccgggttaacccggggggttttaagtttttaacccgttttaacggggttacggttaaacggggggtaaaacttaaaaaccccgggttccggtttaaacgggttaccgggaacctttaaccggttaccccggtaacggttaacggggtttttaacgtttaccgggttaaccgggttaaccccgggggtttaccccggggggaaaccccgggttaaaccggggggtaaacccgggttttacccgggttccccggttaaaccccgggtttccccgttttaacccccgggg

SEQ ID NO: 12494 - DNA, 624 bp, Homo sapiens
  misc_feature: GYAE6OF02GEHT1.10.71.G05.1.454.CMB.1.raw
  modified_base (202)..(202): a, c, t, g, unknown or other
  misc_feature (202)..(202): n is a, c, g, or t
  modified_base (273)..(273): a, c, t, g, unknown or other
  misc_feature (273)..(273): n is a, c, g, or t
  modified_base (282)..(283): a, c, t, g, unknown or other
  misc_feature (282)..(283): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctcaggggaaangccacctctcctgcagggccagtcagagtgttcgctacttcggttagggtgtatcaacataatccgcagcnccagctctnntcttgatgtcttcacgcggcccctggccgtccgaggctaggttcagtggctaggtgggtctgggacagtacttcactctccactatcagacagcctaagacgcgtagtaagttacgtttgacgttagttttaactacgttcggtactacgacgtacggtcgtcgtaccgttaccggtttcgggacgggttacggtcgtacccgttacggttttccggggaacggtacgggtaaaaccgtaaaggtacggtacgggttaacgaaaccgggtaacgttaggtacgggtccgtacgtaaccgtaccgtacgttccgttcgtttaccttacctaccgtttccccg

SEQ ID NO: 12495 - DNA, 731 bp, Homo sapiens
  misc_feature: GYAE6OF02GY86I.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctcagccacgctgtctttgtctccaggggaanagccacctctcctgcagggccagtcagagtgttcgctacttcggttagggtgtatcaacataaatccggcaggctccaggctcctcattcttgatcgtctttacaacgcgggtccctggccgtaccgaggctacgggttcaggtggtactaggtcgggtctgggactaggtaccttcgaacttccgtccaaccgtatccgaacgtaccgtaacgtaccgtaacggcgtacccgttaaggtaaacggtttacgttttgacgtttaaacggtttttaaccttcggttacgtacgtaacgtaccgtaacggttccggtaccgtacccgtttaccgggtttaccgggggaccggggttaacgggttcccggtacccgtttaaccggttttccggggggaaccgggtaaacgggtaaacctaaaagggttacggaccgggttaaccgaaaccggttaacgttcgggttacgggtcgtaacgacccgtaaccgacgtttacgttaccggtttactttaccgtaccgtttacccccg

SEQ ID NO: 12496 - DNA, 766 bp, Homo sapiens
  misc_feature: GYAE6OF02HENKZ.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgtcgctacttcggtagggtgtatcaactataaacgtccggacaggcctacccgaggtcctcctctattctttagattcgtcctttacgaacgtacgggtcccctgggacccgttcccgaggtctacgggtttaccagggtcggacgtaggttcggggttcgtaggggtaactacgggtaacctttcgaaccgttcctaccgaaccctagttacccgaggtccgtaacgtacccgtaacggaaccggtcccgttaaggtaaacggtttacgttttacggtaacgtttaaaggtttttaacttaacggtttcgttacgtaacggtacgtaacggtccgttacggtacccgtttacggtttccgggggtacgggttaacgggtccgtacccgttacggtttccggggaaccgggtaaacgggtaaaccgtaaaggtacggtacggtaaccgtaaaccggtaacgttacgggtacgtaccgtacggtaccgtaaccgttcgttaccggttcgttacgttacccgtacgttccccgg

SEQ ID NO: 12497 - DNA, 700 bp, Homo sapiens
  misc_feature: GYAE6OF02HARIV.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtctgggggaggcgtggtccggccgtgggggtccctggagactctcctgttctgcgtctggattcatctttagtaaatctggcatgtcctgggtccgccaggttccaggcccacgggctggaactggggtggcagatatacgaatatgatgacagtaaaatatactataggagactccttacgaagggccgattcaacctatcctaccaggacgaacctaaactttacccgaaaagaacctagttacgggtagttaacttcgtaggaacctaaaagttccggaacccaagtcccgtaggaaacggtaccggacccggaacggggtaaccgtaaccggggggtttagtttttaacgtttaaaccggttgggttagggggtaaacgtaaaagtttccccggtaaaggttcgggaccctagttccccgtaacccgtttggggtaacttttcggtacgtaccgggtttacccggggacccgtaaacggggggtacccgttcgggtacccgtacccggttcctttaccccggg

SEQ ID NO: 12498 - DNA, 608 bp, Homo sapiens
  misc_feature: GYAE6OF02GZIEN.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaancgccacctctcctgcagggccagtcagagtgttcgctacgttcggttagggtggtatcaacataaatccggccaggcctcccaggcctcctcattctttgatcgtctttcaacgtacgggcccctgggccgtcccgagggctacggttcaggtcggacgtaggtgggtcgtgggacagtacttcacgtctccaccatcagcacgtccagacgtccgtaggaagttagtttgacttagttttacttacgttgttcagtacgtgtcgtcgaccttacggttcgggcggtacggtcgtccgttacggtttccgggacgggtaacggaacctaaagtacggtacggtaacaaacggtaacgtggtacggactacgactaccgtacttcgttcgtacttcgtattcccg

SEQ ID NO: 12499 - DNA, 577 bp, Homo sapiens
  misc_feature: GYAE6OF02HGM95.10.71.G05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (286)..(286): a, c, t, g, unknown or other
  misc_feature (286)..(286): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctntcctgcagggccagtcagagtgttcgctacttcggttagggtgtatcaacataaatccggcagctccagctcctnatcttgatgtctttacaacgacgggtcccctggccgtcccgaggcaggttcaggtcggcaggttgggtcgtggggacaggtacttcactctcaacctatcagcagtcctagacgctagaagtatttgctagtttattactgtctagctagcgtctctacgttcggcggtagtcgcctacgttccgggacggtaacggaaccgtaaaagtacggtaacggtacaaacggtacgtcggtacgtacgtacgaccgaccgtacgttacgtcgttaccttactacttccctacccg

SEQ ID NO: 12500 - DNA, 541 bp, Homo sapiens
  misc_feature: GYAE6OF02GFUAC.10.71.G05.1.454.CMB.1.raw
  modified_base (201)..(201): a, c, t, g, unknown or other
  misc_feature (201)..(201): n is a, c, g, or t
  modified_base (210)..(210): a, c, t, g, unknown or other
  misc_feature (210)..(210): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctntcctgcagggccagtcagagtgttcgctacttcgttagggtgtatcaacataaatccggccaggctcccaggctcctcatctttgatgctttcaacgtacgggcccctggccgtcccaggctaggttcagtggcaggtggtctgggacagacttcactctcaccatcagcagcctagacgctgaagtattttgctagtttactactgtacagctagtcgtcgcctacgtttcggcggtaggtcgccgtacgtttcggacggacggaaccaaagtagaggtacaaacgtacgtgtaggctcgacgactatcgtcgttctctactcctacccg

SEQ ID NO: 12501 - DNA, 591 bp, Homo sapiens
  misc_feature: GYAE6OF02FHUPZ.10.71.G05.1.454.CMB.1.raw
  modified_base (204)..(204): a, c, t, g, unknown or other
  misc_feature (204)..(204): n is a, c, g, or t
  modified_base (314)..(314): a, c, t, g, unknown or other
  misc_feature (314)..(314): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangccaccctctcctgcagggccagtcagagtgttcgcacttcggttagggtgtatcaacataaatccggcaggcctcccgaggcctcctcatctttgatcgctttacaacncgggccctggccgtcccgaggctaggttcagtcggctaggtgggtctgggacaggtacttcgactctcacatcagcacgctagacgtccgtagtaagtatttcgacttagtttactactgtcagctagcgtcgaccgttacgtttcggcggtaggtcgtaccgtacgtttccgggcggtaacgggtaacctaaagtacggtacggtaaccgaaacggtaacgtaggtacggtacgtacgtaccgaccgtacgttcgtacgttccttactacttcccg

SEQ ID NO: 12502 - DNA, 648 bp, Homo sapiens
  misc_feature: GYAE6OF02J0U1G.10.71.G05.1.454.CMB.1.raw
  modified_base (198)..(198): a, c, t, g, unknown or other
  misc_feature (198)..(198): n is a, c, g, or t
  modified_base (225)..(225): a, c, t, g, unknown or other
  misc_feature (225)..(225): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttgacacagtctccagccacgctgtctttgctccaggggaangccacctctcctgcagggccagtcagngtgttcgcactttcggtaggtgtactcaacataaatccggcagcctaccagctcctcattcttgatcgtcttcgaactcgggcccctggccgtcccgaggtccaggttcgagtggactggtggtcgtacgggacgagtaccgttcaccgtactccaacctatccgacgtaccgacgtacccgtaacgacggccctaggtaacgtattttggacttaaggttttatacttcgttacctaggtactaggccgttcacccggttacgtttcgggacggtaacggtcgtcccgttacggtttccgggacgggtaacggaaccgtaaaaagtacggtaacgggttaccgaaagtaccgttgggacgggtactaccggccgtaacctacgttcctacggtttaccctcgtacccgttccgtttaccccg

SEQ ID NO: 12503 - DNA, 597 bp, Homo sapiens
  misc_feature: GYAE6OF02F11PX.10.71.G05.1.454.CMB.1.raw
  modified_base (302)..(302): a, c, t, g, unknown or other
  misc_feature (302)..(302): n is a, c, g, or t
  modified_base (417)..(417): a, c, t, g, unknown or other
  misc_feature (417)..(417): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcacataatccggcagctccagctctcatcttgatgctttcaacncgggcccctggccgtcccgaggcaggttcaggtggcaggtgggtctgggacaggtacttcactctcaccatcagcagctagcgcctgaatatttgacgtagtttattactgtacngcagtctcgcctacgtttccgggacgggtaggttcgacccgttacggtttccggggaccgggtaaacgggtaaccgtaaaagttacgggacggttaaccgaaaaccggtaaccgttacgggtacgggtccgttacgaccgaccgtacttccgttacgtttccttacgtacgtttaccccg

SEQ ID NO: 12504 - DNA, 554 bp, Homo sapiens
  misc_feature: GYAE6OF02FLCAL.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaangcccaccctctcctgcagggccagtcaggagtgttcgcactttcgttaggggtgtatcaacataaatccggcaggctccaggctcctcatctttgatgctttcaacaggccctggcgtcccaggcaggttcagtggcaggtggtctggggacagacttcactctcacctatcagcagcctagagcctagaagtatttgctatttatactgtcagcagcgtgcctagtttcggcggtaggtcgccgtacgtttcggacggtaacggaccgtaaaagtacgacggtacaaacgtacgtggtacggtccgtaggactaaccgacgttcgtagttccttcgtacttcccgttacccg

SEQ ID NO: 12505 - DNA, 553 bp, Homo sapiens
  misc_feature: GYAE6OF02GAASX.10.71.G05.1.454.CMB.1.raw
  modified_base (306)..(306): a, c, t, g, unknown or other
  misc_feature (306)..(306): n is a, c, g, or t
  modified_base (391)..(391): a, c, t, g, unknown or other
  misc_feature (391)..(391): n is a, c, g, or t
  modified_base (422)..(422): a, c, t, g, unknown or other
  misc_feature (422)..(422): n is a, c, g, or t
  modified_base (436)..(436): a, c, t, g, unknown or other
  misc_feature (436)..(436): n is a, c, g, or t
  modified_base (446)..(446): a, c, t, g, unknown or other
  misc_feature (446)..(446): n is a, c, g, or t
tcagcatagtagtgcacgaccggtgctcgatttagtgtcgtcgcaagagagagggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtggtccggccgtggggggtccctgagactctcctgtctgcgtctggattcattctttagtaaatctggcatcgtccgtcgggtccnccgtaggttcccgaggcccacgggctggaagtggggtcggcagatatacaatatgatagactaagtaaaatataactagtagganactcctagagggtccatcactatctacaganacaattacaaaganatgtatatcngataatcgacagcctagacgacggccgagacgtacgggttagtttagtacgtaggtagggtaataacgtccgttaggtcggtacctataccgtaccgttaggttacg

SEQ ID NO: 12506 - DNA, 636 bp, Homo sapiens
  misc_feature: GYAE6OF02GOK3A.10.71.G05.1.454.CMB.1.raw
  modified_base (204)..(204): a, c, t, g, unknown or other
  misc_feature (204)..(204): n is a, c, g, or t
  modified_base (368)..(368): a, c, t, g, unknown or other
  misc_feature (368)..(368): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgcagggccagtcagagtgttcgctacttcggttagggtgtatcaacataaatccggccaggctcccaggctcctcatcctttgatgctttacacacgggcccctggccgtcccaggctaggttcaggtcggcaggttgggtcgtgggacngacttcgactctccactatccagccagtcctaagacgtcctagtaagtacgttttgacgttagttttaacttacgtgttacgacgtgtacgtcgtcgtaccctacgtttccgggcgggtacggtcgtcccgttacggtttcgggaccgggtaacggggaacctaaaaggttcggtaacggttaaccgaaaacgggtaaccgttagggtacggtacgttacgcccgtaaccgtagttaccgttcggtttacttccgtactttacccccg

SEQ ID NO: 12507 - DNA, 697 bp, Homo sapiens
  misc_feature: GYAE6OF02I9WOX.10.71.G05.1.454.CMB.1.raw
  modified_base (203)..(203): a, c, t, g, unknown or other
  misc_feature (203)..(203): n is a, c, g, or t
  modified_base (229)..(229): a, c, t, g, unknown or other
  misc_feature (229)..(229): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgagggaaangccacctctcctgcaggccagtcagngtgttcgctacttcggtagggtgtatcaacataaactccggacaggcctcccgaggcctctacattcctttgatgtctttacaacgacggcccctggccgtcccaggctacggttcaggtcggacaggttcgggtcgtgggaacgtagtaccgttcaactctacgacctatccacgtccacgtaccgtaagaccgacgtagaaagttatttacgcgttaagtttaacgttacgttcggttactacggcgtacgcgttcgtaccgttaccgtttcgggtaccgggtacggtttccgacccggtttaccgttttcggggaccgggtaaacgggtaaaccgtaaaacggtacgggtaacgggttaaccgaaaaaccgggttaccgttagggtaccggtaccggttaacggacccgttaaacccgttcgttaacccgttccggtttaccttaccggtaccgttttacccccg

SEQ ID NO: 12508 - DNA, 780 bp, Homo sapiens
  misc_feature: GYAE6OF02H0S96.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccaccctgtctgtgtctccgagggganagacgccaccctctcctgcgacgggccggtacagaatattgacctacaacttgacctggtactacaaacaaacgcctcggccacggccctaccagtaccttccgtactactccgttcgttcgggtacgcgtacttccggttacggaacggggtcccttaacggttcgggtacccgtaccccgacgggtacccgttaggggttaccacgggttcggaccggttaacgggttcggggttaccgtaacgggaaaacgtaacgggttaacgttaccgacccgttaccgttacccgtaaacccgtaattacccggtaaccggggcccggttaacccgtcgggtaaacccgtacgttaacccggtaaggtaaaacgttttcgttttacaccggtttaaagttttacttaccgtgttacgagtccgtaagtaagtttacgacgttacggttttaggttttacttacggttaccgtttccggtaccggtaaggtaactaacgggttgttacttacgaacggtaaccgttaggttcgtacggtacctaggtacctaccgtacttacgtttcgttaccgttacctaccgg

SEQ ID NO: 12509 - DNA, 816 bp, Homo sapiens
  misc_feature: GYAE6OF02JTTLN.10.71.G05.1.454.CMB.1.raw
  modified_base (200)..(200): a, c, t, g, unknown or other
  misc_feature (200)..(200): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgagggaanagccaccctctccgtgcgagggccagtcagagttgttcgctacgttcggttagggtgtatacaactataaacgtccggaccgacggcctcccgaggtcccttcctactattccgtttagacttcgtactttacgaaccggtaccgggtccccgtcggtccgtcccgagggtccgtaacgggttccgaaggttcggcggtaggttcgggtaccgtacggggtaccgtacggttaccgtttacgacccgtttacctaccgtaacctaacgtaccgtacgacctacggtcctaacgggtaccgtacccgttaaggaaaggttttcttttcggtaacgtttaacgttttaaccgttaccgtaggtttaaccgaacgttacgttacgggtcccgttaggacccgttttacggttacccggggagggttaaccggtttccgtaccccgggtttacgttacccgggggtaccgggaacgggtaaaaccttaaaagggtaccgggtaacggttaacccgtaaacgggtaaccggttcggaggttacccgtaacggtaacccgttaaccggtacgtttacccggttagttaaccccgttcttacccggttccccctttaacccgg

SEQ ID NO: 12510 - DNA, 680 bp, Homo sapiens
  misc_feature: GYAE6OF02F3GSQ.10.71.G05.1.454.CMB.1.raw
  modified_base (203)..(203): a, c, t, g, unknown or other
  misc_feature (203)..(203): n is a, c, g, or t
  modified_base (414)..(414): a, c, t, g, unknown or other
  misc_feature (414)..(414): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacgttcggttagggtgtactcaacataaatccggaccaggctccccaggcctcctcattcttgatgctttcaacacgggcccctggccgtccgaggcaggttcaggtcgcgaggtgggtcgtgggacaggtactcacgtctaccacatcagcacgccgtagacgcctagaagttntttagtccttaagtttacttacttcgtacagcgtaggtccgttcgcccgttaacgtttccggggacggggtacgtacggtacccttaccgggttttccggggaaccgggtaacggtaaacccgtaaaaagtaggggtaaccgttaaccggtaaaaccgggtaaccttaggggttacccgggtaccggtaccgggtaacccgtaaaccccggttatttcccggtttacccgtttacccgttttaccgtaacccgttttaccccccgg

SEQ ID NO: 12511 - DNA, 657 bp, Homo sapiens
  misc_feature: GYAE6OF02I7KXU.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagcccagctgtctttgctcgaaggggaaangccaccctctcctgcagggccagtcagagtgttcgctacttcggtagggtgtatcaacaataaatccggccgagcctccacggctccctacgtacttctttagatcgtcttttacgaaacgaccgggccccgtcgggccgttcccgacgggcctaggtttcgagtcggcgtaggtaggggtctacggggaactacggtaccttcaccgtctaccaacctactcaacgacacgtacctaacggagtcccgtaggaacgtagttttcgacttaagtttacttaccgttagttacagtaccgtaacgtcgggtctaccgttacgtttccgggcggtacgggtcgacccgttacgtttcggggtaaccggaacgggaaacctaaaagtacggaacggtaacgaaacggtaacttcgtacggacgtcgactacacgttcgtagtccttactacttcccg

SEQ ID NO: 12512 - DNA, 699 bp, Homo sapiens
  misc_feature: GYAE6OF02HI841.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagttgttcgctacgttcggttagggtgtatcaacataaacgtccggcaggcctacccgaggtcctcctcattctttagattcgtctttaccaacgtacgggcccctggccctacccgaggccgtaggttcaggtggcgtaggttggggtctgggacagtacccttcactctacacctatacgacgtcacgtaccgttacgacgtccgtaggtaagttacttttcgacgttagttttaacgttacctgttaacgagtaccgtaggtccgttacgtacccgttaacggtttccggggacgggttacggtaccgttacccggttaccggttttaccgggggaaccgggtaaccgggtaaaacctaaacggttaggaaccggttaaccgaaaaccgggtacgttaggttaccgggccgttacgtaaccgtacccgttacgttccgttacttccgtttaccgtactttaccccg

SEQ ID NO: 12513 - DNA, 686 bp, Homo sapiens
  misc_feature: GYAE6OF02GPPRM.10.71.G05.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagaggggggggggaggaactgctcagttaggacccagagggaaccatggaagccccagctcagcttctcttcctcctgctactctggctcccagacaccacggagaaattgtgttgacacagtctccagccacgctgtcttgtctccgaaggggaaancgccaccctctcctgcgacgggccagtcagagtgttcgctacgttcggttagggtgtatacaacaataaacgtccggaccacggcctacccgaggcctcctactacttcgtttgattcgtcctttaccaacgtaccgggtccccgtggtacccgtcccgaggtccgtacggttcgaggtcggcgtaggtcggggtcgtagggactacgtacttacgactcgtaccaccagtaccgacgacacggacctaagacgtactaggtaagttatttagacgtttagtttacttacgttgtacgtacgtacgtacggtccggtactaccgttaccgggtttccgggacgggttacggtccgtacccggttaccggttcggggaccgggtaaacgggaaacctaaacggtacggtaagggtaaccaaacggtaacggttaggcggtactacgaccacgttactccgttagtccgttacacttcccg

SEQ ID NO: 12514 - DNA, 877 bp, Homo sapiens
  misc_feature: GYAE6OF02FUWOJ.10.71.G05.1.454.CMB.1.raw
  modified_base (214)..(214): a, c, t, g, unknown or other
  misc_feature (214)..(214): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgctccgaaggggaancgccaccctctcctgcagggccagtcagagtgttcgctacgtttcggttagggtgtatcaaacataaacgtccggccaggcctcccgaggccttcctcgacttctttgacttcgtccttttacgaaccgtaccggggtcccccttggggcccgttccccgaggggtccgtaaggggttttccgaacgggttcggggacgtaacggggttcgggggttcgttaacgggggaacctaacggtacccttttaccgaacccgttccgttacccaaacccgtacgttaccgaacggaccgttaaccggccccgttaacgggtaaccggtacccgttaagggtaaacgtttaacgttttttacggtaaccgttttaaacggtttttaacgttttaaccgttacggttaaccgtaaccggtaccgtaacggttccggttaacggacccgttaacgggttcccggtttacccgggtcccccccgtttcccgtttaccccccggttacccgtttaacccggtttttacccgggggacccgggggttaaacccggggtaacccgggttaaacgggggttacgggtaaaccggtaaccggttaaacccggtaaaacccgggtaaccggttacggggttaaccgggtaccgtacggtacccgtacccgttaccgg

SEQ ID NO: 12515 - DNA, 671 bp, Homo sapiens
  misc_feature: GYAE6OF02IHRC6.10.71.G05.1.454.CMB.1.raw
  modified_base (212)..(212): a, c, t, g, unknown or other
  misc_feature (212)..(212): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctccagacaccaccggagaaattgtgttgacacagtctccagccacgctgtctttgtctcgaggggaangccacctctcctgcacgggccagtcagagtgttcgctacttggttagggtgtatacaacaataaactccggcacggcctcccgaggtcctcctctattctttgattcgtcttcaacgtcgggcccctggccgtcccgaggtcctaggttcaggtcggcgaggtggtcgtacgggacagtaccttcacttctaccacctatcgagcctacgtaccgtaggacgtaccgtagaagttacgttttacggactttaaggttttacttacgttcgttacgtacggacgtacggtcggttacgacccgttacggtttccgggcgggtaacgggttccgaccgttacggtttccgggacgggtaacgggtaaaccgtaaaaggtcggtaaccggttaactaaaaccggtttaacggtacgggttacggtacgttaccggaacctaaccgttacgttcgttaaccgg

SEQ ID NO: 12516 - DNA, 604 bp, Homo sapiens
  misc_feature: GYAE6OF02JBOVN.10.71.G05.1.454.CMB.1.raw
  modified_base (202)..(202): a, c, t, g, unknown or other
  misc_feature (202)..(202): n is a, c, g, or t
  modified_base (447)..(447): a, c, t, g, unknown or other
  misc_feature (447)..(447): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagtgtcgctacttcggttagggtgtatcaacataaactccgccaggcctcccaggcctcctcattctttgatcgtctttcaacgacgggcccctggccgtcccaggctaggttcaggtgctaggtggtcgtagggacagtacttcactctccacatcagcacgcctagacgcctagaagtatttgcttagtttacttacgtgtacagcagtcgtcnccgtacgtttcgggcggtacggtcgtaccgtacgtttccgggacgggtaacggtaaacctaaaagtacgggtaaggtaccgtaaacggtaacgttgggtacggtcgtacgtaccaccgtactccgttacgttacttcctaccgttcccgttaccccg

SEQ ID NO: 12517 - DNA, 589 bp, Homo sapiens
  misc_feature: GYAE6OF02IXUEE.10.71.G05.1.454.CMB.1.raw
  modified_base (201)..(201): a, c, t, g, unknown or other
  misc_feature (201)..(201): n is a, c, g, or t
  modified_base (299)..(299): a, c, t, g, unknown or other
  misc_feature (299)..(299): n is a, c, g, or t
  modified_base (341)..(341): a, c, t, g, unknown or other
  misc_feature (341)..(341): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagacaccaccggagaaattgtgttcgacacagtctccagccacgctgtctttgtctccaggggaaangccaccctctcctgcagggccagtcagagtgttggcagcaggttagcctggtaccagcagaacgtggccaggcctcccgaggctctcgtatagtggtncatccaccgagggccagtggtatcgtcgaggctaggttccgnggcaggtgggtctggggacaggtacttcactggtaccacctatcacgcacgcctgctagtctagaagtactttgacttagtttacttacgttgtcagtccgtagttactaagtacgtcgtacgggcccgtacgtaccggtttacgggacccgtaaaggggacccgtagggtacggaactttaccggaaaacggtacgttggtcggtacgtacggacccgtacctagtccgttggttccttacgtaccg

SEQ ID NO: 12518 - DNA, 572 bp, Homo sapiens
  misc_feature: GYAE6OF02ITS8R.10.71.G05.1.454.CMB.1.raw
  modified_base (192)..(192): a, c, t, g, unknown or other
  misc_feature (192)..(192): n is a, c, g, or t
  modified_base (252)..(252): a, c, t, g, unknown or other
  misc_feature (252)..(252): n is a, c, g, or t
  modified_base (260)..(260): a, c, t, g, unknown or other
  misc_feature (260)..(260): n is a, c, g, or t
  modified_base (341)..(341): a, c, t, g, unknown or other
  misc_feature (341)..(341): n is a, c, g, or t
  modified_base (374)..(374): a, c, t, g, unknown or other
  misc_feature (374)..(374): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccaggtaccaccggagagattgtgttgacgcagtcgccagccaccctgtctttttcnccaggggacagagtcaccctctcctgtagggccagttatggtgttggcgcctattaaacnggtaccanagaacgtgcaggctccagctctcatctacgagcatccacaggccactggcctccagccaggttcatggcagtggctggacngacttcacgtctcacatcagcacgccgtggacnccgtagaatatatgctaagtttatattgtacagtcagtcgtagacgtggtcggtcctttacgaccgtttaccgggacccggggtaacaaaggttcggaaaataccggaaacgtaaccgtgggttacgacttcggaccctaactacgtacgtacgttacgttcctacgttcccttacccggacctacgttcgtaaccgg

SEQ ID NO: 12519 - DNA, 916 bp, Homo sapiens
  misc_feature: GYAE6OF02JCIWV.10.71.G05.1.454.CMB.1.raw
tcagcatagtagtgcacgaccggtgctcgatttagtgtcgtcgcaagagagagggggcctccattcggtgatcagcactgaacacagaggactcaccatggagttggctgagctgggtttcctcgttgctctttaagagatgtccagtgtcagatgcagagtggtggagtcgtggggaggcggtacggtccggccggtcgggggtccctggacgtaccgtcgtccgtgttccgtggtccggttcgtaggtacttcgtacgttacgtttaagtaaactcgttacggctagttcgtccgtacgggtcccgtccgtacggtttccgacggtcccgtaccggggtcgttacgggtaacggttcgggggtacggtaccgtaaggttaacgttaacgttaaccgtaaagtttacggtacggtaaacgttacggtaaaaccgtaaaacggtttaaaaacgttaacgttaaaccgttaaggttaacggtaaccggttaacccgtttacccgtttaaccggtaaacggggtaccccggttaacgtttacccgtaacccgttaacgttacccgttaacccgtaaacggtaaccgtaaccgttaaaccgtttacccgaaaaaggttaacccgttaagtttaccggggttaactttaacccgttaggtaaccggttaaaccgaaagttacccgaacccgtagttaccccgtaggaaccggtacgtacccgggtaacggtaaccggttacgggtttaactttaaccggttacggtaagggttacgggaaacttaaaccgttacggtaaggtcgggaccttacgttaccggtaacggttgggtttaataccgggttagttaccccggttagggaaccccggtttaacgggaacccgtttcggtaacccgtacccggtttcctaacccggg

SEQ ID NO: 12520 - DNA, 595 bp, Homo sapiens
  misc_feature: GYAE6OF02HD3SO.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtgtatcaacataaatccggccaggcctccgaggctcctcattcctttgatgtcttttacaacgacgggcccctggcctcccaggcctaggttcagtggcagtgggtctgggacaggacttcactctcaccatcagcagcctagacgcctagaagtattttgacttagtttacttacgttcgttacgagtcgtacgtcgttcgtacccgttacgttttccggggcgggtaacgggttcgcccggttacgtttccggggcggtaacgggaacctaaaggtacggacggtacaaacggtactaggtcggacttcgactaccgtagtccttcgtacttcgacttcccg

SEQ ID NO: 12521 - DNA, 580 bp, Homo sapiens
  misc_feature: GYAE6OF02IBXK5.10.71.G05.1.454.CMB.1.raw
  modified_base (176)..(177): a, c, t, g, unknown or other
  misc_feature (176)..(177): n is a, c, g, or t
  modified_base (179)..(179): a, c, t, g, unknown or other
  misc_feature (179)..(179): n is a, c, g, or t
  modified_base (182)..(187): a, c, t, g, unknown or other
  misc_feature (182)..(187): n is a, c, g, or t
  modified_base (189)..(189): a, c, t, g, unknown or other
  misc_feature (189)..(189): n is a, c, g, or t
  modified_base (191)..(191): a, c, t, g, unknown or other
  misc_feature (191)..(191): n is a, c, g, or t
  modified_base (193)..(193): a, c, t, g, unknown or other
  misc_feature (193)..(193): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (204)..(204): a, c, t, g, unknown or other
  misc_feature (204)..(204): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (274)..(274): a, c, t, g, unknown or other
  misc_feature (274)..(274): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcggtcgtttcgcgtaggcgtcttaagagnncngtnnnnnngngngngngngnggngngtgcgcgtggcngagctntctgtntgcgtntagtntgtatcttaagtaatgtgntgtcgtcgtcggaccncgtagtcgagccgacggtcgtagacgtcgggacgagtagtaacgtacaagtacgtagtacgatagtaagtaagtaaatagtagtagtacgtacgtacgtacgtacgtacgtacgtacgtacgtactacgtactacgtacgtacgtacgtacgtaacgaacgtaacgtagtacgtacgtacgtacgtacgtaacgtaacgtacgacgacgacgtagacgacgacgtacgtacgtacggttacgttacgtacgtacgtacggtaacgtaacgtacgtacgtacgtacgtacgtacgtacgttagtacg

SEQ ID NO: 12522 - DNA, 754 bp, Homo sapiens
  misc_feature: GYAE6OF02JE790.10.71.G05.1.454.CMB.1.raw
  modified_base (206)..(206): a, c, t, g, unknown or other
  misc_feature (206)..(206): n is a, c, g, or t
  modified_base (589)..(589): a, c, t, g, unknown or other
  misc_feature (589)..(589): n is a, c, g, or t
tcagcatagtagtgcacgaccggtgctcgatttagtgtcgtcgcaagagagaggggggaggaacgtgctcagttaggacccagagggaaccatggaagccccagctcagcttctcttcctcctgctactctggctcccagaccacccaccggagaaattgtgttgacacagtctccagccacgctgtctttgtctccaggggaaancgccaccctctccgtgacacgggccagtcagagtcgttcgctacgttcgtaggggtcgtatcgaactataactcccggaccaggcctacccgaggtcctccgtactattccttttgacttgtctttaccgaacgtacgggtcccctagggaccgttccccgaagggcccttaacggtttcgaggtttccgggacctagggtttcgggggtcccgttaggggaaccctaggtaacctttccggaaccgttaccttccggaacctacgttcctaaccgggtactaccggacccgttaggtacgtaccccgttaggaaacgtttaacgttttacgacgttaagtttttacctacggttacgttcgacgggttaccagtccggtacnccgttacgtaccggtcggaaggtccaccggttacggttccgggaggtaacggtaaacgaaacgtagggtacgttaaccgaaccgtaacgggttagtccgggtacgtcggtaaaccctacccgggttaattccggtaccgtttaacggttccgtcctttaccccgg

SEQ ID NO: 12523 - DNA, 771 bp, Homo sapiens
  misc_feature: GYAE6OF02HWUUA.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtggggggtccctgagacgtctcctgttctgcgtctggattcattctttagtaaatctggcatgtcctgggtccgcaggttccaggccgacggctaggaagtggggtgcgagatatacaatatgatgaactaagtaaaatataactagtaggagtactaccgttacgaacgggacccgtacttaccaacctacttacctaccaagaacgaactaaacttaccgaaaacgtaaaccgtaagttagggttacgttaacgttacgttacggaactaaaacgttacgaaacccgtaacgtacccgttaggaaccggacggaccccgggtaaaggggtaacccgttaacgggggttttaacgtttttaacgtttaacggttagggttaacggggtaaacgttaaaccggttaccgttaagggttaccgggtaaccttaaccgttaacccggttaacccggttaggggtttaaccggttttacggttaccggttacccgggtttaaccccgggggtacccggtaaccggggttaaacccgggttcgggttaccccgtacccggtttcccgtttaccccgg

SEQ ID NO: 12524 - DNA, 650 bp, Homo sapiens
  misc_feature: GYAE6OF02H71SM.10.71.G05.1.454.CMB.1.raw
  modified_base (201)..(201): a, c, t, g, unknown or other
  misc_feature (201)..(201): n is a, c, g, or t
  modified_base (211)..(211): a, c, t, g, unknown or other
  misc_feature (211)..(211): n is a, c, g, or t
  modified_base (298)..(298): a, c, t, g, unknown or other
  misc_feature (298)..(298): n is a, c, g, or t
  modified_base (486)..(486): a, c, t, g, unknown or other
  misc_feature (486)..(486): n is a, c, g, or t
  modified_base (505)..(505): a, c, t, g, unknown or other
  misc_feature (505)..(505): n is a, c, g, or t
  modified_base (517)..(517): a, c, t, g, unknown or other
  misc_feature (517)..(517): n is a, c, g, or t
  modified_base (544)..(544): a, c, t, g, unknown or other
  misc_feature (544)..(544): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgctccgaggggaaanagccaccctntcctgcagggccagtcagtagtgttcgctactttcggtagggtggtatacaacagtaaactccggacaggcctaccaggcctcctanacttctttagattcgtaccttttacgaaacgaccgggtccccttcgggccgtacccccgagggtccgtaacgggtttcgaacggtcgggaccttaggggttcgggtcgtacgggggaactacggtacctttcaccgtttcaccgtaccaatcacggcaacgtctagagtccctaagaacgtagttttnacgtacgttttaatacgtntcgaagtcacgnttcgcttacgttcgggcggtaggttcnccgtacgttcgggaccggtaacgggaaactaaagtagggaacgtacgaaacggtagtcggtaggctcggaccaccgtatcggtacgttctataccgttcctaccgg

SEQ ID NO: 12525 - DNA, 779 bp, Homo sapiens
  misc_feature: GYAE6OF02IL99P.10.71.G05.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaattgtgttgacacagtcctccagccacgctgtctttgtctaccgagggaaagngcccaccctctacctgcacgggccagtcagagttgtcgctacttggttagggtgtactacaactaataactccggaccgacggcctcccgaggtcctcctacgtattctttgatcgtcctttacaaccgaccggtcccctgggccgttacccgagggtcctaggttccagggtcggcgtacgggtcggggtacgtacggggtacgtacgtaacctttccgacgtttcccgtaccgaacccttaacgttccgaggtaccgacggtacccgttaaacgggtacgtaccccggttaaggtaaacggttttcgttttacggtactttaacgggtttttactttaccggtagttaaccgtacggtaccgtacgggttcgtcggtacccttacgggtttacccgggtacgggtaccggttcgtacccgtttaacggggtttccgggaacgggaaccgggtaaaccgtaaaagttaccgggaacgggttaaaccgtaaaccgggttaacgttcgggtacggtaccgttacgacccgtacgttaccgttccgttaaccgttcgttaccaccgtttcccgg

SEQ ID NO: 12526 - DNA, 536 bp, Homo sapiens
  misc_feature: GYAE6OF02GNHL0.10.71.G05.1.454.CMB.1.raw
  modified_base (214)..(214): a, c, t, g, unknown or other
  misc_feature (214)..(214): n is a, c, g, or t
  modified_base (316)..(316): a, c, t, g, unknown or other
  misc_feature (316)..(316): n is a, c, g, or t
  modified_base (320)..(320): a, c, t, g, unknown or other
  misc_feature (320)..(320): n is a, c, g, or t
  modified_base (407)..(407): a, c, t, g, unknown or other
  misc_feature (407)..(407): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcgttagggtggtatcaacataaatccggccaggctcccaggctcctcatctttgatgctttnaacncgggcccctggccgtccaggcaggttcagtggcagtgggtctggacagacttcacttctcaccatcagcacgctagcgacctgaatntttgacttagtttattactgtcagcgtagcgtgcctcgtttcgggcgtaggtcgccgttacgttcgggcggtaggaccaaagtcggacggtacgaacgtacgtggtcggtctacgacacgtactctacg

SEQ ID NO: 12527 - DNA, 874 bp, Homo sapiens
  misc_feature: GYAE6OF02FVQ0F.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtcctgagactctcctgttcctgcgtctggattcattcgtttaagtaaatcgtggctatcggttccgtcgggtcccgacctacggttcccacgggtcccgacggggtcgtagggtaaacgttgggggtacggacgtaggtaagttaacttaaaccgaaagttaagtcggtaataacggaaactaaaacggttaaaaattaacgttaaacgttaagttaacgggaacgttaccctttaaccgttaaccgggtaaacggggtaccctaaacgttttacccaaccccgtaacgttaccctaccgtaaacgggtaacgtaaaaccccttaaaaccgtttaaccccgaaaaaaggtaaaccccgttaggtttaacggggttaacgtttaaaccgtaccggtttaacgaaacccgttaaaagtttacccgggaaacccgttaacgggaaccccggtttaaagggaaaccggtaacccgggaaacccgggtaaccggggtaaaccggtttacggggggttttaactttttaaacggtttaacccgggttagggttaaacccgggggtaaaaacgttaaccgttacccggttaacgggttacggtaccgttaaaccttcccggttaaccgtttagggtttaacccgg

SEQ ID NO: 12528 - DNA, 804 bp, Homo sapiens
  misc_feature: GYAE6OF02IWEU9.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgtctcttttaagagatgtccagtgtcagatgcagatggtggagtcgtgggggagcgtggtcccggcgtgggggtccctggagtctctcctgttctgcgtcgtggtattcacttcgtttaagtaaattcgtggctattcggttccgtcggggtccccgtccgtcggttccgacggccggtaccgggcgttacgggagttggggtacggcgaagtagtaacgtaacaattagtgtaatacgaactaaagtaaaatagttaactagtggtaactaccttacctacggaacggtacctacttaccaacctaatcccgtaaccgaagaacgtaacctaacttaacccgaaagtaaaccgtaagttagggttattaacgttccgtaagtaaccgtaaaacgtccgtaaccgaacggtacccgtaaggaaccggtacgggacccggtaacgggacggttaacgggtttacgttttaaacgttacgggttaagggtaacgggttaaacgttaaacggttacccggtaaggttcggaacccgtttagtaccggttaccggtttaggtttaacgggttccggtttaacgggttacccggggttaccccggggttaaccgggtaccggggttaaacccgggttccggttaaccccggtttaccccggttcccggttaaccccgg

SEQ ID NO: 12529 - DNA, 626 bp, Homo sapiens
  misc_feature: GYAE6OF02JHJYD.10.71.G05.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagagggggaggaactgctcagttaggacccagagggaaccatggaagccccagctcagcttctctttcctcctgctactctggctcccagaccaccaccggagaaattgtgttgacacagtctccagccacgctgtctttgctccgaggggaaaangccaccctctcctgcagggccagtcagagtcgttcgcacttcgtagggtgtatcacataatccggccagctccaggctctcatcttgatgctttcaactacggccctaggctccgaggccaggttcaggtcggctaggtcgggtcttcgggactacgacttcagtcctcacctatcacgctagcctaagcgcctagaacgtatttgctagtttacttaactgttacacgtcacggcgttacgccttacgtttcgggacggtacgggttcggacccttacggttttaccgggacgggtaaccgggaaaaccgttaaaacgttaacggtaagggtaacccggtaaaacggtaaacgttgggttacggacgttacggaccaccgttacgttaccgttcgttactttcttaacccgtttacccgg

SEQ ID NO: 12530 - DNA, 660 bp, Homo sapiens
  misc_feature: GYAE6OF02G5TG2.10.71.G05.1.454.CMB.1.raw
  modified_base (254)..(254): a, c, t, g, unknown or other
  misc_feature (254)..(254): n is a, c, g, or t
  modified_base (385)..(385): a, c, t, g, unknown or other
  misc_feature (385)..(385): n is a, c, g, or t
  modified_base (463)..(463): a, c, t, g, unknown or other
  misc_feature (463)..(463): n is a, c, g, or t
tcagcatagtagtgcacgaccggtgctcgatttagtgtcgtcgcaagagagagggggggggagaggagcccagcactagaagtcggcggtgcctccattcggtgatcagcactgaacacagaggactcaccatggagtttgggctgagcgttgggttttcctcgttgcttcttttaagagatcgtccagtgtcagatgcagagtggtggagtcggtgggggaggcggtcggtcccgggccggtggggggtcccnggacgtaccgtcctccgttgttctggcgttcgtggtacttctattcctttaagtaaactcgtggactagtcgtccgtcgggtcccgccgtacggttccgaggccgacgggctaggagtgggtggcagatanaacaatatgatacgaacaaagtaaaatattaactagtaggataccttcgtacgaagggccgtattaccactactaccnctaagtaacaacctaattaaccaaagaactagttggtattactcgtaagactaaagtacgaacctacggtacctacggaacggtacgaccgggtaacggtaacggtcggggtttaactttaacggttaaggttacgggtaaacgggaagtaacgttaccgtaggtaccgacgtaagtaccctaggttacggttaacg

SEQ ID NO: 12531 - DNA, 663 bp, Homo sapiens
  misc_feature: GYAE6OF02GTU70.10.71.G05.1.454.CMB.1.raw
  modified_base (202)..(202): a, c, t, g, unknown or other
  misc_feature (202)..(202): n is a, c, g, or t
  modified_base (413)..(413): a, c, t, g, unknown or other
  misc_feature (413)..(413): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaancgccaccctctcctgcagggccagtcgagagtgttcgcacttcggttagggtgtatcaacaattaactccgggaccaacggtcctcccgaggtcctcctcattctttgatgtcttacgaacgcggtccctggcctaccgaggcctggttacaggtcgctaggtgggtactgggactaggtacttcaccgtctaccactagtcacgtcgacncgtagacgtctaaggaacttgttttacggactttaacgtttacttacgtcgtacgagtacgagtcgtcgtaccttacggttcgggaggtacggttccgccggttacgtttacgggacgggtaaacggtaaacccgtaaaaggtacgggtacggtaaccgtaaacgtacggttaacggtacggacgttaccggaccgtaaccggttagttcgttaccgtttaccgtttacgtaccctttcccgttaccccg

SEQ ID NO: 12532 - DNA, 651 bp, Homo sapiens
  misc_feature: GYAE6OF02IM0J3.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcttgggttttcctcgttgcttcttttaagagatgtccagtgtcagatgcagtatggtggagtcgtggggagcggtggtccggccgtcgggggtcctgacgactctcctgttctgtcgtcgtggtacttctattctttaagtaacttcgtgtactagtcgtccgtcgggtccgtccgtaggttcccgacggcccgacgggtcgtaggtagtgggtacgcagaatatacaatagtgatagaataagtaaactatacgtagtagagtactccttacggaaggtccgtatccaactactcgtacagtaactacaacttaccgaaagtactaggtagttatactacgacgaacctaaagtccgaacgtaccgacgtaacggaaggtacccgacggaacgggttaacgtacgggttttagttacgttaacggtagggttaacggtaaacgttaaccggttaacgttacgggtaacctacgtacgtaacccttcgggttaaggtttaccgg

SEQ ID NO: 12533 - DNA, 741 bp, Homo sapiens
  misc_feature: GYAE6OF02HUAEN.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaanacgccaccctctcctgcagggccagtcagagtgttcgctacttcggttagggtgtatcaacataatccgacaggcctccaggctcctcattctttgatcgtctttacaaccgcgggtcccctgggccgtacccgagggccgtacggtttcaaggttcggcgtaggtcgggtcgtaggggactaggtacctttcacgttctacaacctagtcacgcacgtacccgtagtaccgaccgttaggtaacgttagtttttcggacgtttaagttttacgtttaacgttcgttaaccgtacgtaccgtacgtccgttacggtacccgttaccggttttccgggggaccgggttaacgggttccgtacccggttaccggttttacccggggaccgggtaaaccggggtaaaaccctaaaaggttacgggtaacgggtaacccggtaaaacggttaaccggtttcggtacggtaccgtacggaaccctacccgttagttccgtttaccggttaccttttaccgttacccttaccccgtttaccccgg

SEQ ID NO: 12534 - DNA, 525 bp, Homo sapiens
  misc_feature: GYAE6OF02JB145.10.71.G05.1.454.CMB.1.raw
  modified_base (290)..(290): a, c, t, g, unknown or other
  misc_feature (290)..(290): n is a, c, g, or t
  modified_base (379)..(379): a, c, t, g, unknown or other
  misc_feature (379)..(379): n is a, c, g, or t
  modified_base (393)..(393): a, c, t, g, unknown or other
  misc_feature (393)..(393): n is a, c, g, or t
  modified_base (402)..(402): a, c, t, g, unknown or other
  misc_feature (402)..(402): n is a, c, g, or t
  modified_base (408)..(408): a, c, t, g, unknown or other
  misc_feature (408)..(408): n is a, c, g, or t
  modified_base (416)..(416): a, c, t, g, unknown or other
  misc_feature (416)..(416): n is a, c, g, or t
  modified_base (448)..(448): a, c, t, g, unknown or other
  misc_feature (448)..(448): n is a, c, g, or t
  modified_base (511)..(511): a, c, t, g, unknown or other
  misc_feature (511)..(511): n is a, c, g, or t
tcagcatagtagtgcacgaccggtgctcgatttagtgtcgtcgcaagagagaggggggaggaactgctcagttaggacccagagggaaccatggaagccccagctcagcttctcttccctcctgctactctggctcccagacaccaccggagaaattgtgttgacacagtctccagccacgctgtctttgtctccaggggaaagagccaccctctcctgcagggccagtcagagtgttcgcattcggttagggtgtatcaacataaatccggcaggctcccaggctcctnatctttgatgcttcacgtacgggcccctggccgtcccacggcaggttcaggtggcaggtgggtcgtgggacagtactcgactcgtcacntcacgcagcctagncctagagtntttcgnttagtttntactgcagcagcgtcgctcgttcggcgtggcncgtcgttcggcggtagaaccgaatacgagtacaacggctagtcggactaggcaccgtattccngttcttctatcccc

SEQ ID NO: 12535 - DNA, 734 bp, Homo sapiens
  misc_feature: GYAE6OF02IXHEE.10.71.G05.1.454.CMB.1.raw
  modified_base (202)..(202): a, c, t, g, unknown or other
  misc_feature (202)..(202): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccgagggaaancgcccacctctcctgcgacgggccagtcagagtgttcgctacgttcggtagggtagtatacaaacaataaacgccggtccacggcctcccgaggcctcctcacttctttgagtcgtacttaccgaaccgacgggtccccgtcgggaccgtacccgacggacttacgggttacgaggtggctacggttgggcgttagggactagtacttcacctcgtacaccacgtacgacgacacgtacgtaacgacgtaccgtagtaaacgttagttttacgccgtttaagtttaacctttacgttcggtactacggtaccgtaacgccgttacggtacccgttaacggtttccggggaccgggttacgggtccggtaacccttacgggttttcccggggaacggggtaaacgggtaaaacctaaaagttacgggtaacggttaaacccgtaaaacggtaaccgttcgggtacgggtacctacggtaacctaaccggttacttacggttccgtttaaccgtttacctacgtttacccccgg

SEQ ID NO: 12536 - DNA, 691 bp, Homo sapiens
  misc_feature: GYAE6OF02HPONW.10.71.G05.1.454.CMB.1.raw
  modified_base (423)..(423): a, c, t, g, unknown or other
  misc_feature (423)..(423): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtcctccagccacgctgttctttgtctcgagggaaagcgcccacctctcctgcgaggccagtcagagtgttcgctacttcggttagggtggtatacaacaataaaacgtccggaccgtaggcctacccgaggtcctcctcacttccttagatcgtcctttacaaccgacggtcccctaggccgtcccgtaggcgtagttccgagtggcgtggtcggtacgtgggactacgtacgttcgacctctaccacactcgacanacgccagacgtccagtaagtagtttagtcttacgtttaacttacgtagtaccgtagtacgtacgtcgttacgtaccgttaccggtttcgggaacggtacgggtcgtaaccgtaacggtttaccgggaccgggtaaagggtaaacccgtaaaaacgttagggtaaacgggtaccgaaaacggtaaccggttcgggtacggtaccgtaacggtacccaacgttaaccgtccgttacgttccgtttaccttaccgttccccgttaaccccg

SEQ ID NO: 12537 - DNA, 892 bp, Homo sapiens
  misc_feature: GYAE6OF02H0LAX.10.71.G05.1.454.CMB.1.raw
  modified_base (161)..(161): a, c, t, g, unknown or other
  misc_feature (161)..(161): n is a, c, g, or t
  modified_base (201)..(201): a, c, t, g, unknown or other
  misc_feature (201)..(201): n is a, c, g, or t
  modified_base (226)..(226): a, c, t, g, unknown or other
  misc_feature (226)..(226): n is a, c, g, or t
tcagcatagtagtgcacgaccggtgctcgatttagtgtcgtcgcaagagagaggggggaacgtggctcagttaggaccagagggaaccatggaagccccagctcacgcttctcttcctcctgctactctggctccagacaccacggagaattgtgttgacncagtctccagccacgctgtctttgcctacgaggggaaacngccacctcgctgcaggccagtcagngtcgttacgaacgttcgttagggtgtactcaaactattaaaacgtccggtaccgacggtcgttaccccgaaggtccgttaccctaccgtacttaccgttttagaacgttcgttacctttaccgtaaccgtacgggtccccgttcggtaccccgtcccggtacggggtaccgtaacggtttccggaggtttcgggaccggtaaggtttcgggggacggttcggggtaaacctaaggggttacccttaccgtacgtttaccgtaccggtaaaccctactttacggaccggtaaccgtacgggtttaaccccggtaacgaaccgggttcccggttaacgggaaaacggttttacggttttaacgtaaccggtttaacggtttttaaacccgttaacgttttaccggtaacgacgggttaccttacgggtacggttccgggttaaaccgttcggtttaaccggggtcgggttaacgggttcccgtacccgggttacgtttacccggggaccggggttaaacgggtaaaacccggttaaaagtaaccgggggttaacgttaccgggaaaacccggttaccggtttacgggaaggttaccggtgtaacccgtaaccgtaaccgttcgttaccggttccgttaccggtacttaccccggttccccgtaaccgg

SEQ ID NO: 12538 - DNA, 672 bp, Homo sapiens
  misc_feature: GYAE6OF02HO79Q.10.71.G05.1.454.CMB.1.raw
  modified_base (162)..(162): a, c, t, g, unknown or other
  misc_feature (162)..(162): n is a, c, g, or t
  modified_base (173)..(173): a, c, t, g, unknown or other
  misc_feature (173)..(173): n is a, c, g, or t
  modified_base (213)..(213): a, c, t, g, unknown or other
  misc_feature (213)..(213): n is a, c, g, or t
  modified_base (248)..(248): a, c, t, g, unknown or other
  misc_feature (248)..(248): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccgganaaattgtgttnacacagtctcagccacgctgtctttgtctcgaggggaaangccaccctctcctgcaggccagtcagagtgttacnctacttcggttagggtgtatcaacataaatccggcaggcctcccgaggcctcctcattctttgatcgtctttaccaacgaccgggcccctggtccgtcccaggtcgtacggtttccgaggttcggcgtaggttcggggttcgtacgggactacgtaccttctaccttcctccgacctactcgaagctaacgaccgtagaccgtcgtacgtaacgttattttaggacctttaaggttttaacttcgttcgtacgtagccgtaagtccgttagtacccgttaccgtttcgggcgggttacggtccgtaccgttaccgggtttaccgggacgggtagggtaaacctaaaacggtaggtaaccggttaaaccaaaacggttaaccggtggttacggtccgtcgtaccgaacccttcgtaccgttacgg

SEQ ID NO: 12539 - DNA, 705 bp, Homo sapiens
  misc_feature: GYAE6OF02IDTF5.10.71.G05.1.454.CMB.1.raw
  modified_base (202)..(202): a, c, t, g, unknown or other
  misc_feature (202)..(202): n is a, c, g, or t
  modified_base (291)..(291): a, c, t, g, unknown or other
  misc_feature (291)..(291): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaanagcccacctctcctgcagggccagtcagagtgttcgctacttcggttagggtgtatcaacataaagtccggcacggctccgagctcctntatctttgatgtctttacaacgcgggccctggcactcccgagcctaggttcaggtcggcaggtgggtctagggactagtacttcacttctaccactatcgaacgtcagactagacgtaccgtaggtaaacgttattttgaccgttaagtttttacgttaacgttacggtactacggtacgtacggttaccggttacgaccgttaaaccggttccggggtacccgtttacccggggtaacccgggtttccggggaacccgtaaaaccggggtaacccggtaaaagggttaaccggaacccgtaagtaacccgaacggtaacccggtaacggttacgggttacggtaccggttaccgacccgtacccgttaacgttaccgttacgtttacccgttaccgtacccgtttaaccccgg

SEQ ID NO: 12540 - DNA, 590 bp, Homo sapiens
  misc_feature: GYAE6OF02FTP07.10.71.G05.1.454.CMB.1.raw
  modified_base (359)..(359): a, c, t, g, unknown or other
  misc_feature (359)..(359): n is a, c, g, or t
tcagcatagtagtgcacgaccggtgctcgatttagtgtcgtcgcaagagagagggggggggagaggagcccagcactagaagtcggcggtgcctccattcggtgatcagcactgaacacagaggactcaccatggagtttgggctgagctgggttttcctcgttgcttcttttaagagatgtccagtgtcagatgcagatggtggagtcgtggggggagcgtgggtccggccgtggggggtccctggacgactctcctgttctgcgtctggattcatctttagtaaatctggcatgtcctcgggtccgccgaggttccagggccgacgggtctgggaatgggtggcagatatacaatangatagacaagtaaatatactagtggagactcctacgaacgggtccgaacttccaaccgtactcctccgaacgagaacctaattaccaaagacctagttggtgtactcacgtacaaagtcgaaccaacgcccgtaagagacggaccgacggtacgtacggggttatttacgttacgtgggtacgggtaacgtaacgttccgtaggtcggtactacgtcctacgttgttacgg

SEQ ID NO: 12541 - DNA, 797 bp, Homo sapiens
  misc_feature: GYAE6OF02GV7NV.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgagggaaanacgccaccctctcctgcacgggcctagtccagagttgttccgctacgtttcggttagggtgtactacgaactataaacgtcccggcaggccctcccgaggtcctccctacgtacttcgtttgattcgtaccttttacgaaaccgtccgggtcccctgggtcccgtcccgacggtccgtaggttccgaggtcggacgtacggtcgggtcgtacgggactacgtacctttccgacctcgtaccaccgtacttacgacgtccgacgtaccgtagaaccgtccgtaagtaagtttgtttacgacgtttaagtttactaccgttgtaaccgtgtacctaacggtccgttaaccgtccgtttacggttaccggggacgggttacggttcccggtaccgtttaacgggttcccggggaacgggtaaccgggtaaaacccgttaaaagggttaaccggggtaaaccggttaacccggtaaaaacggttacccgggtttcgggttaaccgggtacccttaccggtaacccgtaaaccgttaccggtttccggtttaaccgttttaccgtttaaccggtacccgttttaccccggttaacccccgg

SEQ ID NO: 12542 - DNA, 655 bp, Homo sapiens
  misc_feature: GYAE6OF02GPKXJ.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctcgaggggaaangccaccctctcctgcgagggccagtcagtagtgttcgctacgttcggttagggtgtatacaactaataaactccggaccaggtcctccgaggtcctcctctacttctttagacttcgtacctttacgaacgtccgggccctggacccgtccgaggcctaggttcgacggtcggacgtaggtgggtacgtagggaccacgttacttcgacttcctaccgtaacctacgtacacgctacgaccgtaagaccgtccgtaaggtaacgttgtttcgacgtttaagtttaactcgtgttacgtagcgtacgtcgtacgtaccgttacggtttcggacgggttacggtcgtaccgttcggttaccgggacggtaaacggaacgtaaaggtcgacggtaacgaacggtcggtggtacggctacgactacgtattccggtcttacgtactaccgttcccg

SEQ ID NO: 12543 - DNA, 714 bp, Homo sapiens
  misc_feature: GYAE6OF02I030Y.10.71.G05.1.454.CMB.1.raw
  modified_base (176)..(176): a, c, t, g, unknown or other
  misc_feature (176)..(176): n is a, c, g, or t
  modified_base (195)..(195): a, c, t, g, unknown or other
  misc_feature (195)..(195): n is a, c, g, or t
  modified_base (257)..(257): a, c, t, g, unknown or other
  misc_feature (257)..(257): n is a, c, g, or t
  modified_base (303)..(303): a, c, t, g, unknown or other
  misc_feature (303)..(303): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctgcctccagacaccaccggagaattgtgttgacacagtctccagccacgntgtctttgctcgagggaancgcctacctctccgtgcgacgggctagtcagtagtcgttacgaacgttcgttagggtgtaancgaactaataacgtccggcgtaggtccgtaccgaggtcctcccttnaattccgttagtactcgtaccttacgaaccgcggtccccgttggaccgtcccgaggtccgtagttcaggtcggctacgggttcggcgtagggacgtactacgttctacccgtacgtccaacagttaccgagtacgacgtcgtacacgtccgtaggtaacgttagtttcgacgttaagtttcgtacgttcgacgtagttccgtacgtccggttagttcccgttaacggtttccgggacgggttaacgttccgggttacccgtttaccgggttaacggggaaccggttaaacggtaaacccgtaaaggttaaccgtacgggtaaacctaacgggtaacgttcgggtcggtaccgacgtaacctacccggttaatccggttccttcgttaacctccggttaccttccggaaccg

SEQ ID NO: 12544 - DNA, 636 bp, Homo sapiens
  misc_feature: GYAE6OF02INIPP.10.71.G05.1.454.CMB.1.raw
  modified_base (215)..(215): a, c, t, g, unknown or other
  misc_feature (215)..(215): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (480)..(480): a, c, t, g, unknown or other
  misc_feature (480)..(480): n is a, c, g, or t
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggctcccagacaccaccggagaaattgtgttgacacagtctccagccacgctgtctttgtctccgaggggaanagccacctctcctgcagggccagtcagagtgttcgactactttcgttagggtggtatacaacataaagtccggacaggcctcccaggcctctcattcgtttagatcgtctttacgaacgacggtccccgtggtcccgtacccgaggcgtacggttccgaaggtcggacgtaggttcgggtcgtacggggacagtacttcactctacacnctacngcacgcctaagctcgtagtaacgtgttttcgacgttaagttttatacgttntacgagacgtagtccgtacgtacccgtacgtttcgggcggttacggtcgaccgttaccgttccgggacggtacggaacccgtaaagttacggtaacggttaacaaacgtacgtaggtacggtaccgttacgaccgtaaccgttactaccgttccgg

SEQ ID NO: 12545 - DNA, 334 bp, Homo sapiens
  misc_feature: GYAE6OF02FQEJP.10.71.G05.1.454.CMB.1.raw
  modified_base (321)..(334): a, c, t, g, unknown or other
  misc_feature (321)..(334): n is a, c, g, or t
tcagcatagtagtgcacgaccggtgctcgatttagtgtcgtcgcaagagagaggggagagtgttagagggggcacttctccctctaacactctcccctgttgaagctctttgtgacagacttcactctcaccatcagcagcctagagcctgaagattttgcagttttattactgtcagcagcgtgccactttcggcggaggtgccactttcggcggaggaccaaaaatgaggtcaaacgaactgtggctgcaccatctgtcttcatcttcccgccatctgacactactatgctgagcgggctggcaaaggcgacagtagcnnnnnnnnnnnnnn

SEQ ID NO: 12546 - DNA, 623 bp, Homo sapiens
  misc_feature: GYAE6OF02HN0S3.10.71.G05.1.454.CMB.1.raw
tcagcatagtagtgcacgaccggtgctcgatttagtgtcgtcgcaagagagaggggggcctccattcggtgatcagcactgaaccacagaggactcaccatggagtttgggctgagctgggttttcctcgttgctcttttaagagatgtccagtgtcagatgcagatggtggagtcgtgggggaggcgtggtccggccgtgggggtccctgagactctcctgttctgcgtctggattcattctttagtaaactctggcatgtcctgggccgccaggttccaggccagggctggagtgggtggcagataatacgaatatgatagaacaagtaaaatagtactagtaggataccttccttacgaacgggtcctaagttcacctatcctaccagaacgacaaattacccaaagtaacagttgggtatacttactagaacctaaaattcgaactacgccctaggaacgcgaccggacggaacgtaccggggttattttaacgtacgttagggtaacgggtaacgtaaagtaccgtaaggtcggactacgtacctaccggttggtacgtttgtaccggtaccgttccggggacgtacgggtaacgtcggtaccgtaccgtcttaccgg

SEQ ID NO: 12547 - DNA, 698 bp, Homo sapiens
  misc_feature: GYAE6OF02JAJJH.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggaggcgtggtccggccgtgggggtccctgagactctccgtgttctgcgtctggattcattctttaagtaaatctggctagtcgttccgtgggtcccgccgtacggttccgacggccgtaccgggctaggaagtggggtgacagattaataacaatagtgtatgaactaagtaaaatactaactatcggacgtacttcctacgaacgggccgtattaccacctactaccgtacccgaaagtacgtaacctaactttaccaaaaccggtaaactaggtttaggtaacgttattaccggtaacggactaaaacgtcgtaaaccccgtacgtacccgtagggaacgacgggtaacccggaacgggttaccggtacgggtttagtttaacgttaccgtagggttacgggaactaaacgtcggttaagtacggcctagtacgtaccggttgttacgtaggtcgaacccggttcccgggacggtaccggttaacccgtcggttacccgtaccgttcttacccgg

SEQ ID NO: 12548 - DNA, 678 bp, Homo sapiens
  misc_feature: GYAE6OF02JZC5U.10.71.G05.1.454.CMB.1.raw
  modified_base (569)..(569): a, c, t, g, unknown or other
  misc_feature (569)..(569): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagtcgttgggttttcctcgttgtcttcttttaagagatgtccagtgtcagatgacagagtggtaggacgtcggtgggggaggtcggtcgggtccgggtccggtcggggggtcccctggacgtaccgtccgtccgttgttcgtcgtcgtcgtggtattcctattcctttaagtaaactcgtaggctacgttcgttccggtcgggtcccgccgtacggttccgacggacccgacgggtctagggtaacgtggggtcggacgaggtaacttaacgtaactaagtagtgtacagtaactaaagtaaataatacgtagtaggacgtacctacttacggaacggtcctaagttaccactactctaccgaagacaacctaacgtaccaaacgtaacagttcgggtatactacgagtactaaagcgaaaccngtaccgtagacgaacggtaccgaacggtacgttaccggtttagtttactacggtaaggtacggtaataacgttcgtaagtcggacctacgtacgttacggtgttaacgg

SEQ ID NO: 12549 - DNA, 726 bp, Homo sapiens
  misc_feature: GYAE6OF02FM5M9.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagagggggggaactgctcagttaggacccagagggaaccatggaacgccccagctcagcttctcttcctcctgctactctggctcccagaccaccaccggagaaattgtgttgacacagtctccagccacgctgtctttgtctccgaggggaangccaccctctcctgcagggccagtcagagttgtcgctacgtttcggtagggtgtatctaaacataaactccggccaggcctccccgaggtcctcctctattctttacgactggtacctttacgaacgaccggggtccccctaggggtccgttacccccgagggtcgtacggttcagggtcgaccgtaggtcgggtctaggggacacggtaccttacactctacaaccatccgagtaccagtacctagacgtcctaggtaagttactttgactttaacgtttaacttaccgtagttaccgtacgtaccgtacggtccggttacgtacccgtaccggttttacgggacggggttaacggtccgttacccgttaacggttttacccggggaccgggttaaaccgggtaaacctaaaaggttaccgggtacggttaacccgaaaaccggtacgttcgggtaccggtaccgtacggaccctaaccgtacgttccgtacgtttccctacgtaccgttcccttaccccgg

SEQ ID NO: 12550 - DNA, 603 bp, Homo sapiens
  misc_feature: GYAE6OF02I75J3.10.71.G05.1.454.CMB.1.raw
  modified_base (203)..(203): a, c, t, g, unknown or other
  misc_feature (203)..(203): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgctccgaggggaaangccaccctctcctgcagggccagtcagagtgttcgctacttcggttagggtgtatcaacataaatccggcaggctccaggctctcatcttgatgctttcaacgacgggcccctggccgtcccgaggcctaggttcaggtggcaggtggtctgggacagacttcactctcacatcagcacgcctagacgcctagaagtatttgactagtttatacttgtactagcacggtcgtcgacctacgtttcgggcgggtacgggtcgtaccgtaccgtttcgggaccgggtaacgggaacccgtaagggttcggaaggtacgtaacgtaaaaccggaacggttacggttaacgggccgttacggacccgtaaccgtacgttcgttacggttaccttccgttaaccg

SEQ ID NO: 12551 - DNA, 810 bp, Homo sapiens
  misc_feature: GYAE6OF02G3BTQ.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttggctgagctgggttttcctcgttgctcttttaagagatgtccagtgtcagatgcagatggtggagtcgtgggggagcggtggtccggccggtgggggtccctagacgtactctccttgttctgcgtcgtaggtacttcagttctttaagtaaatcgtggactagttcggtccgtcgggtcccgaccgtaggttcccgacggccgacgggctaggaagtggggtgacgagtataatacgaattacgtgtagtagaaactaagtaaaaatataacgtagttaggaacgtacccttacggtaaccgaaagggtcccttaacgttccctaaccgtaccgtacccttacgaaacggtaacctaaacctaaccgttaaccgtaaacgaaacgttaacggtttacggtacgtttaaccgttcgtaaccgtaaactaaaccggtaccgtaacccgtacggttacccgtaacggaacggtacggaccccggtaaaggggtaccggttaaaccggggtttagtttttaaacgttaccggggttaggtaacgggggtaaaattaaacccgggttacgttaaacgggcgggttaaccctacgtaacccggttaacggttcggggtttactttaccggtacccggttaccggtttaccggggacccggtaaccgggttaccggtaccggtacccggttacccgttcgttaccccgg

SEQ ID NO: 12552 - DNA, 650 bp, Homo sapiens
  misc_feature: GYAE6OF02F71H5.10.71.G05.1.454.CMB.1.raw
  modified_base (201)..(201): a, c, t, g, unknown or other
  misc_feature (201)..(201): n is a, c, g, or t
  modified_base (268)..(268): a, c, t, g, unknown or other
  misc_feature (268)..(268): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctcgaggggaaanagccaccctctcctgcacgggccagtcagagtgttcgctacttcggtagggtgtatcaacataaacnccggccaggcctccaggctctcatcttgatcgtctttcaacgacggcccctggccgtcccaggcctaggttcgaggtggcgtaggttcggtcgtgggactagactttccgactcctacacctatcacggtccaacgtccgtaacggaccgtccgtaaggtaaacgtttacttttcgacgttagtttaacgttacttcgtacgtagactaggccgttacgtaccgttaccgttcggggacggtacgggttcgtccgttacggtttaccggggacgggtaaacgaaaccgtaaagtacgggaacggttacgaaacgtacggtcggtacgacgtacgccgtacgtacgttctaccgttacttacgttaccttaccccgttacccg

SEQ ID NO: 12553 - DNA, 713 bp, Homo sapiens
  misc_feature: GYAE6OF02HUYQL.10.71.G05.1.454.CMB.1.raw
  modified_base (346)..(346): a, c, t, g, unknown or other
  misc_feature (346)..(346): n is a, c, g, or t
  modified_base (497)..(497): a, c, t, g, unknown or other
  misc_feature (497)..(497): n is a, c, g, or t
  modified_base (504)..(504): a, c, t, g, unknown or other
  misc_feature (504)..(504): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctacccagaccacccgaccgggtagtaaatttcggtgttgaaccacgagttcctccgagcccaacgtcttgttccttttcgcctaccgaaggggaaacgtacgcccgtaccctctccgtagcgacgggcctaggtcaggtacgttcgttcctactacgttcggttagggttgtactacaaactataaacgccggcaggcctaccgagctcctntattcttgatcgtcttagaccgcgggtccctggcctacccgagcgtaagttcgagtcggacgtacggtgggtacagggactcgtacgttccgaacttccgacctacgtatccgaacgtcaaccgtacgtaacgcgtaccgtagtaacgttntttacgngtttaacgtttacttacgtagtaccgagtctacggtcgtaccggtcccgttacggtttcggacggttacgtaccgttaccgttcgggtttccgggaacggtaacggaaaacctaaggtacggtacgtaacccgtaaaggtcgtaacggttcgacctaaccgtaccacgtttacgtaccgtttacgtacctttacgtacccggttacccc

SEQ ID NO: 12554 - DNA, 332 bp, Homo sapiens
  misc_feature: GYAE6OF02HO01N.10.71.G05.1.454.CMB.1.raw
  modified_base (321)..(332): a, c, t, g, unknown or other
  misc_feature (321)..(332): n is a, c, g, or t
tcagcatagtagtgcacgaccggtgctcgatttagtgtcgtcgcaagagagagggggagagtgttagagggggcacttctccctctaacactctcccctgttgaagctctttgtgacagacttcactctcaccatcagcagcctagagcctgaagattttgcagtttattactgtcagcagcgtgccactttcggcggaggtgccactttcggcggagggaccaaaatagaggtacaaacgaactgtggctgcaccatctgtcttcatcttcccgcatctgacactactatgctaggagcggctggacaaggcgacatagnnnnnnnnnnnn

SEQ ID NO: 12555 - DNA, 581 bp, Homo sapiens
  misc_feature: GYAE6OF02HV2UO.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagaccaccaccggagaaattgtgttgacacagtctccagccacgctgtctttgtctccgaaggggaanagcccaccctctcctgcagggccagtcagagtgttcgctacttcggttagggtggtatcaacataaaatccggccaggctcccaggcctcctctatttttgatgtctttcaacagggccctggccgtcccaggcaggttcgagtggcgaggtggtcgtgggacagacttcactctcaccatcacgcacgcctagacgtcctgaacgtagttttgacttagtttattacgtgtacagtcagtcgtcgcctacgtttcggcggtaggtcgcctacgttcgggacgggtacgggaaactaaagtagacggtacgaaacggtaacgtggtacggacgtacgcctacgacgttcgtcgttccttactcgttcccttaccccg

SEQ ID NO: 12556 - DNA, 713 bp, Homo sapiens
  misc_feature: GYAE6OF02HOYIJ.10.71.G05.1.454.CMB.1.raw
  modified_base (204)..(204): a, c, t, g, unknown or other
  misc_feature (204)..(204): n is a, c, g, or t
  modified_base (272)..(272): a, c, t, g, unknown or other
  misc_feature (272)..(272): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagcccagctgtctttgtctccgaggggaaancgccaccctctcctgcagggccagtcagagtgttcgctacttcgttagggtggtatcgaacataaacnccggacacggctacccaggtcctcctcgattccttttagacttcgtcctttaccgaacgtacgggccccctgggacccgttccccgagggtcctaacggttcgaaggtcggaccgaggttcgggtcgtcggggacacggtaccttcgacctccgtacgacctagtacccgacgtctacgaccgtaacggacgtaccgttagaaggttacgttttacgacttaggtttaacttacgttcgtacgtacggtacgacgtacgtcgtacccgttacgtttaccgggcggtacggtcgtaccgttaccggttttccgggaccgggtaaacggaaaccgtaaaggtacggaacgggtacctaaaccggtaacggttacggttacggtacgtacgaccgtacccgtaacgttccgttacgtttacccgttaccgtacgtttacccccg

SEQ ID NO: 12557 - DNA, 556 bp, Homo sapiens
  misc_feature: GYAE6OF02HM0YM.10.71.G05.1.454.CMB.1.raw
  modified_base (202)..(202): a, c, t, g, unknown or other
  misc_feature (202)..(202): n is a, c, g, or t
  modified_base (258)..(258): a, c, t, g, unknown or other
  misc_feature (258)..(258): n is a, c, g, or t
  modified_base (263)..(263): a, c, t, g, unknown or other
  misc_feature (263)..(263): n is a, c, g, or t
  modified_base (329)..(329): a, c, t, g, unknown or other
  misc_feature (329)..(329): n is a, c, g, or t
  modified_base (445)..(445): a, c, t, g, unknown or other
  misc_feature (445)..(445): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctccagacaccaccggagaaattgtgttgacacagtctccagccacgctgtctttgtctccgagggaaangccacctctcctgcagggccagtcagagtgtcgcacgttcgttagggtgtatcaanataanccggcagctccaggctctcatcttgatcgcttacacgacggccctggccgtccgaggctacggttnacggtgcaggtcgggtctgggacagtacttcactctcactatcagcagcctagcgacctgtaagtatttgacttagtttattacgtgtcagctagtcgtcaccgttagttccgggnggtacgcgtacccggtacgtttccgggacgggtaacggaaacctaaaggtacgaggtacaaacggtacgtggtaggctacgtcacgtactccgttagtacttgaccttccg

SEQ ID NO: 12558 - DNA, 682 bp, Homo sapiens
  misc_feature: GYAE6OF02H44MZ.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtgtgggggaggcgtggtccggtccgtggggggtccctgagacttctccgttgttctgtcgtcgtggtattctattactttagttaaactcgtggcattgtcccgttgggtcccgtccagggtttccagggcccgaccgggtcgtgggtaagtcggggtgcgagatatacaatatagatagactaagtaaatattaactagtagtacgtacctccgttagaacgggctactaccaacctatccgtaccgaagaagtaacctaacgttaaccaaacgtaactaaggttaggttacgttaaccgttgtacgtaacctaaagtaccgaacctaacgaccttagcgaacggccgtaagggaccgtagggtttacgtttagttacgtagggtaggtaaagttaacgtaccggttagtacgtactacgttactacggttgttaacgtttcgtaggtaacccggttcgggaccggtacgggaaccggttcggtacccgtaccggtcgtttccccggg

SEQ ID NO: 12559 - DNA, 640 bp, Homo sapiens
  misc_feature: GYAE6OF02FLJS8.10.71.G05.1.454.CMB.1.raw
  modified_base (203)..(203): a, c, t, g, unknown or other
  misc_feature (203)..(203): n is a, c, g, or t
  modified_base (420)..(420): a, c, t, g, unknown or other
  misc_feature (420)..(420): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaangccaccctctcctgcagggccagtcagagtgttcgcacttcggtagggtgtatcaacataaatccggcaggctccccgaggctcctcatctttgactgtctttacaacgacgggcccctggccgtcccgaggcgtaggttcagtcggcgaggttgggtcgtgggaacagtacttcgactctcaccatcgacgcacgtccgtagacgtcctagaagtnttttagacttagtttacttacttcgttacagtacgtagtcgtcgtaccgtacgtttccgggacgggtagggtccgtaccgtaccggtttaccgggcgggtaaacgggtaaacccgtaaaagttgggtaacggtaaccgtaaaccggtaacgttacgggtacgggtccgttacgaccgtaaccgtacgttcccgttacggttcctttaccgactttccccg

SEQ ID NO: 12560 - DNA, 801 bp, Homo sapiens
  misc_feature: GYAE6OF02IRI1O.10.71.G05.1.454.CMB.1.raw
  modified_base (179)..(179): a, c, t, g, unknown or other
  misc_feature (179)..(179): n is a, c, g, or t
  modified_base (208)..(208): a, c, t, g, unknown or other
  misc_feature (208)..(208): n is a, c, g, or t
  modified_base (675)..(675): a, c, t, g, unknown or other
  misc_feature (675)..(675): n is a, c, g, or t
  modified_base (695)..(695): a, c, t, g, unknown or other
  misc_feature (695)..(695): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagcttgggttttccttgttgctattataaaggtntccagtgtcaggtgagctggtggagtcgnggggagtcgtggacacgccgtgggtacggtccctggacgaccgttcgtccctggtcgacacgtccttaccgtggtactttcccggccttcgttacggggtactttacgggtacccgtttaccgtaaggttaccgtaacggtttaaccctaccttaacggtaccggtaacccccggttccggggggttaccccccacccgggtaacgggttcccccgttaacccgggggaaacgggggggtaaacggggggtccgttaacgggggttacggggttttacggggttttacgtaaacgttaacccggtttaaagttttacccgtacggtttaagggttagggttacgtaaaccttaaccgtattaacgtaacgtaccgacgacgtaacttccgtaggtacgggaacggtacccgtattaccgactatcccgaccgtaggaaccaaccgacaacactacactagtactttnaacgtaaactcgaacctacncgaccggaacggaccgtagggaccgacggtaccgttaattaaccgtactacggttacggactaacggtaccgtttaaccgaccgtcggtttaccgtttatacccgg

SEQ ID NO: 12561 - DNA, 611 bp, Homo sapiens
  misc_feature: GYAE6OF02FRJIK.10.71.G05.1.454.CMB.1.raw
  modified_base (200)..(200): a, c, t, g, unknown or other
  misc_feature (200)..(200): n is a, c, g, or t
  modified_base (239)..(239): a, c, t, g, unknown or other
  misc_feature (239)..(239): n is a, c, g, or t
  modified_base (345)..(345): a, c, t, g, unknown or other
  misc_feature (345)..(345): n is a, c, g, or t
  modified_base (366)..(366): a, c, t, g, unknown or other
  misc_feature (366)..(366): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccacggagaaattgtgttgacacagtctccagccacgctgtctttgctcgagggaagngccaccctctcctgcgacgggccagtcagtacgtgttcnctacttcggttaggggtgtatcaacataaagtccggccaggcctcccaggcctccctctacttcgttgattcgtctttcgaacgtccggccgtggtccgtcaggcnggtacgagtggcaggtggtcngggactagtcttcactctcacctactcgactcgacgtacgtagactccgtaggagttactttagactttagtttacttacgtacgtcacgtacgagtcgtacgccttagtttccgggaggtacggtcgtacccgttcggttacgggacgggtaccggtaacaaacgttaggaacggaacgtaaacggtacgtggtacggcgtacgacctacgtacttcggtacttaccggttcctacgttccccg

SEQ ID NO: 12562 - DNA, 667 bp, Homo sapiens
  misc_feature: GYAE6OF02GGX4M.10.71.G05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtcctcagccacgctgtctttgctccaggggaancgccaccctctcctgcacgggccagtcagagtcgttcgcacgttcggttagggtgtatacaactataaactccggccaggcctacccgaggcctcctcattctttgatcgtctttacaacgcgggtcccctggcctcccgaggtcaggttaccaggtggccgaggttcggtacgtacgggacacggtacctactactcgtaccacctaatccgagtcacggaccgtaagacgtccgtaggtaatcttttacgcgttaagttacttacgtgtacagtcgacgtcgttcgacccttcgttacgggtcgtacgtcggtacccttaccgggttacgggacgggaacggtaaaccgtaaaagtacgggtaacggtacgaaaaacggtacgttacgggtacggacccttacggtaacccggaaccttaagttccggttccgttaaccgttcgttaacccgttcccttaccccgg

SEQ ID NO: 12563 - DNA, 722 bp, Homo sapiens
  misc_feature: GYAE6OF02FFQV2.10.71.G05.1.454.CMB.1.raw
  modified_base (146)..(146): a, c, t, g, unknown or other
  misc_feature (146)..(146): n is a, c, g, or t
  modified_base (153)..(153): a, c, t, g, unknown or other
  misc_feature (153)..(153): n is a, c, g, or t
  modified_base (160)..(160): a, c, t, g, unknown or other
  misc_feature (160)..(160): n is a, c, g, or t
  modified_base (202)..(202): a, c, t, g, unknown or other
  misc_feature (202)..(202): n is a, c, g, or t
  modified_base (265)..(265): a, c, t, g, unknown or other
  misc_feature (265)..(265): n is a, c, g, or t
  modified_base (523)..(523): a, c, t, g, unknown or other
  misc_feature (523)..(523): n is a, c, g, or t
tcagcatagtagtgcacgaccggtgctcgatttagtgtcgtcgcaagagagaggggggactgctcagttaggacccagagggaaccatggaagccccagctcagcttctcttcctcctgctactctggctcccagacaccacgganaattgtntgacacngtcctccagccacgcttgttctttcgctaccgaaggggaacncgccctaccctctcctggacacgggccagtccagtgttcgtcgcttaacgttcggttagggtntactacaactataacgtccggaccaggcctacccgaggtcctcctcgtacttcttgacttcgttaccttacgaaccggtccggtccccgtaggtcccgtacccgaggtacgtacggtttacgacgggttaggacggttagggtcggttacgtacggggactacggttaccttcgaaccttccaccgaacctacgttaccgagtaccacgtaccgtaaggccgtacgttagtaactttgtttacgactttaagtttacncgtacgttacgacgtacgtacgtccgtacgtacccgtttaacgggttccgggacggtacggtccgtaaccgttaccgggttaccgggaacgggaacctaaaccgtaaagtccgggtaacgttaccgaaacggttcggtacgacggacttacgacctaacttcgtccgtttacgttcctaccgtaccgttaccctacccg

SEQ ID NO: 12564 - DNA, 632 bp, Homo sapiens
  misc_feature: GYAE6OF02HSYX0.10.71.G05.1.454.CMB.1.raw
  modified_base (194)..(194): a, c, t, g, unknown or other
  misc_feature (194)..(194): n is a, c, g, or t
  modified_base (213)..(213): a, c, t, g, unknown or other
  misc_feature (213)..(213): n is a, c, g, or t
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggcctcccagacaccaccggagaaattgtgttgacacagtctccagccacgntgtcttgctcgaggggaangccacctctcctgcagggccagcagagtgttcgctacgttcggttagggtgtatacaactaataaagtcccggcaggcctaccgaggtcctcctactacttctttgatcgtaccttcgaaaccgtcgggtcccctggcccgtccgtaaggtctacgggttcagggtcggactagggttcgggtcgtagggactacgactttcacttcctacaccgataccagtccaagtctacgacgtacctagtaacgttagtttgacgttaacgttttacttactagtactacgtacgaggtcgtacgtaccgtacggttcgggacggtcgttcgtaccgtacgttcgggacgggtaacgaaccgttaaaagcggtacggtaacgaaacggtacgtaggtcgtacgtacgacctacgtattcgtacg

SEQ ID NO: 12565 - DNA, 569 bp, Homo sapiens
  misc_feature: GYAE6OF02FYHGV.10.71.G05.1.454.CMB.1.raw
  modified_base (317)..(317): a, c, t, g, unknown or other
  misc_feature (317)..(317): n is a, c, g, or t
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggctcccagacaccaccggagaaattgtgttgacacagtctccagccacgctgtctttgtctccgagggggaaaagagcccacccctctcctgccagggccagtcagagtgttcgcactttcgttagggtggtatcaacataaatccggcaggctcccagctcctcatcttgatnctttcaacgacggcccgtggccgtccaggcaggttcagtggcgagtgggtctgggacagacttacactctccaccagtcagacacgacctagacgcctagaacgtactttgacgtagtttacttacgtgtcagcgtagcgtcgtccgtacgttcggtacggtaggtcaccgtcgttcgggacggacggaaccaaagtacggtacggtaacgtaaacggtacgtacggtgccgtacgccaccgtatcgttacg

SEQ ID NO: 12566 - DNA, 583 bp, Homo sapiens
  misc_feature: GYAE6OF02F5H33.10.71.G05.1.454.CMB.1.raw
  modified_base (201)..(201): a, c, t, g, unknown or other
  misc_feature (201)..(201): n is a, c, g, or t
  modified_base (438)..(438): a, c, t, g, unknown or other
  misc_feature (438)..(438): n is a, c, g, or t
  modified_base (459)..(459): a, c, t, g, unknown or other
  misc_feature (459)..(459): n is a, c, g, or t
tcagcatagtagtgcacgaccggtgctcgatttagtgtcgtcgcaagagagagggggaggaactgctcagttaggacccagacggaaccatggaagccccagcgcagcttctcttcctcctgctactctggctcccagacaacactgcagaaatagttatgacgcagtctccagccaccctgtctgtgtctccgagggganagagcccaccctctcctgcgagggccggtcagaatattgctaccaacttagcctggtatcaaacaaagcctggccaggctcccagacctcctcatcctcgtaggtcgcattccgttacggacgggcctacgtcggtcgtcccaggcctaggttcaggtcggactaggttgggtacgtggaacaggtagttaccacttctccgacctacgtcacggccgtcctgctagtctagaagtntttcgattagtttatacgttntcgagtctaagttatacgtgttacgtttggttttaactcgtacgtttccgggccgttacgggtaccgtaaggtcggttaacttacgaagtaccgtaagtcggtagctagccacgtatcgttacg

SEQ ID NO: 12567 - DNA, 946 bp, Homo sapiens
  misc_feature: GYAE6OF02JBXAT.10.71.G05.1.454.CMB.1.raw
  modified_base (139)..(139): a, c, t, g, unknown or other
  misc_feature (139)..(139): n is a, c, g, or t
  modified_base (223)..(223): a, c, t, g, unknown or other
  misc_feature (223)..(223): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccanacaccgacgagtaaattgtgttagacacagtctaccagccacgtctgttctttgtctccgaaggggaaagacgtcccaaccctntcctgcgaagggccagtcagtaggtcgttcgactaccgtttaggttaggaggttaactacaactaagtaaactccggaccgacggtcctaccccgaggcgttccctctaattcctttaggtactcgtacgttttaccaacgtacgggccctacggtcccgtacccgtaacggctacgggttactacggttacggacgttaacggtcggggttaccgtacgggggttaaccacggtaaccgtttaccgtaaaccctccggtttaaccaaacccgttacgaccgtaacggtaacccgtacgggtaacccgttacggaaccggtacccgttaaggtaaacggtttaaacgttttcgggaaaccgttttacggtttaaaacgttttaacgttaccggttaacgttaacggtaacccgttaaacgggttccccgttacggtttaacccccgttaaccggggtttttacgggttacccggggggaaacggttttcccggggtaaaccccgttttaaccggggttttaacccgggggtaacccgggggtaaaacgggtaaaaaccccgggttaaaaaagttaaacccgggggtaagtaaaccccggtaaaaaaccgggtaaccgtttaagggtttaacgggtacccgtttaaccggacccgttaaaccccggtacggtttaacccttttaacgggtttccctttaaccctttaacggttttcccccccgg

SEQ ID NO: 12568 - DNA, 559 bp, Homo sapiens
  misc_feature: GYAE6OF02GXAF8.10.71.G05.1.454.CMB.1.raw
  modified_base (215)..(215): a, c, t, g, unknown or other
  misc_feature (215)..(215): n is a, c, g, or t
tcagcatagtagtgcacgaccggtgctcgatttagtgtcgtcgcaagagagagggggagagccctggggaggaactgctcagttaggacccagagggaaccatggaaaccccagcgcagcttctcttcctcctgctactctggctcccaggtaccaccggagaaattgtgttgacacagtctccaggcaccctgtctttgtctccaggggaaagngccaccctctcctgcagggccagtcagagtgttaacaacaactacttagcctggtaccagcagaaacctggccaggctcccaggctcctcatctatgatgcatccagcagggccacgtcggcactcccagaccaggttcaggtgcaggtcgggtctggggacaggtacttcactctcaccatcagcagactggacgcctagaagttatttgctagtgttattactgtctagcgtagtagtggtcgcccggtcgccgtcgtacggtttcgggacgggtacgggtaaccgtaagggttcggaacgtacgtaacgaaacgtacgtggtacggtacgtcgacctaccg

SEQ ID NO: 12569 - DNA, 725 bp, Homo sapiens
  misc_feature: GYAE6OF02G99E5.10.71.G05.1.454.CMB.1.raw
  modified_base (226)..(226): a, c, t, g, unknown or other
  misc_feature (226)..(226): n is a, c, g, or t
  modified_base (230)..(230): a, c, t, g, unknown or other
  misc_feature (230)..(230): n is a, c, g, or t
  modified_base (276)..(276): a, c, t, g, unknown or other
  misc_feature (276)..(276): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatggtggagtcgtgggggagcggtcggtccggccgtgggggtcctggagactctcctgttcngctntggattcattctttaagtaatcgtggctagtcgttccgcgggtccncgtacggttccgacggccgacggtactagggtaacgtggggtcgacgtaagtactagtaactaatacgtagagtagaactaaagttaaaacttagtaacgtagtacggtaactaccttaccgtacggaacgggtccttaacttacgacctaacgttcctacgaagtaaccgaactaaccttaacgaaagtactagttagggtattagtactacgaactaaacgttcgaaccctaggtaccgtaagaacggtaaccgccgggtaaacgggaccgttaagggtttacgttttaagttaccgggtaagggttacgtaaacggtaaccttacggtagggcctacgtacgtacccttacggttggttcgtttaacgggccgttaaccgggtcccgggaccggtaacggggttacccgttcgggtaccccgtttaccggtccccgttaacccggg

SEQ ID NO: 12570 - DNA, 339 bp, Homo sapiens
  misc_feature: GYAE6OF02FV8KI.10.71.G05.1.454.CMB.1.raw
  modified_base (330)..(339): a, c, t, g, unknown or other
  misc_feature (330)..(339): n is a, c, g, or t
tcagcatagtagtgcacgaccggtgctcgatttagtgtcgtcgcaagagagagggggaacatggtgtatctgcaaatgaccagcctgagagccgaggacacgggtgtttattactgtgggagaaatcctagtggcatcacctggtattgtgacttccggggccagggaaccgtggtcaccgtctcttcggcctccaccaaggcccatcggtcttcccctggcgcctgctccaggacgcacctccgagacgcacacggccggcccgtgggctgcctggtcaaggactaccttcccactactatgctgacgcgggctggacaggcgcatagnnnnnnnnnn

SEQ ID NO: 12571 - DNA, 658 bp, Homo sapiens
  misc_feature: GYAE6OF02FXH2K.10.71.G05.1.454.CMB.1.raw
  modified_base (205)..(205): a, c, t, g, unknown or other
  misc_feature (205)..(205): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtcctccagccacgctgtctttgtctccgaggggaaanacgccaccctctcctgccagggccagtcagagtgttcgctacttcggttagggtgtatcaacaataactccggccaggcctcccgaggctcctctatctttgatgtctttcaacgcggccctggccgtcccgaggtcgtaggttcgaggtcggctaggtcgggtcgtagggacagtaccttcacctctaccacactcacgctacgcctagcgtcgtagtaagttatttgacttagtttactacgttgtacagtacgtcgcgttacgcccgttacgtttccgggacgggttacggtcgttacccgttacgggtttccgggacgggaaacggtaaaccgtaaacggttaggtaacgggttaaccgaaaacggttacggtacggttaacgggtccgttaccggtacctaccgtacgtttaccgttacggtttaccctttacgtaccctttaccccg

SEQ ID NO: 12572 - DNA, 678 bp, Homo sapiens
  misc_feature: GYAE6OF02HJVHX.10.71.G05.1.454.CMB.1.raw
  modified_base (257)..(257): a, c, t, g, unknown or other
  misc_feature (257)..(257): n is a, c, g, or t
  modified_base (577)..(577): a, c, t, g, unknown or other
  misc_feature (577)..(577): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctcccaagaccaccaccggagaaatttcgtgttgacacagtctcagccagctgtctttgctccaggggaacgccaccctctctgcagggccagtcagagtgttcgctacgttgttagggtgtancgaacattaaagccggccaggtcctccgagtctcctcacttctttaggacttagtcctttaccgaaacgtcgggtcccccttgggcccgtacccagggcctaagggttccgaaggtcggtcagggttccgggtcgtaggggactacgtaacttcgtaacgttccgtccaaaccttatcccgagtactacgtaccctacggtacgtccgtaggtaacgttacgttttgaccttacggtttacttaacgtgttacgtaacggtcgaacggtcgtagtcccgttcgtttacgggacggtcggtcgtcccgtacgtttccgggnggtaaaccggtaacgtaaacgtaggacggtaaccaaaccggtaacgtcggtacggtacctacgccgtacgtaccgtcgttacgtccttacgtacttacccg

SEQ ID NO: 12573 - DNA, 628 bp, Homo sapiens
  misc_feature: GYAE6OF02F86J1.10.71.G05.1.454.CMB.1.raw
  modified_base (203)..(203): a, c, t, g, unknown or other
  misc_feature (203)..(203): n is a, c, g, or t
  modified_base (423)..(423): a, c, t, g, unknown or other
  misc_feature (423)..(423): n is a, c, g, or t
  modified_base (437)..(437): a, c, t, g, unknown or other
  misc_feature (437)..(437): n is a, c, g, or t
  modified_base (468)..(468): a, c, t, g, unknown or other
  misc_feature (468)..(468): n is a, c, g, or t
  modified_base (476)..(476): a, c, t, g, unknown or other
  misc_feature (476)..(476): n is a, c, g, or t
  modified_base (501)..(501): a, c, t, g, unknown or other
  misc_feature (501)..(501): n is a, c, g, or t
  modified_base (505)..(505): a, c, t, g, unknown or other
  misc_feature (505)..(505): n is a, c, g, or t
  modified_base (510)..(510): a, c, t, g, unknown or other
  misc_feature (510)..(510): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccacggagaaattgtgttcgacacagtctccagccacgctgtcttgtctccgaggggaaacncgcccaccctctccgtgcgacgggccagtcagtcgttgttccgctacggtttcggtagggtgtactacgaactaataaacgtcccggacacggtcctcccgaggtccttaccgtctacttccgtttagacttcgtaccgtttaccgaaaccggtccgggtcccgtcggacccgtcccgaggtccgtacggttcggacggtcggaccgtaggtcggtacgnggactacgtctccnctctaccactactcgacacgcgtacacgcgnttaacgtnttacgttgacgtttagttactagtnacgntacgngtctcgtacgttgcggtgtcgtacgtcggtcggtacgaagacgtaaacgagtacgagaaccgtacgaggtcgacgtcgtacgacgtacgtcgttactccgttactacccgtctcccgg

SEQ ID NO: 12574 - DNA, 834 bp, Homo sapiens
  misc_feature: GYAE6OF02FJWEG.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggacctcaccatggagtttgggctgagtctgggttttcctcgttgcttacttttaagagatcgtccagtgtacagtatgacgagtagtgggtaggagtcggtggggggtacgtccggttcgggtccccgggccggtaccggggggtccctaggtacgtaccgttcccgttccgttcggttccgtcggtcccggttcgttagggttactttccgtaacgttttacctttaaacggtaaacgttccggtacggtctaacttccggttccccggttacggggtccccgtaccggttacggttacccggaacgggtcccggtaaccggggtccttaaggggtaacgttcgggggtacgaccgtaggtaacttaactaaccgtaaattacggtagtactaacggtaaacgtaaaaggttaaaaccttataaaccggttacggtacggtaaccgtaccctttaccgttaacggaaccgggtcctaacgtttacccaccttacgtaccctaaccgagtaaacctaccgtaaactaccgaaagaccttaggtcggttaactactccgtaagtaacaacgttccgaaacgtcgtaaccgtaggaaccgacgaccgggtacggtaacgttacgggttactttacgtaacggtagggttaacgggaaacttaaccggtacggttagtacggtaccctaacgttcccgttacggttgttaaccgg

SEQ ID NO: 12575 - DNA, 744 bp, Homo sapiens
  misc_feature: GYAE6OF02G4N5D.10.71.G05.1.454.CMB.1.raw
  modified_base (205)..(205): a, c, t, g, unknown or other
  misc_feature (205)..(205): n is a, c, g, or t
  modified_base (346)..(346): a, c, t, g, unknown or other
  misc_feature (346)..(346): n is a, c, g, or t
  modified_base (463)..(463): a, c, t, g, unknown or other
  misc_feature (463)..(463): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaattgtgttgacacagtctccagccacgctgtctttgtctccgaggggaaanacgcccaccctctcctgcgagggccagtcagagttcgtcgctacgttcggtagggtgtatcaacataaagtccggccaggcctcccgaggcctcctcatctttgatcgtcttacgaacgccgggtcccctggcctacccgnggcgtaggttcaggtggcgtacggtcggggtcgtcggggaacacgttacgttccaccgttctaccgacctatacgcgtaccaacggtcctaaggacgtcccgttaaggaaacgtttnttttacggacttaacggtttttacttaaccggttgtaccgtaggcgtaacggtccgtaccggttacccgttaccgggtttaccggggacgggttacggtcccgttaccggttaccgggtttacccggggacggggaaaaccggttaaacccgtaaagggtacggggtaaccggttaacccgtaaaacggtcccgggttaggttacggaaccgttcgggtaacctaaaccccggttgttacccggtttggttaaccctttccgaacccttttacccccgggg

SEQ ID NO: 12576 - DNA, 746 bp, Homo sapiens
  misc_feature: GYAE6OF02JEOU3.10.71.G05.1.454.CMB.1.raw
  modified_base (201)..(201): a, c, t, g, unknown or other
  misc_feature (201)..(201): n is a, c, g, or t
  modified_base (372)..(372): a, c, t, g, unknown or other
  misc_feature (372)..(372): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgcagggccagtcagagtgttcgctacttcgttagggtgtatcaacataaatccgacaggctcccaggcctcctcattctttgatcgtctttcaacgcggtcccctggccgtcccgaggcctaggttcaggtcggctagggttcggtcgtgggtaccnggtacttcacgttctaccgacctattccgaagtccgaacgtcccgttaggaccgtacccgtaggtaaacgtttacgttttacggaacgtttaaggttttaccttaacgttcggttacggaacgtaccgaacggtccgttccgtaccgttaccggttttacggggcggttaacgggttccgtaacccggttcggtttaccgggggtacgggtaaacgggtaaaacccgttaaaaggttacgggtaaccggttaaccggaaacggttaacggtttcgggtaacgggtacgttaaccggtaacccgttaacccgtaccgtttaccggttaccggttttacccgttaaccgttacccgttttacccgttaccccccgg

SEQ ID NO: 12577 - DNA, 709 bp, Homo sapiens
  misc_feature: GYAE6OF02IKEGK.10.71.G05.1.454.CMB.1.raw
  modified_base (207)..(207): a, c, t, g, unknown or other
  misc_feature (207)..(207): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtcctccagccacgcttgttcctttgtctccgaaggggaaanacgcccaccctctcctgcgacgggccagtccaggtagttcgttccgactacgtttgggttagggtgtactaccaacaattaaaacgtccggaccgacggtcctacccgacggtcctcccgtacacttacttaagtgtactcggactaccgtaccgacggtacgaccgggaccctacggttacggctaaccgtaccgaacggtacgtaggttacgaggtacgggcttagggtcgggtcgtacgggaactacgttaaccgttccaacgttccaccgtaccaacgttacgaacggacccgaaggtaaccgtacgggacgtaaccgttaaggaatttacgttttcgaaccggtttagttactttaacgttactacgttacgaacgttacgtagttacgtcggtcccgcccggtacgtcttacggtacggttcggacgggtaagtccgaagttcgaagtaaccgtaacgaacgtacgtgtaacgtcgtacgacctacgtactgttac

SEQ ID NO: 12578 - DNA, 809 bp, Homo sapiens
  misc_feature: GYAE6OF02JGEDD.10.71.G05.1.454.CMB.1.raw
  modified_base (221)..(221): a, c, t, g, unknown or other
  misc_feature (221)..(221): n is a, c, g, or t
  modified_base (292)..(292): a, c, t, g, unknown or other
  misc_feature (292)..(292): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgaccacagtcctccagccacggctgtctttcggctccgagggggaaaancgccaccccgtctccgtgacacggggtccaaggtccaggagttcgttacgctacttcggttagggtggtancaacataaacgtccggcacggctcccaggcctcgtctagtcctttggactcgtcgttaccaacgtaccgggcccctagggtccgtaccccgaggaccgtacggttacgtacgtggcgtacggttaggggtctacggggtactaacgtaccgtttacacccggttcctaccgactacgtacacggtactacgacgtacgacgtaccgtacggtaatttaacgtttcgaacggttttacgtttttaacttaaccggtgttaccggtaacgtaccggtaacgtccggttaacccggttacccgtttaaccggtttttacggggggtacccgttaaacggggggtcccgtttaaccccgttaacgggttttacccgggggtaacccggggttaaccgggtaaaacgtaaaaccggttaacggggttaaaccgggttaaacccgtaaaacggtaaccgggtttacggtaacgggttcttacgggaaaccccgtttacggtaaccccgtttgttaaccccggg

SEQ ID NO: 12579 - DNA, 918 bp, Homo sapiens
  misc_feature: GYAE6OF02FG5NN.10.71.G05.1.454.CMB.1.raw
  modified_base (112)..(112): a, c, t, g, unknown or other
  misc_feature (112)..(112): n is a, c, g, or t
  modified_base (159)..(159): a, c, t, g, unknown or other
  misc_feature (159)..(159): n is a, c, g, or t
  modified_base (205)..(205): a, c, t, g, unknown or other
  misc_feature (205)..(205): n is a, c, g, or t
  modified_base (239)..(239): a, c, t, g, unknown or other
  misc_feature (239)..(239): n is a, c, g, or t
tcagcatagtagtgcacgaccggtgctcgatttagtgtcgtcgcaagagagagggggaggaactgctcagttaggacccagagggaaccatggaagccccagctcagcttcncttcctcctgctactctggcctcccgagacaccaccggagaaattgngttgacacgagtctaccagccacgctgtctttgctccgagggaacngccctacccgtctcctgccgagggccagtccagngtgttccgactacgttcggttagggtggtactaccgaacataaacgtcccggaccgacggtcctaccccgaggtccctacccgtccgtaacttccgtttacgaacgtttcgtacctttttaccgaaaccggtaccgggtccccccgttacgggtaccccggttaccccggaacgggtacccgttaacgggttttaccgaacgggttaccggggtaccgtaagggtttacccggggttaccggttaaccgggggaaacccttaaaccgggttaacccgtttacccgtaacccgttacccgttaacccgtaaccccgttaacgttcccgtaaaccggccgtaacccggtacccgttaaggaacccggtcccgttaacggtaaacgtttacgttttacggaaccgtttaacgttttaacttacccgtttacgttaccgtacgtaccgtaaccgggtcccgttacgtacccgtttaccgggtttaccgggaccggttaacgggttaccgtaccccggttaacggttttcccggggaaccgggtaaaccgggtaaacccttaaacgggtacggttacggtaaccggtaaaccggtaacccggttcgggtaccggtccgtaacgacccgttacccggtacgttacccgtttaccggtaccgtttaccggtaacctttacccccgg

SEQ ID NO: 12580 - DNA, 893 bp, Homo sapiens
  misc_feature: GYAE6OF02JJU0G.10.71.G05.1.454.CMB.1.raw
  modified_base (201)..(201): a, c, t, g, unknown or other
  misc_feature (201)..(201): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccaggggaaanagccaccctctcctgccagggccagtcagacgtgttccgctacttcggttagggtggtatcaactataaacgtcccggccaggcctacccgaggtcctcctacgtattccttttaggacttcgtaccgttttacgaaaccgcggggtcccccgtgggtcccgtccccgaagggtcccgttagggttaccgaacggttcgggtaccgtagggttcggggttacgttacgggggaaccctaggttacccgtttaccgtaaccgtttccgttacccgaacccgtacgttccgaacggtacccgtaacggtacccgtttaacggaaccggtacccgttaggtaaacggtttaacgtttttcgggaaaccttttaacggtttttaacgtaacgtttccggtaccgtagtacccgttaacgggtcccggttaaccgtcccgtttaccgggttttacccgggggtacgggtaaccgggttacccggtaccgttaacccggggttttacccgggggaacccgggttaaaacggggtaaaacccgttaaaaacgtaccggggttaaacccgggttaacccggtaaaccgtaccgggtttaaccggtaacgggtttccgtaacccgggtccgtaaaccccggttagtttaccccgttggtttacccctttacggttacccgtttaccccggtttacccccgg

SEQ ID NO: 12581 - DNA, 775 bp, Homo sapiens
  misc_feature: GYAE6OF02IPTXB.10.71.G05.1.454.CMB.1.raw
  modified_base (207)..(207): a, c, t, g, unknown or other
  misc_feature (207)..(207): n is a, c, g, or t
  modified_base (454)..(454): a, c, t, g, unknown or other
  misc_feature (454)..(454): n is a, c, g, or t
  modified_base (474)..(474): a, c, t, g, unknown or other
  misc_feature (474)..(474): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagaccaccgaccggagaaattggtgttagacacagtcctccagccacgctgtcctttgctccgaggggaacncgcccaacctctaccgtcgcgtaagggccctaggtaccagtaggtcgttaccgactacgtttcgggttaggggttacggtataaccaactaacgtaaacggtcccggaccgacggtccgtacccgacgggtcctccgttactacttccgttttagactttcggtaccttttacgaaccggtaccgggtccccgtcggtaccggtcccgtaggctacgggttacagggtcgtacgagggtcggtacgngggtactacggtcctttacncgttacctacgacctactgaacgcctacggtacgtaacggtacgtaccggtacgtaaagttacgtttacgtactttacggtttaacttaccgttagtacggtacgctacggtccttaccgtaccgtcggtttcggaccggttaggtccgtaccgttaccgggttacggtcgggtaaacgggtaaactaaaagggttccgtaaccggtacgtaaacgtaaccggttggttaaccggtagtacccggtaccctaacgtcgttccccggtattaccccgtacgtacccgtttacgtacccccgg

SEQ ID NO: 12582 - DNA, 789 bp, Homo sapiens
  misc_feature: GYAE6OF02G5ZND.10.71.G05.1.454.CMB.1.raw
  modified_base (179)..(179): a, c, t, g, unknown or other
  misc_feature (179)..(179): n is a, c, g, or t
  modified_base (185)..(185): a, c, t, g, unknown or other
  misc_feature (185)..(185): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacncgggtntctttgtctccgaggggaaagacgcccaccctctcctgcgagggccagtcagagtgttccgctacgttcggttagggtggtactacgaaacaataaacgtcccggaccaggcctccccgaggtcctacctctattctttagactgtcctttaccgaaaccgtacgggtcccctggtccgtacccgaggcgtacggtttcgaacggtcggacgtaggttcggggtcgtacgggaactaggtaccgttccaccgttctacccaaccgtagtaccgacgaccgtaccgtaccgtaacgtaacggacccgttaaggtaaacgtttacgttttacggaacgtttaacgtttttaaacgttaccgtaggttaccgtaagtacccgtaggtaccgtccgtacccggtttaccggtttccgggggaacgggtacgggttccgtaaccggtttacccgtttccgggggaaccgggtaaaccggaaaaccgttaaaagtaaccggggtaacgttaacccggtaaaaacggttccggttagggtacgggtaaccgtacgtaaccaacccgggttattacccgttacggttaccctttaccgaccgtttacccccg

SEQ ID NO: 12583 - DNA, 1069 bp, Homo sapiens
  misc_feature: GYAE6OF02IGNAE.10.71.G05.1.454.CMB.1.raw
tcagcatagtagtgcacgaccggtgctcgatttagtgtcgtcgcaagagagaggggggagaactgctcagttaggacccagagggaaccatggaagccccagctcagcttctccttcctctgctactctggcctccagacaccgacggagtaattgtgtcgacacagtcctcgagccacgtcttgttccgtttgtccgtaccggaaggggaaaactcgcccctaccctcttaccgtgccggaacgggccctaagtcgaacggtaggttcgttaccgccgttaacgtttcgggttaaggggtgtaactaccaaacgtaacgttaaacgtccccgggaccgtacggtcctaccccgtacggtccttaccgtctacttacgtttagaactcgttcctttaccgaaccggtaccgggtccccgtcggtacccgtcccgtacgggtaccgttacgggttccgaacgggttcgggacgtaacgggttcggggttaccgtacggggtaaccgttaacggtacccgtttaccgtaaccgtttacccgtaccgtaacccgttaccgttaacgacggtacccgtacggttacccgtaacggtaaccggttaccgttaaaggtaaaccggttttacggtttttacggtaaacccgttttaaacggtttttaccgttaaaccggttccgggtttaaaccgaacgggttacccgggttaaccgggttcccgggtttaacccggttaaccccgggtttttaacccggggtttacggggggtaacccgggttttaacggggtaccccgggtttaaccccgggtttaaccccgggggtttttacccgggggaaaccggggttaaaaacccggggttaaaaccccggtttaaaaacggggttaaacccgggggtttaaacccgggtaaaacccgttaaaaccccgggggttaaccgggttttacgggtaaacccggggttacccggttaacccggtaaaccccggtttaaccggttaacccggttttccggtttaccggtttttaccccggtttaaaccccgttaccccggtttttaaccccccgg

SEQ ID NO: 12584 - DNA, 572 bp, Homo sapiens
  misc_feature: GYAE6OF02GKMMX.10.71.G05.1.454.CMB.1.raw
  modified_base (545)..(572): a, c, t, g, unknown or other
  misc_feature (545)..(572): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctatctggctcccagacaccacggagaaattgtgttgacgacagtctccagccacgctcgtctttgtctccgaaggggaaagcgccaccctctcctgcagggccagtcaggagtgtcactcgttcggttagggtggtatcaaacgtaataaacgtccggaccagggtcctaccccgaaggcctaccgtcctaacgttcgtttaggacttcgtacctttacgaacggtaccgggccccgtacggtccgtaccccgagggtacgtacgggtttcgaaggtccggctaggggttcgggtcgtacgggaacacggtactttaccgactccgtaccgaacctagtacctaggccacggaccgtacgcggtaaccgtaggtaacgtttacgtttacgtacgttaatttacgtttacnnnnnnnnnnnnnnnnnnnnnnnnnnnn

SEQ ID NO: 12585 - DNA, 757 bp, Homo sapiens
  misc_feature: GYAE6OF02IU2UZ.10.71.G05.1.454.CMB.1.raw
  modified_base (224)..(224): a, c, t, g, unknown or other
  misc_feature (224)..(224): n is a, c, g, or t
  modified_base (254)..(254): a, c, t, g, unknown or other
  misc_feature (254)..(254): n is a, c, g, or t
  modified_base (289)..(289): a, c, t, g, unknown or other
  misc_feature (289)..(289): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggacctcaccatggagtttgggctgagcgttgggttttccctcgttagcttacttttaagagatcgtccagtgtcagatgcagatggtggagtcgtagggggngtcggtcggtccggtcgtcgggggtacccnggaacgtctctccttgttcctagtccgtcgtggtnttcgtacttacgtttaataagtccgttggctacttcggttccggtcgggttcccgtcccggtagggttccccgggaccgtacggggtctacgggtaagtggggtaccggtagaagtagtaacgtaactaagtaagtgtagtacgaacgtaaagttaaaaatgtaacgtagtaggactaaccgttaccttacggaacgggtccctagtttaaccccaactcttacccgaacctacgaacgtaacttaaccgtaccgtaaaagtaaccgtattagggtattactactacggtaataaccgacgtaaccgaacgtccgtaacggaacgtcgggaaaccgacggttaaaccgggtaccggtttagtttaacggttccggtttaagggacgggttaaaacctaaccggttaacggtacggttaccgtaacgttaacctcccggttaacccggtttaggttacctttaccgggg

SEQ ID NO: 12586 - DNA, 791 bp, Homo sapiens
  misc_feature: GYAE6OF02HW7PU.10.71.G05.1.454.CMB.1.raw
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggctcccagacaccacggagaaattgtgttgacactagtctccagccacgctgttcttgtctcgaaggggaagcgccaccctctcctgcgacggccacgtcagtagtgtcgctacgtttcggttagggtggtatacaactaagtaacgtccggacacggcctacccgacggcctacctactattcgtttagacttcgtacctttacgaaccgtaccgggtccccgttcgggtcccgtacccgagggtacctacgggtttacgagggtcggacgttaggggtcgggttaccggtagggacctaggtaaccttccgtaacttaccgtacctaccgtacgtccgacgtaccgtaccgtaccggtaacgtccggtaccgttaaggtaaactttacgtttttacgaacggttttaacgtttttaaccgtttcgttacggtaaccgtacgtaaggttaccgtaccggttacggttacccgtttacgggtttccggggacgggttaccggttccgtaccggttacccggggtttcgggaaccggggtaacgggtaaacctaaaacggggtcgggttaaaccggaaaccgttaaacccgggtaacgttcggggtaccgtacggtaccgaccgttaaccgtacgttccggtttaaccg

SEQ ID NO: 12587 - DNA, 777 bp, Homo sapiens
  misc_feature: GYAE6OF02HKRCN.10.71.G05.1.454.CMB.1.raw
  modified_base (219)..(219): a, c, t, g, unknown or other
  misc_feature (219)..(219): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaagacgcccaccctctccngcgacgggccagtcagtagtgttcgactaccgtttcggttaggggtgtataccaaacgtaataaacgtcccggaccacggcctccccgagggtcctccctactacttcgttttagacttgttacctttaccgaaacggtacccgggtcccccgtcggtcccgttccccgaggccgttacgggttcgaggtcggcgtaggttcggggtcgtaggggacctaggtacccttcgaccttcctaaccaccgtactacgacgccgtaacgcccgtaaggaccgtaccgttaaggtaaacgtttacgttttacgaccgtttaagttttacttaccggttacttacgagtaccgtacggttcgtccgtaccggttacgttccggggacgggtacggttaccggtaccgtttaccgggttaccgggaaccggggtaacggtaaacccgtaaaggtaccgggtaaccggtaaccgtaaaaccggttgggttaccggacggtaccgtacggtacctacccgttaaccggttgttacccgtttaccgtttaccgtacccgttaccccgg

SEQ ID NO: 12588 - DNA, 737 bp, Homo sapiens
  misc_feature: GYAE6OF02GQB47.10.71.G05.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagcatagtagtgcacgaccggtgctcgatttagtgtcgtcgcaagagagaggggggaactgctcagttaggacccagaggaaccatggaacgccccagctcagcttctcttcctcctgctactctggctcccagaccaccaccggagaaattgtgttgacacagtctccagccacgctgtctttgcctcgagggaancgccaccctcncgtgcgaggcctagtcagtacgtgttcgactacgtttcggttaagggtcgttaactacaaaacgtaattaaaaccgtcccggaccagggtccccttacccgacggcccttccgtacctattcgtttagtacttcgtacctttacgaaaccgtaccggggccccctacgggtccccgtacccgacggtaccgtacggttaccgtaggtcgggacctaggggttcgggttccgtacggggaccacgttaccgttctaaccgttcctaccgaaccttacgtccgacgtacgtacgaccgtaagaccgtccgtaagaacgtttactttcggaacttagtttactacgtgtacgagtcgagtccgtcgtccgttacgttcgggcggtacggttccgccgtttcgggtaccgggacgtaaccgggtaaactaaaaggtccgtagtaaccgaacgtaacggtggtaccgtacgttacgaccgtaaccgtacgttccgtttaactcccgtttaactaccgttcccgtaaccccgg

SEQ ID NO: 12589 - DNA, 802 bp, Homo sapiens
  misc_feature: GYAE6OF02GEQY6.10.71.G05.1.454.CMB.1.raw
tcagcatagtagtgcacgaccggtgctcgatttagtgtcgtcgcaagagagagggggggggagaggagcccagcactagaagtcggcggtgcctccattcggtgatcagcactgaacacagaggactcaccatggagtttgggctgagcgttgggttttcctcgttgcttacttttaagagtatgtaccagtgtacagtatgctagagtgggtggaggtcggtgggggacggtcggttcgggtacccggtccggttcggggggtaccctggacgtaccttcctccgttgttcctggtccgttacgtggtacttaccgatttacgtttaaagtaaacttcggtggtactacgttcggttacccggtggggtaccccgtcggtaaccgggttccccgaagggccccgtaacgggtcgtaacgggtaaggtcggggtagactaaggtattaaaccgtaactaaataacgtgtaacgttaaggaaactaaaaggttaaaaatacgttaagtaacggtagggtaaacctacccgtttacgtaacggaaaccgggtcctagttaaccacgttactaccgtaccaaggttaacaaaccgtaaccttaacgaaacgtaaccgtagttaggtacgttaactacgaactaacgtaaacgtcgaacccgttacgacgtaccgggaagtacccgggaaccgtaaaggtacccgggttaaggttactttaaggttacggttacgggaaggttaaaccgtaaacgtttccgacgggttacgaaccttaacggtcccgttaagttacgtttaacggg

SEQ ID NO: 12590 - DNA, 1000 bp, Homo sapiens
  misc_feature: GYAE6OF02F9AP2.10.71.G05.1.454.CMB.1.raw
  modified_base (266)..(266): a, c, t, g, unknown or other
  misc_feature (266)..(266): n is a, c, g, or t
tcagcatagtagtgcacgaccggtgctcgatttagtgtcgtcgcaagagagaggggggcctccattcggtgatcagcactgaacacagaggactcaccatggagtttgggctgagctgggttttcctcgttgctcttttaagagatgtccagtgtcagatgcagatgggtggagtcgtgggggaggcggtggtccggcggtcgggggtccctgagactctcctcgttctgtcgtctggattctattcgtttaagtaaatcgtaggntagttcggttccgtcggggtacccgtaccgtacgggttacccgacgggtccggaacgggtcgtagggtaacggtgggggtcggacgagtaatacgtaactaagttacgtgatacgaagtaaagttaaaatactaactagtaggaacgtacttaccgttaacggaacgggtccctaaacttccgaaccctagttacccgtaccgtaaggtaaccaaacttaaaccgtaaccctaaaaaggtaaccgtaaggtttacgggtaactttacgttaccgttaaacggtaaccgttaaaaccgtaccggtaaacccgaacgtaccggtaaacgggaaccggtaacccgggaccgggtaaacggggtaacccggggtttaaacggggttttaacgtttttaaacgggtttaccgggtttaaacggggggttaaacggggtaaaaccgtttaaaaccgggtttaccggtttaaacggggtaacccggggtttaaacgttaaccggtttaccccggtttaaaaccgggttttaacgggggtttaaccggttttttaaaccccggggtttaaccggggggttaaacccccccggggggttttttacccccgggggggggaaaacccccggggggtttaaaaccccgggggggttttaaaccccccccggggttttacggggtttaacccccccccgggtttttaacccccggggttttcccccgggggttttaacccccccggg

SEQ ID NO: 12591 - DNA, 734 bp, Homo sapiens
  misc_feature: GYAE6OF02HLUSO.10.71.G05.1.454.CMB.1.raw
  modified_base (440)..(440): a, c, t, g, unknown or other
  misc_feature (440)..(440): n is a, c, g, or t
  modified_base (457)..(457): a, c, t, g, unknown or other
  misc_feature (457)..(457): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaattgtgttgacacagtctccagccacgctgttctttgtctccgaaggggaaagcgccaccctctcctgacgacgggcccaggtcaaggtagtgttccgactacgtttcgggttagggtggtactactaactaacttaaacgtcccggaccgtaaggccctacccgaggtccttcctactactttcgttagtacgttcgttcctttacgaacccgtccgggtccccctgggcccgtacccgagggtactacgggttcgaggtcggcgtacggtgggtcgtagggacncgtactcactcacactntacagcctacacgtcgtacgaccgtagtaacgttgtttacgtactttaagtttattacgtgttacgaccggacgtaccggtcgttaccggacccgttaccgggttaccgggcgggttaacgggttccgtacccggttaccgggttcggggaaacccggggtaacggtaaaccgtaaaagggtcggtaacggtaccggtaaaacggttacggtcggtaccggtccggtaacgtaccgtaccgttacttccgtacgttttcctacgtaccgttccccgg

SEQ ID NO: 12592 - DNA, 802 bp, Homo sapiens
  misc_feature: GYAE6OF02JZN35.10.71.G05.1.454.CMB.1.raw
  modified_base (181)..(181): a, c, t, g, unknown or other
  misc_feature (181)..(181): n is a, c, g, or t
tcagcatagtagtgcacgaccggtgctcgatttagtgtcgtcgcaagagagaggggggggagaggagcccagcactagaagtcggcggtgcctccattcggtgatcagcactgaacacagaggactcaccagtggagtttgggctgagcgtgggttttcctcgttgtctcttttaagagtntgtccagtgtcagatgcagtagtgggttgggagtacgggtggggggaggtcggtcggggtcccggccggttcggggggtccctgtacgtaccttccgtccgttgttcgtcggtccgtcgttggtattactacgtttactttaagtaactcgtaggtctagttcggtcccggtcgggtcccgtaccgtacggttacccggacggcccggtaccgggtcgtagggtaggtacggggtcgacgtaaggtactaacgtaactaagtagtgaagtagtaaaccgtaaaagttaaaatgttaaactaggtacgggtactaaccgttaccgttaggaaccgggtccggtaactttaacccgaacctacgtacctaaccgaagtaaccaaaccgttaaaacgttaccgaaaacgtaaacgtaacgtttcggtaagttaacgttaccgttaagaaaccgtaaataacccggaaccgtacgtacccgttagggaacggtacccggaaccggtaacggggtaaccggttacgggttttactttaaccgggtacgtaagggggttaacggtaaacgttaccttaacgggtcggtagttaccggactttaacccgttaggttaggtttaaccgg

SEQ ID NO: 12593 - DNA, 844 bp, Homo sapiens
  misc_feature: GYAE6OF02IKBXO.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactcgaacacagaggactcaccatggagtttgggctgagcttgggtttcctcgttgcttacgttttaagagtatgtccagtgtacagatgcagtagtggtggagtcgtggggggtaggcggtgggtacccggtccggtcgggggggttccctggtacgtacctccgttccgtggttcctcggcgttcgtggtaactttccgtaactttccgtttaagtaaacttccgtaggtacctacgttcggttcccggtcggggttcccgtaccggttaccggtttacccgacgggtacccggaccgggtacgttacgggaacggtttcggggtacggtaccgaaggtaactacgtaaataaccgtaagttacgtaagtacgtaaacgttaaaagttaaaacgttattaacgttaagtaacggtaacgttaccgtttaccgttaaccgggtaacgggtacccgttaaaccgtacctaacccggtaactttaccccgtaaccgtaacggtaaaccgtaaccttaaaccggttaaacccaaacgttaaaccgtaggttacggtacgttactaccgtaacggtaactaaacggtaccgaacccgtacggtccgtaagaccgggtacggacccggaacgggttaacgttacggggtttaacttttaacgtcggtttaacggtacgggtaaattaaccgttacggttaggtacggtacccgttaagtcgtaaccgttaggttaccgg

SEQ ID NO: 12594 - DNA, 719 bp, Homo sapiens
  misc_feature: GYAE6OF02JEX02.10.71.G05.1.454.CMB.1.raw
  modified_base (202)..(202): a, c, t, g, unknown or other
  misc_feature (202)..(202): n is a, c, g, or t
  modified_base (300)..(300): a, c, t, g, unknown or other
  misc_feature (300)..(300): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctccgaggggaaangcccaccctctcctgccagggccagtcagtagtgttcgctacgttcggttagggtgtactcaacataaagtccggaccaggcctcccgagcctcctcnttcgttgactgtccttacgaacgcggcccccggtttaacgggtacccggttaccccggtaacggtaccggttaaccgggttaccgtaacgggttacggtaccggttacggttacgggttaccggtacgggtaacgtaccggttacgttaccgtaccgttccgtaccgtaaccgtacgtaccgtacgtcgtaacgtacgtaacgtacgtaccgtaggtaacgttacgttacgtaccgttacgtttacgtaccgtacgtacgtacgtacgtacgtacgtacgtaccgttacggttcggtacggtacgtacgtaccgttacggttacggacgtacggtacgtaagtacgtacgtacgtaacgtacgtggtacgtcgtacgtacctacgtacgtcgtacgtacgtctaccgttaccgtacccg

SEQ ID NO: 12595 - DNA, 717 bp, Homo sapiens
  misc_feature: GYAE6OF02FSIEY.10.71.G05.1.454.CMB.1.raw
  modified_base (203)..(203): a, c, t, g, unknown or other
  misc_feature (203)..(203): n is a, c, g, or t
  modified_base (212)..(212): a, c, t, g, unknown or other
  misc_feature (212)..(212): n is a, c, g, or t
  modified_base (225)..(225): a, c, t, g, unknown or other
  misc_feature (225)..(225): n is a, c, g, or t
tcagcatagtagtgcacgaccggtgctcgatttagtgtcgtcgcaagagagaggggggaactgctcaggttaggacccagagggaaccatggaacgccccagctcagcttctcttcctcctgctactctggctcccagacaccaccggagaaattggtgttgacacagtctccagccacgctgtctttgtctcgaggggaaangccaccctntcctgcagggccngtcagtagtgttcgctaactttcggttaggggtgttatacgaaactattaaaactccggtaccagggtcctaccccaggtccttacctcctattcgttttgattcgtacttttacaacgaccggggcccctgggaccgttcccaggtcaggttccaggtcggctaaggtcgggtctaggggacacggtcttacgtaactcgacctaccattaccaggccaacgtcccggttaagacgtccgtaaggtaaacgttagtttttcggaacctttaggtttaacttcgttacgttacgacgacgtaacgtccgtgtaccctaggttcggacgggtacggttcggacccttacgggttttaccgggacggtaaccgggaaacctaaaaggttaccggaaacgttaaccgaaaggtaacgttcgggtaggttacccgtacgtaacctaccggtacttacgggttaattccctttaacggtaccttcccgttaaccccg

SEQ ID NO: 12596 - DNA, 675 bp, Homo sapiens
  misc_feature: GYAE6OF02JB18M.10.71.G05.1.454.CMB.1.raw
  modified_base (149)..(149): a, c, t, g, unknown or other
  misc_feature (149)..(149): n is a, c, g, or t
  modified_base (602)..(602): a, c, t, g, unknown or other
  misc_feature (602)..(602): n is a, c, g, or t
tcagcatagtagtgcacgaccggtgctcgatttagtgtcgtcgcaagagagaggggggaactgctcagttaggacccagagggaaccatggaagccccagctcagcttctcttcctcctgctactctggctcccagaccaccaccgganaaatttgtgttgacacagtctccagccagctgttctttgtctccgaaggggaacagccctaccctctcctggcagggccaggtcagagttgttccgctaccttcggttaaggggtgtactacgaactattaaacgtcccggaccacggtccttaccgacggtacctcctacgactttctttagtacgtttcgtccttttacgaaaccggtcccggggtccccgtggtacccttcccgacgggtaccgtacggttcgtaggttcgggacctagggtccgggttcgaacggggtaactacgttaccgtttccgaccttccgtaccgtaactacgtcccgagtaccgacgtacgtacgacgtctaggtaaactgtttacgtcgttaacgtttctaacgtgtacgacgtcgactcggtctaccgttcgtacggcggtagttcgacgttcgttacggngtaaggaaccagtacgagtacgaagtcgtagtaccgatacgccattactgttccgtacgtctaccgtctcccg

SEQ ID NO: 12597 - DNA, 410 bp, Homo sapiens
  misc_feature: GYAE6OF02I8EED.10.71.G05.1.454.CMB.1.raw
  modified_base (282)..(282): a, c, t, g, unknown or other
  misc_feature (282)..(282): n is a, c, g, or t
  modified_base (379)..(410): a, c, t, g, unknown or other
  misc_feature (379)..(410): n is a, c, g, or t
tcagcatagtagtgcacgaccggtgctcgatttagtgtcgtcgcaagagagagggggaacatggtgtatctgcaaatgaccagcctgagagccgaggacacgggtgtttattactggtgggagaaatcctagtggcatcaccgtggtattgtgacgttccggggccagggaaccgtggtcaccgtctcgtccggcctccaccacgggccagtccggtccttccccctggccgccctcgcctccgaggacgtccaccgtccgagcgccacgacgccgggtccngggcctgcccgtggtacgaacggtacctccttccccacgtaacttcgtcgcgttgacggggtccgggccgtagggccaacgggcgcctaaagtcggnnnnnnnnnnnnnnnnnnnnnnnnnnnnnnnn

SEQ ID NO: 12598 - DNA, 776 bp, Homo sapiens
  misc_feature: GYAE6OF02GEDXR.10.71.G05.1.454.CMB.1.raw
  modified_base (226)..(226): a, c, t, g, unknown or other
  misc_feature (226)..(226): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctcccagacaccaccggagaaattgtgttgacacgtagtctccacgccacgtctcgttctttcgtacgttccgaaggggaacncgccctacccgttctccgtgaccgacggccagtacacgtgttcgttcgcgtacttcggttaggtgtactcaactaataacgtccgaccaggtccctccgagtaccgtacctacgtacgttcgttagactcgtaacctttccaacggaccgggtcccctgggtcccgtacccggtacggtaccgtacgggtttccgacgggttcggacgttacgggttgggttacggtcggggtaaactacggttaccttcgaaccgtcgtcccaaccgtcgtacgtaccgtacgtacgtaccgtacgtacgttaccgtaggtacgttaacgtttccggttaacctttaggtttaaccgtttagtaccgttacgtacggtccgtacggttaccgtacgtacccgtttacggttccgggtacgttacggtccgttaccggtccggtttacgggaccgggtacggtaaccgtaaaacgggttcggtaaccggttaacggtaaccgttaacggttacggtaccggtacggttaacgtaccgttacgttacgttaccggttaccg

SEQ ID NO: 12599 - DNA, 358 bp, Homo sapiens
  misc_feature: GYAE6OF02GI5VT.10.71.G05.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
  modified_base (336)..(358): a, c, t, g, unknown or other
  misc_feature (336)..(358): n is a, c, g, or t
tcagcatagtagtgcacgaccggtgctcgatttagtgtcgtcgcaagagagagggggaacatggtgtatctgcaaatgaccagcctgagagccgaggacacgggtgtttattactggtgggagaaatcctagtggcatcacctggtattgtgacttccggggccagggaaccgtggtcaccgtctcttcggcctccaccagggccatcggtcttcccctggcnccctgctccaggagcacctccgagngcacagcggccctggggcctgcccgtggtccaaggaccttacttccccactactatgctggaggcgggtctggccaaggcgcagtagnnnnnnnnnnnnnnnnnnnnnnn

SEQ ID NO: 12600 - DNA, 841 bp, Homo sapiens
  misc_feature: GYAE6OF02JTIF8.10.71.G05.1.454.CMB.1.raw
  modified_base (128)..(128): a, c, t, g, unknown or other
  misc_feature (128)..(128): n is a, c, g, or t
  modified_base (396)..(396): a, c, t, g, unknown or other
  misc_feature (396)..(396): n is a, c, g, or t
tcagcatagtagtgcacgaccggtgctcgatttagtgtcgtcgcaagagagagggggcctccattcggtgatcagcactgaaccacagaggactcaccatggagtttgggctgagctgggttttcccngttgctcttttaagagactgtccagtgtcagatgcagtagtggtcggaggtcgtagggggcgcggttgggtccccgggcgttcgggggtacccttggacgtaccgtcccgttcgttcgtttccgtggtccgttccgttacggtattcccgtatttaccgttttaagttaacgtccggttcggtacgttacgtttccggtacccggtcggggttacccgaccttacgggtccgacggtccggtaccggtcgtagggtacgggttcgggngaccgtaacggtaagttacctaagtagtacgtacggagtactaaacgtaacggtaaaattccgtaaggttacgtacggtacttaacccgtacgttaccgaaacgggtttccttacttacccgtactaacggttaccccgaaccgtagtaacctacccggttaacgtaacccgtaaacgttaagtaccgtttagggtattaccgtagtaccgtaataaacctaccggaaccgtacgaccgttaacgagtcccgggaacggtaacggaccgttacggtttacgtaagttttacccggaagggttacgggaacttaacggtcgtttaacggcggtaccgtacgttacggtaacccggtttggtacccggtttagtaccgggttacccggttacgggtaccgttaaccggggtaccttcgggttaccttacccggtccctttaacccgg

SEQ ID NO: 12601 - DNA, 755 bp, Homo sapiens
  misc_feature: GYAE6OF02JQMGX.10.71.G05.1.454.CMB.1.raw
  modified_base (153)..(153): a, c, t, g, unknown or other
  misc_feature (153)..(153): n is a, c, g, or t
  modified_base (170)..(170): a, c, t, g, unknown or other
  misc_feature (170)..(170): n is a, c, g, or t
  modified_base (206)..(206): a, c, t, g, unknown or other
  misc_feature (206)..(206): n is a, c, g, or t
  modified_base (728)..(728): a, c, t, g, unknown or other
  misc_feature (728)..(728): n is a, c, g, or t
tcagcatagtagtgcacgaccggtgctcgatttagtgtcgtcgcaagagagagggggggaacgtaggctcagttaggacccagagggaaccatggaagccccagctcagcttctcttcctcctgctactctggctcccagaccaccaccgganaaagttgtgttgacacngtactccagccacgctgtctttgtctccgagggaanacgccaccctctccgtgcacgggccagtcagtacgtgttacgctaccgtttcggttagggtcggtactacaacgtaattaaacgtccggacccgaaggtccccgtacccgtacggaccccttcccgtacgtacttaccttttacggacttcgtaccgttttaccgaacccggtaccgggtcccccgttaccgggccccggttaccccgacgggtaccggttacggttaccggtaggtaccgggtccggtaaggtcgggttacgggtccgggtacgtaacggtactttccgaccgttcaccgtaccgattacccgagcctacgtaccctaggaccgttcgtacgtaaaggttacttttcgggaacctttaaggtttactttacccggtgttaccgttagacgtcggttcgtactaccgtccgttcgggacgtcgggtactaccgttccggtcgggacgtaacggtaacctaaagtcgaacgtaccgaaggtcggtcgaggttccgcgtaacctactcgttacngttttaccaccgtacttccctacccgg

SEQ ID NO: 12602 - DNA, 779 bp, Homo sapiens
  misc_feature: GYAE6OF02I3NV5.10.71.G05.1.454.CMB.1.raw
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
tcagcatagtagtgcacgaccggtgctcgatttagtgtcgtcgcaagagagaggggggaactgctcagttaggacccagagggaaccatggaagccccagctcgagcttctcttcctcctgctactcgtggctccagacaccgaccggagtaattcggtgttacacgacgtctacacgaccncncgtnttcgttcgttcgtaccgagggaagacgccgtaccctcttccgtcgtcgacggaccgtacgtacgtagaacgttcggttcgaccgtacgtttaccggttacggggtaggttacgttaacaaaccgtaagttaaaccgtacccggttaacccggccggtacgtaccccgtaccgggtacctcccgtaccttacggtcctttaacggtagtacgttaccgttacgttaaccggaaccgggttccccgtacggttccggaacccgtcgtaaccggtacgttcggtaacggtcggtacgtaaggttcggggtacggtacgggaaccgtaagttccgttaacgtcccgtaagtacccgtaacgcgttaccgaacgtacgacggtccgtaaagtacgaccgtaagtaacgttacgttacgtacgttagttacgttacgtagttcgacgtacgtcgtcgtacgtcgtacggttacggacgtacggctcgtaccgtcgggtacgaacggttaccaaggtaccgaagtaccgacgtaacgtcggacgtacgtcgaaccttactacgttctcgttaacgcgttaactcccgttacgtacccg

SEQ ID NO: 12603 - DNA, 825 bp, Homo sapiens
  misc_feature: GYAE6OF02FI5M6.10.71.G05.1.454.CMB.1.raw
  modified_base (210)..(210): a, c, t, g, unknown or other
  misc_feature (210)..(210): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctcccagacaccgacggagtaaattgtgttgacacagtcctccgagccacgctgttctttgctaccgaggggaaacncgcctaccctctcctgcgacgggccagtcagacgtgtcgctacttcggttagggtgtactacaacgataacgtcccggacacggtcctacccgaggtcccttcctcgtactttcgtttagacttcgtacctttacgaaccggtccgggtaccccgtgggtcccgtacccggagggtaccgtacgggttacacgggtcggtacgtagggttccggggtcgtacggggaaccttaacggttcttaccgtacgttacccttaacgaccgttaacgccgtacgtcccgtaacgtaccgtacgaccggttaccggtaacgtaaacggtttacgtttacggtaacgtttaacgttttaacgtaccgttcgtaaccgacggttaccgaccggttccggttacccgtacccgggtttaccgggttaccggggtaccgggttaccggttaccggttcccggtttaaccgggttaccggggaacgggtaaaccggtaacggttaaaaacggttcgggaaccgggttaaacccgtaacgggttaacggttcggtaacggttcccggtacgtaaccccgtacgttagttacccgttccggtttaccttaccgtacccgtttaccccg

SEQ ID NO: 12604 - DNA, 669 bp, Homo sapiens
  misc_feature: GYAE6OF02JHZVD.10.71.G05.1.454.CMB.1.raw
tcagcatagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccgaggggaagacgcctaccctctcctgcacgggccagtcagagtgttcgctacgttcggttagggtgtatcaactataacgtccggcacggcctcccaggcctccgtcacttctttcgatcgtctttacaaccggtaccgggccccctgggtcccgtccgacggcgtacggttcgacgtcggcgtaggttcggggtctacggggactaggtacttccacgttcctacaccctatccgacgtacacggtcctacgacgtcgtaggaacgttatttacggtacttagttttacttacgtcgttacgaacgtcgacggtcctcggtaccctacgtttccgggacgttacggtcgtaccgttaccggttcgggaccggtaaacggaacctaaacggtacggtaccgtaaccgtaacggtacgttacggtacgggacttcggacctacgtacgtccttaggtcccttacggtcttaccccg

SEQ ID NO: 12605 - DNA, 838 bp, Homo sapiens
  misc_feature: GYAE6OF02JAH51.10.71.G05.1.454.CMB.1.raw
tcagcatagtagtgcacgaccggtgctcgatttagtgtcgtcgcaagagagagggggcctccattcggtgatcagcactgaacacagaggactcaccatggagtttgggctgagctgggttttcctcgttgctctttaagagtatgtccagtgtcagatgcagtagtggtggagtcgtgggggaggcggtggtccggccggtcgggggtccctaggacgtacctccgtcctgttcgtggtcgtcgtggtattctattctttaagtaatcgtagtctagtcgtccgtcgggtaccgtccgtacggttccgacggtccgaccgggtcgtaggaagtcggggtgtacgaacggtaataactaacgtaattagtagtaacgtagtaaacgtaaagttaaaattaactacgtaagtacggacgtaccgttacgttacggaacggtccgtaactccgtaaacctacgttacctaccgtaaacgaacgttaaacctaaacgttaacccgaaaaggttaaaccgtaagtttaccgggttaggttaacttaccgtaacgtaaacgtaaaacgttacccgaaccggtaacgttaccccggaaaggtacccggtaagggaaccccgggtaaccgggtaaacggttaccggggttttaacgttttaaaccggtacggttaacggggttaaacgggtaaaccgttaaaccggttacggtaagggtaccgtaaccgtaacgttaaccggtacgttaaccgggttaagttcggttaaccggtcccggttaaccgggtacccgtaaccggggtaccgttacccgggtaccgttaccggttcccgttaccccggg

SEQ ID NO: 12606 - DNA, 696 bp, Homo sapiens
  misc_feature: GYAE6OF02GEKT1.10.71.G05.1.454.CMB.1.raw
  modified_base (178)..(178): a, c, t, g, unknown or other
  misc_feature (178)..(178): n is a, c, g, or t
  modified_base (357)..(357): a, c, t, g, unknown or other
  misc_feature (357)..(357): n is a, c, g, or t
  modified_base (386)..(386): a, c, t, g, unknown or other
  misc_feature (386)..(386): n is a, c, g, or t
  modified_base (596)..(596): a, c, t, g, unknown or other
  misc_feature (596)..(596): n is a, c, g, or t
tcagcatagtagtgcacgaccggtgctcgatttagtgtcgtcgcaagagagaggggggcctccattcggtgatcagcactgaacacagaggactcaccatggagtttgggctgagcttgggttttcctcgttgcttctttaagagatcgtccagtgtcagatgcagatggtgagtcgnggggacgcgtggtccggtccgtcgggggtccctggactacgtctccgtgtcgtgcgtcgtggtacttctattctttaagaaatcgtagctagtcgtccgtcggtcccgtacctacggttaccacgggtccaacgggtctaagggaagtggggtcggactagaagtaataactaaaagtntagacttaagaactaaagttaaaaacttntaacgtaagtacgaactacgttaccttacgaacgggtacccgtaacttcgaaccctagttccctaccgaagtacgtaaactaacgttaacaaaaggaactagttcgtagtaacttcgacgtaactaaacgaccgaacctacgaccctaggaaccgacgtaccggaacggtaacggtacggtttagtttaattaacggtggtaacggtaanaaacttcgtaagtcgactaccgttacaccggtttacgtattacggagttaccggtaacccggagtaacgggtaccgtccgtccgtaccgttcttacccgg

SEQ ID NO: 12607 - DNA, 699 bp, Homo sapiens
  misc_feature: GYAE6OF02I84I4.10.71.G05.1.454.CMB.1.raw
  modified_base (199)..(199): a, c, t, g, unknown or other
  misc_feature (199)..(199): n is a, c, g, or t
tcagcatagtagtgcacgaccggtgctcgatttagtgtcgtcgcaagagagagggggggaactgctcagttaggacccagagggaaccatggaagccccagctcagcttctcttcctcctgctactctggctcccagacaccaccggagaaattgtgttgacacagtctccagccacgctgtctttgtctcgagggaancgccacctctctgcgacgggccagtcagagtgtcgctacgttcggttagggtgtatacaactaataaacgtcccggaccaggcctacccgaggtcctcctctacttcgtttgacttcgtactttacgaaccgaccgggtcccgtcgggcccgtacccgagggccgtacgggttacgtacggtacggcgtagggtcgggtacgtacggggacgtagtaccttctaaccgtccgtaccaacctagtaccgagtaccgtacgtaccgaacggacgtacgtacggtaagttagtttacggtactttaagtttacttacgtgtactaggacgtacgtccgtcgtccgttacgggttcggacgggtacggttccgaccgttacgggttaccgggtacggtaaacgggaaacctaaagggtacgaaccgttaacgaaacggtacgtaggtacggactaaccgacctaccgagttcgttacgttcccgtacttccgtacccgtacccg

SEQ ID NO: 12608 - DNA, 632 bp, Homo sapiens
  misc_feature: GYAE6OF02GIWZL.10.71.G05.1.454.CMB.1.raw
  modified_base (206)..(206): a, c, t, g, unknown or other
  misc_feature (206)..(206): n is a, c, g, or t
  modified_base (308)..(308): a, c, t, g, unknown or other
  misc_feature (308)..(308): n is a, c, g, or t
  modified_base (411)..(411): a, c, t, g, unknown or other
  misc_feature (411)..(411): n is a, c, g, or t
tcagcatagtagtgcacgaccggtgctcgatttagtgtcgtcgcaagagagagggggggggaggaactgctcagttaggacccagagggaaccatggaagccccagctcagcttctcttcctcctgctactctggctcccagacaccaccggagaaattgtgttgacacagtctccagccacgctgtctttgctccgaggggaaangcccaccctctcctgcgagggccagtcagagtagttaacaacaactactagccttaggtaccagacaagaaacctggaccaggcctccccgaggcctccctnacttctatgatcgcacgtccagcgacgggccacgtggccactcccgagactaggttccaggtcggctaggtggtcgtagggacacgtacttcacctcacaccntcacgctagacgtacggacgaccgtaagttcgtttacgcgtagttagttacttacgtacgttacgacgcgtacggtccgtacgtacccgttacggtttaccgggcgggtacgtcgtacccgtacggtttaccgggaccgggtaacgggtaaacccgtaaagtacgggtaaacggtaaccgaaaccggtacggtacggtacggccgtacgacctaccgtacg

SEQ ID NO: 12609 - DNA, 771 bp, Homo sapiens
  misc_feature: GYAE6OF02FSMYT.10.71.G05.1.454.CMB.1.raw
  modified_base (209)..(209): a, c, t, g, unknown or other
  misc_feature (209)..(209): n is a, c, g, or t
  modified_base (271)..(271): a, c, t, g, unknown or other
  misc_feature (271)..(271): n is a, c, g, or t
  modified_base (327)..(327): a, c, t, g, unknown or other
  misc_feature (327)..(327): n is a, c, g, or t
  modified_base (454)..(454): a, c, t, g, unknown or other
  misc_feature (454)..(454): n is a, c, g, or t
tcagcatagtagtgcacgaccggtgctcgatttagtgtcgtcgcaagagagaggggggggaactgctcgagttaggacccaggagggaaccagtggaagccccagctcagcttctcttcctctgctactctggctccagacaccgaccggagaattgtgttgacacagtctccagccacgtctgttcctttgtcctccgagggggaaancgccaccctctcctgcagggccagtcgagtgtcgttcgcttacgtttggttagggtgttaanactaaacaagtaaaacgttccggtactacgggtaccttacccgaggtcctccgtanacgttccgtttgaacgtccgttacgtttaccaaccggtaaccgggtccccttaggggtacccgtcccgaggtctacgggtttacggagggttaccggacgtcggggtttcggacggtagggtaccgngttacttcgtactttccgactaccgtattacgacgtacgtaacctacgttacgactccggttaaggtaaacgtttcgtttacgtaccgtttaacgggttttaacttacggttacgtacgtaacggttacggtacggtcgttaaccgttacttccgggttaacggggtcgacgggttcctaaccggtttacgttccgggaaacgggtactaaaaccggttaagtccgggtaacggttacgaaaccggtacggttggtaaccgttacggacaccgtactacggttaccgttagttacctacggttcccgtccgtacccg

SEQ ID NO: 12610 - DNA, 784 bp, Homo sapiens
  misc_feature: GYAE6OF02FKOH3.10.71.G05.1.454.CMB.1.raw
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (242)..(242): a, c, t, g, unknown or other
  misc_feature (242)..(242): n is a, c, g, or t
tcagcatagtagtgcacgaccggtgctcgatttagtgtcgtcgcaagagagaggggggagaactgctcagttaggacccagagggaaccatggaagccccagctcagcttctccttcctcctgctactctggcctcccagacaccacggataaattgtgttgacacagtctccgagcccacgctgtctttgtcctccgaaggggaacncncccaccctctcctgccgcgggccagtccgagnggtaccgttccgctacgtttcgggttaagggtcgtataccaaacgtaattaaaccgtcccggaccgtaacggtcccgttaccccgacggtaccttccctacgttactttccgtttagacgttcgttacctttaaccgaaccgtacccggggtccccgtacggcccggttacccgacggtaccgttacggttaccgagggtcggtcggtaggttcgggtacgtaggggacctacggtaccttaccgactaccgtacacctatctacgcgtaccgacgttagccgttacgagtagttcgtttacgaacgttagtttactcgttagtaactcgagtaccgtcgtttaccgaccgtttaccgttcgggtaaccggtacggttaccggtaccgttttaccgggtaccggggtaacggtaaaccggaaaattaaaccgggtacggtacggtaaaccggtaacccgttaacggttacgggacggttaacccacggaaccccggtttagcccggtttaactggtttcccctttaagttcccctaccccgg

SEQ ID NO: 12611 - DNA, 812 bp, Homo sapiens
  misc_feature: GYAE6OF02HQ9OS.10.71.G05.1.454.CMB.1.raw
  modified_base (148)..(148): a, c, t, g, unknown or other
  misc_feature (148)..(148): n is a, c, g, or t
tcagcatagtagtgcacgaccggtgctcgatttagtgtcgtcgcaagagagaggggggaggaactgctcagttaggacccagaggaaccatggaagccccagctcagcttctcttcctcctgctactctgctcccagacaccacgganaaattgtgtgacacagtctccagccacgtctgtctttgctaccgaaggggaaacgacgacccaacccgtctcctgccgacgggccaagtcagtagtcgttaccgactaccgtttcggtagggttggtaactacaaactaagtaaaacgtcccggaccacggcctacccgaggccttccgtactacgttactttaggtaacttcgttaccttttaacgaaaccggtaccgggtacccccgttcgggacccggttaccgacggtacggtacggttaccgtaaggtacggtacgagggttcgggttacgttacggggacctaaggtacctttacaccgttactacccgtaacctagtaccgacgtaccgtaaccgtacgtacggaacgtaccgtacggtaaagttacgttttacgtacgttaaacgtttttacttaacgttcgttaaccgacgtaccgttacgaccggttacaccggttacgggtttacggaccgggtaggttcgtaacccgttagggtttaccgggaaccgggaaacggtaaaaccgtaaaagggttagggtaaccgttaaaccggaaaaccggttaacggttaacgggtagtccggttaacgaccgttaaccgtattaccggtttacttaccgtttaccgtacctttaaccccgg

SEQ ID NO: 12612 - DNA, 724 bp, Homo sapiens
  misc_feature: GYAE6OF02FGPRA.10.71.G05.1.454.CMB.1.raw
tcagcatagtagtgcacgaccggtgctcgatttagtgtcgtcgcaagagagaggggggggagaggagcccagcactagaagtcggcggtgcctccattcggtgatcagcactgaacacagaggactcaccatggagtttgggctgagctgggttttcctcgttgctcttttaagagatgtccagtgtcagatgcagatggtggagtcgtgggggagcggtcgggtccggccggtgggggtccctgacgtactccgtcctgttcgtgccgtctggtattcactttctttaagtaaacttctacggtcacgttcggttccggtacggggtcccgaccgttacggtttacccgacgggccgaacgggggtcctaggggaacggttggggtacggactaaggtaacttacgtaactaactagtagaacgttagaaccgtaaaagttaaaacttacgtaacgtagttacgggaacgtaccgttacccgttacggaacgggtacccgtacttaccaccgtactacctaccgaacgaacaacctaacgttaccaaacggactaaggttcggttagtacgtccgtagaacgtaagtccgaacgaacgcctacggacgaaccggcggtaacgggtaccggttaccgggttagtttacggttaacggttagggtaacggtaacggttaacttcggttacggtcggtacctacgtacccgttacgttggttacgg

SEQ ID NO: 12613 - DNA, 1030 bp, Homo sapiens
  misc_feature: GYAE6OF02IKMHN.10.71.G05.1.454.CMB.1.raw
tcagcatagtagtgcacgaccggtgctcgatttagtgtcgtcgcaagagagagggggagagccctggggaggaactgctcagttaggacccagagggaaccatggaacgccccagctcagcttctcttcctcctgctactcgtgcctcccagaccaccgaccggaagtaaattggtagttcgacacagtcctccgacgcccacgccttgttccttttcgtaccgtaccggaagggggtaaaacgaccggtacccctaaccccgttccgttcccgttacggccggaacgggggtacccctaacggttccggaaggttaacggtttcggtttacccggaaccgttaccggttttaacggggtttaacggggggttacgttttaaacctaacccgaaaaccgttaaaattaaaaccggtcccccgggtaccgaaacggttacccctaccccggaacgggttcccttaccccgtttaacgtaaacctttttccgtttaggtaaccgttacgttttacccgttttaaccggaaacccggttccccggggtaccccttacggggtccccgttaccccggagggtaaccgtttacggggttaccgtacggggtacggtcggttaaccggggttcggtttacggtaacggggtaccaacgttaacccgttttccgaccctttacccgaaccaaccgttacgtaccgaacgtaaccggtacgttaccgtaaggtaccgttaaccgtaacggttaaacgttttcggtttaacgtaacgtttttaacgttttaacgttaccgtttaacggttacgtaaccgggtagttaacccggttccggttaaccgttaccccggttaacgggtttccgggacgggttaaaccgggttcccgttaacccgggttaacccgggtttccggggaaaccggggtaacccggtaaacggttaaaccggtaacgggtaacggtaaaccggttaacggaacggttgggttaccgtacgtaccggtaaccccgtaagttaccgttacgtttaccgg

SEQ ID NO: 12614 - DNA, 702 bp, Homo sapiens
  misc_feature: GYAE6OF02F8B5O.10.71.G05.1.454.CMB.1.raw
  modified_base (152)..(152): a, c, t, g, unknown or other
  misc_feature (152)..(152): n is a, c, g, or t
  modified_base (204)..(204): a, c, t, g, unknown or other
  misc_feature (204)..(204): n is a, c, g, or t
tcagcatagtagtgcacgaccggtgctcgatttagtgtcgtcgcaagagagagggggggggagaactgctcagttaggacccagagggaaccatggaagccccagctcagcttctcttcctcctgctactctggctccagacaccaccgganaaattgtgtgacacagtctccagccacgctgtctttgcgtccgaaggggaangccctaccctctcctgcgagggccagtcagtagtgttcgctacgttcggttagggtgtaatacaacgtaataaacgtccggacaacggtcctacccgaggtcctcctctagttcctttgacgttgtaccttttaccgaaacggtccgggtccccctggtcccgttacccgacgggtaccgtacggggtttaccaagggttcggaccgtacgggttcgggtaccgtagggactaacggtacttacacgtctaccaacatactacgctacgtacctaaggcgtacctaggtaacttagtttacgactttaacgtttataccgttagtacgacgtacgtagccgtctcccgttacgtttccggggagtcgggtacacccgtttcggtccgggtaacggaacggtaaaccgtaaaagtcgggtaacggtaacccgaaaacgtcgggtatacgggtcctagacccgtaagtccttacgttacgttacttaccgtacttcccgg

SEQ ID NO: 12615 - DNA, 906 bp, Homo sapiens
  misc_feature: GYAE6OF02JRST4.10.71.G05.1.454.CMB.1.raw
  modified_base (889)..(889): a, c, t, g, unknown or other
  misc_feature (889)..(889): n is a, c, g, or t
tcagcatagtagtgcacgaccggtgctcgatttagtgtcgtcgcaagagagagggggagagccctggggaggaactgctcagttaggacccagagggaaccatggaagccccagctcagcttctcttcctcctgctactctggctccagacaccacggagaattgtgttgacacagtctccagccacgctgttctttgtctccgaagggaagacgccaccctctacctcgcgacggccagtcaggtagttcgttcgacttacgttacggttagggtacgtactacgaaactaacgtaaacgtcccggaaccgtacggcctacccgacggtccttcccgtactagtttccgtttagacgttccgttacctttaaccgaaaccggtaccgggtcccccgttacgggtaccccggttaccccggaacggtaccggttaaccgggttaccggtaagggggttccgggtaacgggttacggggttaccggggttttacccggtaacgggggaaacccgtttacggtttaacccggttttaccgtaaaccccgttccgtttaacccgaacccggtttacgaaccccggtaaggtacccgtacccgggtaaaccggtaaccgtaccggggttaaccttaaacggggttaaacgttttacgttttaaccggtaacgttttaacgttttttaaacgtaccggttacttaaccggtaaccggttaactccggttcgggtttaaccctacccgggtttacgggtttaccgggaccgggttaacgggttcccgtaacccggttaccgggtttacggggaaccgggttaaccggtaaacgtaaaccgggttaagggtaacctaaaccgggtaaacgtccgtttaggcgttacgtaccgtacncgttaacgttccgtacg

SEQ ID NO: 12616 - DNA, 711 bp, Homo sapiens
  misc_feature: GYAE6OF02FPX2Q.10.71.G05.1.454.CMB.1.raw
  modified_base (318)..(318): a, c, t, g, unknown or other
  misc_feature (318)..(318): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaattgtgttgacacagtctccagccacgtctgtctttgtctccgagggaaagcgcccaccctctcctgccgaggccagtcagagtgttcgctacgtttcggttagggtgtatccaaacataaatccggaccgaggcctcccgaggccttcctctattctttgatntctttacaacgtaccgggccccctgggccgtcccgagggtcctagggtttacaggttcggcgtaggttcggggtccgaggggtactacgtacttccgacgtcctaccacctagacgtacgccacgtacccgtagccgtacgttacggaaagtttagttttacgacgttaaagttttaccgttacgttcgtaacctaggtacctaggtcgggttcctacccgttaccgttccgggggacgtacgggtacccgttccggttaccggtttcggggaccgggtaaacggaaaccgtaaacgttcggaacgggttaaccaaaccgggttcgtaggtccggtaaccgtcggacccctaacgtacgttaccgttcgtttaccttccgtaacttcccccgg

SEQ ID NO: 12617 - DNA, 673 bp, Homo sapiens
  misc_feature: GYAE6OF02HA7IR.10.71.G05.1.454.CMB.1.raw
  modified_base (216)..(216): a, c, t, g, unknown or other
  misc_feature (216)..(216): n is a, c, g, or t
tcagcatagtagtgcacgaccggtgctcgatttagtgtcgtcgcaagagagaggggggagagccctggggaggaactgctcagttaggacccagagggaaccatggaagccccagctcagcttctcttcctcctgctactctggctcccagacaccaccggagaaattgtgttgacacagtctccagccacgctgtctttgtctccaggggaaacngccacctctcctgcagggccagtcagagtgttcgcacttcgttagggtggtatcaacataaagtccggccaggcctcccgaggcctcctcattctttgatcgtctttcaacgtacgggccccctggccgtcccgagggacctagggtttcaggtcggccgtaggtcggggtctcgggacaggtaccttcgaccttctccgacctatacgagtccgacgtacccgttaggacgtccctaaggaacggttacttttcgacgttagtttttacttaccgttgttaccgtagtaccgtagtccggtcgtaccttacgtttcgggtaccgggtacgggttctacccggttacgtttccggggacgggtaccgggaaccgtaaacggttacggaacgggttaccgaaaacggtaccggttaggtacggtaccgtacggacccgtactacgttcgtttaaccgg

SEQ ID NO: 12618 - DNA, 711 bp, Homo sapiens
  misc_feature: GYAE6OF02JT31T.10.71.G05.1.454.CMB.1.raw
  modified_base (201)..(201): a, c, t, g, unknown or other
  misc_feature (201)..(201): n is a, c, g, or t
  modified_base (219)..(219): a, c, t, g, unknown or other
  misc_feature (219)..(219): n is a, c, g, or t
tcagcatagtagtgcacgaccggtgctcgatttagtgtcgtcgcaagagagaggggggaggaactgctcagttaggacccagagggaaccatggaacgccccagctcagcttctcttcctctgctactctcgctccagaccaccacggagaaattgtgtgacacagtctcagccacgctgttctttgtcgtcgagggaaancgccctacctcactcganacgggcctagtccgagacggttcgtcgtactaccgtttcggtaaggttcgtacttacaaactataactcgcggacgacgtacccgtaccgcggtacctctacgttacgttcgttacgtgtttaccggtaccgttaaccgaccgggtcccggtaccccgggtcgggtacccgtacgtacgggtcggttaacggtcgtacggtcgggttcggtacggtgggtccgggaacggttacgtacccgtttactactaccttacctcgaaccgttctacgacgtccgtacgtacccggtagtacggttaaccgtaacgttacgttaccgtttagtaacgttttacgtttaaacgttcgtactcggacgtcgtacgtcgtcttacggttcgtaccggttacgtctacgtacgtcggtacggacggtaacgaagtacgacggttacgacgtagtacgtcgtcgtacaccgacgtcgtaccgtcggtcttccgtcgtacccg

SEQ ID NO: 12619 - DNA, 628 bp, Homo sapiens
  misc_feature: GYAE6OF02GV3A6.10.71.G05.1.454.CMB.1.raw
  modified_base (205)..(205): a, c, t, g, unknown or other
  misc_feature (205)..(205): n is a, c, g, or t
  modified_base (397)..(397): a, c, t, g, unknown or other
  misc_feature (397)..(397): n is a, c, g, or t
  modified_base (424)..(424): a, c, t, g, unknown or other
  misc_feature (424)..(424): n is a, c, g, or t
tcagcatagtagtgcacgaccggtgctcgatttagtgtcgtcgcaagagagagggggggaggaactgctcagttaggacccagagggaaccatggaagccccagctcagcttctcttcctcctgctactctggctcccagacaccaccggagaaattgtgttgacacagtctccagccacgctgtcgttgtctccgaggggaaangcccaccctctcctgcagggccagtcaggagtgttcgctacttcggtagggtgtatcaacataaatccggaccaggcctcccgaggcctccctctacttctttgatcgtctttacgaacgcgggcccctggccgtccgaggctaggtcaggtggcgtaggtcggtcgtgggactagtctacactcacaccgntcgacgcagctaagcgcgtagtagttntttcgacttagtttactacgtgtacgacgctaggcgttacgccttaacggttgggaccggtaggtccgtaccgttacgggttccgggacgggtaacggtaaactaaaggtacggtacggtaaccgaaaccggtggttacggtacgggtactaccggtacctaaccggttgttacccgttacgttaccttactccgttacccccg

SEQ ID NO: 12620 - DNA, 862 bp, Homo sapiens
  misc_feature: GYAE6OF02G1X98.10.71.G05.1.454.CMB.1.raw
tcagcatagtagtgcacgaccggtgctcgatttagtgtcgtcgcaagagagagggggggggagaggacgcccagcactagaagtcggcggtgcctccattcggtgatcagcactgaacacagaggactcaccagtgggtaggtttgggctgagtcgttcgggttttcctcgttcgtcttcttttaagagtatcgtcctagtgtacagatcgcagtagtggtaggtaggtcggtgggggaggtcggttcgggtccgggtccgggtcggggggtccctaggacgtacttccttccgttcgttcgtcggtccggttcgttaggtactttcgtatttacgtttaaagttaacttcgtacggtctacgttcggttccgtcggggtcccgtaccgtacgggttcccgaccgggtccgtacggggtcgttacggggtaaggttggggtacggtacgaagtaacttaactaacgtaaagttagtagtaacgtacgtaaacgtaaaagttaaaaacttaacgttaaccgttaaaggttacgggtaaccgttaacccctttaccggttaaaccggggaaccggggttaccccgtttaactttaaccccgaaacccgttcttacccgtaccggaaacggtaaacgttaaacccttaaaccgtaaccggaaaagtaacccgttaaaggttcggttaacttaccgtacgttacggtaaacctaaaggtcccggaaccgtaccgtacgtagggaacgtacccgggacgggaacgttaacgggttaggttttacgtttaacgtaacgggttgggaaacggtaacttacgttaccgtggtaccgttacaaccgtttaccgttacggttaggtttacgg

SEQ ID NO: 12621 - DNA, 890 bp, Homo sapiens
  misc_feature: GYAE6OF02JTPDG.10.71.G05.1.454.CMB.1.raw
  modified_base (107)..(107): a, c, t, g, unknown or other
  misc_feature (107)..(107): n is a, c, g, or t
tcagcatagtagtgcacgaccggtgctcgatttagtgtcgtcgcaagagagagggggagagccctggggaggaactgctcagttaggacccagagggaaccatgganccccagctcagcttctccttcctcctgctactcgtggcctcccacgaccaacccgaccggaataaagttgtgttgaccacgagtcctccagcccacgcttcgttcgtttcgtcctaccgaaggggaaactaccgccctacccgtccttcctcggtccgacgggccctagtacctaggtacgttcgttcgtacctaccggttacggttaggggtcgtaactacctaacgtaagttaaaccggtccccgggaccgtaaccgggcccgttacccacgggtccccttacccgttactaactttcccggttaacggtacttaccgttaccgttttaaccgaacccggggtaaccccggggttccccctacgggtacccggtacccccgtaaccggggtacgttaaccgggttccggacggttacggggtacggttacggggggtttacggtaccgggttaccgggaaccttaccggggttaaccttaccccggtaacccttccgtaaccctacccgtaacgttaccgaaccgggtacctaaacgggttaacccggcgggttacccgtaacccggtaaggttaacgtttaacggtttacggtacgttaggttttaaccggttaagtacgttacgaacggtactaacggtacgttaccggtcgggtacccggcccggtacgttccgttacggttcggtaccgggacgggtaccggaggttacgggtcgaacggtaacgtaacgtacggtacgttggtacgtacgtccgttacgtacctgttacggttccg

SEQ ID NO: 12622 - DNA, 802 bp, Homo sapiens
  misc_feature: GYAE6OF02FVWKH.10.71.G05.1.454.CMB.1.raw
  modified_base (123)..(123): a, c, t, g, unknown or other
  misc_feature (123)..(123): n is a, c, g, or t
  modified_base (129)..(129): a, c, t, g, unknown or other
  misc_feature (129)..(129): n is a, c, g, or t
  modified_base (161)..(161): a, c, t, g, unknown or other
  misc_feature (161)..(161): n is a, c, g, or t
  modified_base (211)..(211): a, c, t, g, unknown or other
  misc_feature (211)..(211): n is a, c, g, or t
tcagcatagtagtgcacgaccggtgctcgatttagtgtcgtcgcaagagagagggggagagccctgggaggaactgctcagttaggacccagagggaaccatggaagccccagctcagcttcncttccncctgcctactctggctcccgagcaccaccggnaaattgtgtgacacagtctccagccacgctgtctttgctccaggggaaancgcccaccctcgtccttgccaggggccagtcaaggagttcgttcgccacgtttacgttaggggtacggttaagtacctaaacgacttaaaacgttccccgggacccgtaagggaccttacccccggaagggtcctacccgttacgtacctttaacgttttcggaacttcggacctttttaccgaaaccgtaccggggtccccctaggggtaccgttcccccaaggggtcctacggggtttaccaagggttcggccgtaggttcgggggtaccgttggggaccaggtaccttaccgaccttcgaccctaaccgtacgttacacggtaccgtacgggtacccgtaacggtaccggtaccgttaacggtaacgtaacgtttttagacgtttaaagtttacgtttacttcggttaaccaacgttacgttacccgggtaaccgtacgggttaccggtacccggttcccgggggttaccctaccggttttacccggacccggttacgggtaacccgtaaggttacggtaacgtaacgtaaccgaacggtaaccgttcggtacgtactcggacctacccgtagtcctagtcccttacg

SEQ ID NO: 12623 - DNA, 794 bp, Homo sapiens
  misc_feature: GYAE6OF02F4TE9.10.71.G05.1.454.CMB.1.raw
  modified_base (149)..(149): a, c, t, g, unknown or other
  misc_feature (149)..(149): n is a, c, g, or t
  modified_base (169)..(169): a, c, t, g, unknown or other
  misc_feature (169)..(169): n is a, c, g, or t
  modified_base (202)..(202): a, c, t, g, unknown or other
  misc_feature (202)..(202): n is a, c, g, or t
  modified_base (329)..(329): a, c, t, g, unknown or other
  misc_feature (329)..(329): n is a, c, g, or t
  modified_base (491)..(491): a, c, t, g, unknown or other
  misc_feature (491)..(491): n is a, c, g, or t
tcagcatagtagtgcacgaccggtgctcgatttagtgtcgtcgcaagagagagggggggaactgctcagttaggacccagagggaaccatggaagccccagctcagcttctcttcctctgctactctggctcccagaccaccaccgganaaattgtgttgacacagtcncagccacgctgttctttgtctccgaggggaaancgccaccctctcctggcacggggaccagtacgacgaggttcgtaccgctaacgttttcggttaaggggtcggtaataccaaactaataaaacgtccggacctaggccttacccgaggtcctccctanacgttccgtttagaacttcgttaccttttacgaaccggtaccggggtcccccgttgggtacccgtaccccgtaagggcctaacgggtttcacgggttacggcggtaacgggttcggggtactcggggaactacgtaaccgtactacgtctaacgacacgtanacggtacacgtcctaggacgtcctagtaaggttcttttgggacttagtttaaacgtccgttgtacacgtacgtacggtccttacggccctttaaccgggtcgggtaacggtcggttacccttacccgggttaacggtttcgggaacggggttaacccgtaaaaccgttaaagggaccgggtaacggttaacgtaaaacccgggaggtttccgggaacggttccggtaaccgttaaccccgtaacgtaccgtttaccgttacggttaacctttacccgtttacccgtaccccgtttaaccccgg

SEQ ID NO: 12624 - DNA, 847 bp, Homo sapiens
  misc_feature: GYAE6OF02IUDC0.10.71.G05.1.454.CMB.1.raw
  modified_base (152)..(152): a, c, t, g, unknown or other
  misc_feature (152)..(152): n is a, c, g, or t
  modified_base (210)..(210): a, c, t, g, unknown or other
  misc_feature (210)..(210): n is a, c, g, or t
  modified_base (274)..(274): a, c, t, g, unknown or other
  misc_feature (274)..(274): n is a, c, g, or t
  modified_base (334)..(334): a, c, t, g, unknown or other
  misc_feature (334)..(334): n is a, c, g, or t
tcagcatagtagtgcacgaccggtgctcgatttagtgtcgtcgcaagagagagggggaggaactgctcagttaggacccagagggaaccatggaagccccagctcagcttctcttcctcctgcctactctggcctcccagacaccaccgganaaattgtgttgacacacgtctccagccacgctcgttctttgcctaccgaggggaaacncgccctaccctctctgcgagggccctaggtcagtagtcgttcgactacgttcggttaaggggtntatacgaactactaaacgtccggctacggcctacccgaggtcctcctacactttcgttanacttcgtactttacgaaccgtacgggtcccctgggacccgttcccgaggtaccgtaggttactcggtcggaccgtaggtttcgggtcgtacgggactacgtacgttcaccgttacctcctaacccgtataccgacgcgtaaccgccgtagtaaccgtccgtaagtaaacgtttgttttacgtacgtttaacgttttacgttaacgttacgttacgtacggtaccgtacggttcccgttaccgggtaccctttacccgggttttcccggggaacggttacccgggttacccttacccgggtttaacgggtttaccgggggaacccggggttaaacccgggtaaaaccttaaaacggggttccgggtaacccgggtttaaaacccgtaaaccggggtaaaccgggtttcccggggtaacggttcccggtaaccccggtttaaccggtacccgttacgggtttaccccctttaacgggtttcccgtttaacccctttaccccggggttaacccccc

SEQ ID NO: 12625 - DNA, 770 bp, Homo sapiens
  misc_feature: GYAE6OF02JMNUC.10.71.G05.1.454.CMB.1.raw
  modified_base (485)..(485): a, c, t, g, unknown or other
  misc_feature (485)..(485): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgcctactctggctcccagacaccacggagaattgtgttgacacagtctccagccacgctgtctttacgtcctaccgaagggaaagacgacctaccctctcctgcgaggccagtcagtagtcgtcgctacgttcggttagggtgtactacaacgaactaacggtcccggaccgtacggccgtaccccgagggtcccttaccgtaccgtactttcgtttaggacttgttacccgtttaccgaaccggtaccgggtcccccgtacgggacccgtacccgacggtacgtacggttcgacggtacggcggttacggtcggggtaccgtacgggactacgtaccgttaccaccgttctaccacccgtanccgtagcctacgtaccgtagctaccggtagtaaacgttgttacgtaacgttaactttacgttaaccgttcggtaacgtacgtacgacggttaccgtcgtacccgtttacgggttccggggtacgggtaccgttaccgtcccggtttacgggtaccgggtaccggtaaacggtaaaccctaaagggtaccggacgttaaccgaaacggtacggttacgggtacgtccgtaacgacccggttaaccgttcgtaccgtttacgttaccggttaccttaccggtccccg

SEQ ID NO: 12626 - DNA, 653 bp, Homo sapiens
  misc_feature: GYAE6OF02FYXMV.10.71.G05.1.454.CMB.1.raw
  modified_base (152)..(152): a, c, t, g, unknown or other
  misc_feature (152)..(152): n is a, c, g, or t
  modified_base (205)..(205): a, c, t, g, unknown or other
  misc_feature (205)..(205): n is a, c, g, or t
  modified_base (318)..(318): a, c, t, g, unknown or other
  misc_feature (318)..(318): n is a, c, g, or t
  modified_base (359)..(359): a, c, t, g, unknown or other
  misc_feature (359)..(359): n is a, c, g, or t
  modified_base (400)..(400): a, c, t, g, unknown or other
  misc_feature (400)..(400): n is a, c, g, or t
  modified_base (407)..(407): a, c, t, g, unknown or other
  misc_feature (407)..(407): n is a, c, g, or t
tcagcatagtagtgcacgaccggtgctcgatttagtgtcgtcgcaagagagagggggggaggaactgctcagttaggacccagagggaaccagtggaagccccagctcagcttctcttcctctgctactctggcctccagacaccaccgganaaattgtgtgacacagtctaccagccacgcttgtctttgctcgaaggggaaancgaccaccctctcctgacgtacgggccagtcagtagtcgttcgactacttcggtagggtgtactacaacataaacgtccggccaggtcctccgagcctcctctacttcttagntctcttaccaacgacggccctggcccgtccgaggtcgcgtntaggtgcgtaggtgggtcgtaggactagtactacgcttccncaacctnacgactcgacgtaccgaacgcgacgtgtaacgtaatttcgaccgttaagttttactaacgtcgtacgagtacgaacgtccgttacgcccttaacggtttcgggacgtacgggtccgttaccgtccggtttccgggaacggtaaccggaaaacgtaacgttacggaacggtaaccgtaaaccgtaggttcggtacggtcctaagcccgttaactacgttcccgttgttccttacgacctttccccgg

SEQ ID NO: 12627 - DNA, 1117 bp, Homo sapiens
  misc_feature: GYAE6OF02IF6FF.10.71.G05.1.454.CMB.1.raw
tcagcatagtagtgcacgaccggtgctcgatttagtgtcgtcgcaagagagagggggggaggaactgctcagttaggacccagagggaaccataggaagccccagctcagcttctccttcctcctgctactctggcctaccagaccaccgaccggagaaattgtagttagacacagtcctccacgccacgtctcgttctttcgtactaccggaaggggaaacgacgaccctaccctcctccgtaggaccgacgggacctaacggttcaacggtacgttccggttaccgtaccgttaaccggttttacggggtttaagggggttacgttaaaccgtaaaccgtaaaaccttaaaacggttaaaaaccggtccccggggtaacccgtaaccgggtaaccccgttcccccgggaacgggttaccccctttacccttacccgttaacgtttttaccggtttaaccggtaaacggttttacccgtttaacccgttttaaacccggaaaccccggggttaccccggggttacccccggttacggggttaccccgggttaccccgggtaacggggtaccgggtttaaacggggttcccggtaacgggttacgggtaccggttacggggtttacgggggttaccggttaagggggtaaaccgtaaccggtttaaccgtttaacccggttacccttaccgtaacccgtaaaccttaaccgttaaccggaaccgtacccggtaaccggttacccggtaacggtacccggtttaaccgttaaagggtaaacttttttaaggtttaccgtaaaaccggttttaacgttttaaccgtttaaacgttcccggttaaacgtaccgtaaccgggtaccttacccggggttacgttaaaccccgggtttcggggtttaccgggaacggggttccgttaccgggtaacccgggtttccgggttaaacccggggggaaaccgtaaaaccggggtaaacttaaaacggggtaccgggttaaacccggttaaccgtaaaaccggggttctttaaccggggaccgttacgttaacccggttaaccaccgttacggtttaccggttacttttacccggtacccgttacccgttaccccgg

SEQ ID NO: 12628 - DNA, 731 bp, Homo sapiens
  misc_feature: GYAE6OF02G3QZR.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccagtggaagccccagctcagcttctcttcctcctgctactctggctcccagacaccaccggagaaattgtcgttgacacagtctccagccacgctgtctttgctccgagggaaancgcccgaccctcgtccctagcgagggcccaggtcagagtgttcgctacgttttccggtaaggggttgactcgaacataaatcccggaccaggcctccaggcctcctcgattccttttagacttcgcttttcgaaccacggggtccccctgggccgtccccgaaggtccgacggttccaggtcggctacggttcgggtcgtacggggtacctacggtacgttcctactccgtcccaaccgtacttccgaacgtccaccggtaccgtaagtacgaccgtagtaacgttcgtttagtccgttaaggttttacttaacgttcggttacctacggtaccgtacgtcggttaccgtcccgttacgggtttcccgggacggggttacggtttccgcccgttacggttttccgggagggtaaccggtaaaccgtaaacgttacgggtacgtaaccgaaaacggtaaccgtgggttaccggccggtacgtcccgtacctacgttcccgttacgtttccttacgtaccttaccccgg

SEQ ID NO: 12629 - DNA, 690 bp, Homo sapiens
  misc_feature: GYAE6OF02F5869.10.71.G05.1.454.CMB.1.raw
  modified_base (229)..(229): a, c, t, g, unknown or other
  misc_feature (229)..(229): n is a, c, g, or t
  modified_base (492)..(492): a, c, t, g, unknown or other
  misc_feature (492)..(492): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggcctcccagaccaccaccggagaaattgtgttgacacagtctccagccacgctgtcttgtctccgagggaaagcgccaccctctccgtgcacgggccngtcagagtgttcgctactttcggtagggtgtatcgaactaataaacttcccggaccaagggccttaccccgaggtccttcccgtactattcctttacggtagttcgtacttttaccgaaaccgtaccgggtacccccgtgggcccgtacccgacggtccgttaggttacaggtcggacgtacggttgggtcgagggtacagtacgttacgacgtctacacctatcgagacacgtaccaggacgtcctagtaacgttacgtttnacgttaatttacgtactacgttacaacgttacgttccgtacgtaggtccggcccggttacccgggtaccttacggtttcccggaccgtacgggtaacccgtaaaggtcgttaagaaccttacgaaacggtctcggtacggtcgtaccgaccgtacgtacgttcgttcgttaccgttctaccgtttccgtcccgtaccg

SEQ ID NO: 12630 - DNA, 819 bp, Homo sapiens
  misc_feature: GYAE6OF02IS60P.10.71.G05.1.454.CMB.1.raw
  modified_base (204)..(204): a, c, t, g, unknown or other
  misc_feature (204)..(204): n is a, c, g, or t
tcagcatagtagtgcacgaccggtgctcgatttagtgtcgtcgcaagagagaggggggaggaactgctcagttaggacccagagggaaccatggaagccccagctcagcttctcttcctcctgctactctggctccagacaccaccggagtaaattgtgttgacacagtcctccagccacgctgtctttgtctccgagggaacncgcccaccgtctcgtgcgacggcatcagagtcgttcgctacgttcgtaggtgtactacgaatagtaacgtccggaccgtaggcctacccgacggtcctactctatttcgtttaggacttgtacctttaccgaaaccggtccgggtacccccgttcgggtacccgttaaccccgacggggtaccgttaacgggtttccgaacggggttccgtcggtacggggttaccggggttacgtaccggggtaacgtaacctttaccggttaccgtacccttccctaccgtaccctaagttcccagggtccaaccggtaccgtaacggacccgtcgtaagggtaaccgtttacgtttcgtacgtttaaagtttaccttacggtcgttaacgaccggtaactcgggttaccctccgaccggtttacggttaccggggcggttaccggttaccgtacccgttacgggtttacccgggggaacgggtaaacccggttaaaacgttaaccgtacggggtaacctaaaccggtaaaacccgggtacggttacgggtaaccggtacccaacggtacccctaaccgtaacgttcccgttaccgtttacgttacccgtccgttaaccccgg

SEQ ID NO: 12631 - DNA, 737 bp, Homo sapiens
  misc_feature: GYAE6OF02IX28O.10.71.G05.1.454.CMB.1.raw
  modified_base (592)..(592): a, c, t, g, unknown or other
  misc_feature (592)..(592): n is a, c, g, or t
tcagcatagtagtgcacgaccggtgctcgatttagtgtcgtcgcaagagagaggggggagaactgctcagttaggacccagagggaaccatggaagccccagctcagcttctcttccctctgctactctggctccgagacaccacggagaaattgtgtgacactagtcctacagccacgcttcgtctttgtacctaccggaagggtaaacgcgccctaccctctacgtcgacgacgggccaagtcagtgttctcgctcgttaggtggtagtactacctaactataacgtccgaccgtaacgctaccccgacggtcctccgtactagttcctttagacgttacgtacgtttacgaaccggtaccggtccccgtcggtaccgtccgacggtccgtagggttaccacggttacgacggttacgggtcggtacgggttacgggacgtaacggtaacttaccgtaccgtaccgtaccgaccaagtaccgacgacgtcgtacccgtaggtaccgtacgtagtaacgttgtttacgaacttaggtttacctgttacgtcgtaacgcgtacggtccgtcgtaccgttcggttaccggggngtacggtacgtccgtttacccggtacgaacgggtaaacggtaaaccgaacggttaacggacgttaaaccgaacggtacgttaccggacgtccgtacgacccgttacggtacttacggttcccgtactttacccgcgttaaccccg

SEQ ID NO: 12632 - DNA, 1000 bp, Homo sapiens
  misc_feature: GYAE6OF02HLO5Y.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttggctgagtcttgggtttcctgttcgcttacgttttaagagtatgtacctagttcgtacgtaagtagtgacgaaggtagttgggtagggtacggttcggggtagggggggacgggtccgggttccgggggtccccgggtacccggggtttccgggggggggttacccccttagggtaaaccggttacccgtttcccgttccccgttttcggtttccgttcgggttcccggtttacggttacgggtttaacgttttccttaaagtttttaaccgtttttaaaaacggtttaaaacgtttccgggttacggttaaccttaaggtttacggggtttccccggttaccgggggttacccccggtaccggttaaccgggggtttccccgaaccgggggtaaccccggtacccgggggttaacggttaacgggggttaacgggtcgggggttacgggaacgttaaaggtaacttaacggtaaaaccgtaagtttaagttagtaaacgtaacgtaaaacgtaaaacgtttaaaattagttaaaccgttagggaaaccgttactaccgtttaaccgtacggaaccgggtacctacttaccaccttaactaccgtacgaagtaccgtaactaactaacgaaacttagtacggtagtagttaccacgttacaaacgaacgtaccgacggtacgtacgaggaaccggaacgtaccggtaggttaacgtacggtttttaacgttacggttacggagggttaacgggtaaacgttaacggtcgtaaagacggttacctcggtttaccttaggttagttacggttcggttaacggtcccgggttaaccgggtccggtaaccggggtacccgtttaccgggttaacccgttccggttcccgttaccggg

SEQ ID NO: 12633 - DNA, 832 bp, Homo sapiens
  misc_feature: GYAE6OF02I32PR.10.71.G05.1.454.CMB.1.raw
tcagcatagtagtgcacgaccggtgctcgatttagtgtcgtcgcaagagagaggggggcctccattcggtgatcagcactgaacacagaggactcaccatggagtttggctgagctgggttttcctcgttgctactttaagagatgtccagtcgtcagactgcagagtggtaggacgtcggtggggggacggtcggtcgggtccggccgtcggggggtccctaggacgtactctcctgtttcctggccgtacgtaggtattaccgtacttaccgtttaaaggtaaacttccgtacggtacctagttaccggttcccggtcggggttccccgccgtaacgggttccccaaccgggcccgtaacggggtccgtaacgggtaaagttcggggggttaacggcctaaagggtattaaacgtaaaccgtaaagtttaacggtcgtaaggtaccggtaaaccttaaaagttaaaaaagtacttaacgttaaaggtaccgggtaactaacccgtttaccttaacgggtaaacggacccgttaattacccaaacggtaccgttaccaacccggtaaacggtaccgaaaaccttaacttaacccgaaacgtaataacgttacgggtattaacgtctacgactaaagtccgaaactagtcctacggacgcggaccggtacgacggtagtttacgttaagtacgtgggtaacggtaagtaaaccttccggtaacggtacgaaccgttacctacgtaccgtttggttaaccggttcgtacgggaccggtttacccgggacggtaaccggttacccggtgttacccggtaccgttcgttacccgg

SEQ ID NO: 12634 - DNA, 628 bp, Homo sapiens
  misc_feature: GYAE6OF01BE8VT.10.5.A05.1.454.CMB.1.raw
  modified_base (250)..(250): a, c, t, g, unknown or other
  misc_feature (250)..(250): n is a, c, g, or t
  modified_base (580)..(580): a, c, t, g, unknown or other
  misc_feature (580)..(580): n is a, c, g, or t
tcagcatagtagtgcacgaccggtgctcgatttagatagatagacagggggagtctccctcactgcccagctgggatctcagggcttcattttctgtcctccactatcatggggtcaaccgccatcctcgccctcctcctggctgttctccaaggagtctgtgccgaggtgcagcgtggtgcgaggtcgggagcaggaggtaggaaaaagcccggggatctgtagaagatctcttgcacgggttcagganagagatttagcagcgactggctcggctggtgcgccagagtcggaccggggaaggccgtgggagtggagtggggatcgatacgaatcgttggtagctacgtagaaaaccagtaactaccaaccccgttccttacccggaaacgggtcccgggtacaacccgatccgtaccgaacgacccgaacgtacgggtacctatacgtacgtaaccttaaccgtacgttagggacgtagggtaacttaggccgtagaacggccctaggaaccaccgcctaagtagttacttaacgtgtaacgagttaaccgtaggaaccgggtattacgttaattagnggtcgcgtactcggtcggggaccacgggtaaccctgggcctaaccccg

SEQ ID NO: 12635 - DNA, 872 bp, Homo sapiens
  misc_feature: GYAE6OF01DBOKR.10.5.A05.1.454.CMB.1.raw
  modified_base (204)..(204): a, c, t, g, unknown or other
  misc_feature (204)..(204): n is a, c, g, or t
  modified_base (228)..(228): a, c, t, g, unknown or other
  misc_feature (228)..(228): n is a, c, g, or t
  modified_base (277)..(277): a, c, t, g, unknown or other
  misc_feature (277)..(277): n is a, c, g, or t
tcagcatagtagtgcacgaccggtgctcgatttagatagatagacgagggggagtctccctcactcgcccagcgtgggatctcgagggtcttctattttctcgtccctccactatcagtcggggtaccaaccgccactcctccgccctcctccgtggtcttcgttcctaccgaaggtacgtcgtggtcggccgtaggtcgacgngtcgttggcgcgtagggtcggganacgaggtaaggtaaagggaaaaccggccggggtatcgtaggagaacgtntcgttcgttcggacggttaccggtacggaaggacgtacgtaagttacgttacgcgtacgacggtacggtcggtccggtcggtacgttggtccggacgacgtacggtacggaccgggggtaaccgggcgtacggtagggttagggacgggtacgggtacgggtaactaccgtaacgttaccgtaaggttttcggtacggttaccgtaccgttaaaccgtaaaccggtaacctaacggtaaccccgtttaacccccgttaccccgggtaaccgttaaacccgggggtacccggtaccccggtaacctaacccgtaacgtccccggttaacccgggaacccggttaacccgtaccgggtaacccggtaacccgttaaccgttaaccccggttaaccgttaacccggttaaccggttaacgggtacgttacgggttaacgtacggtaacccgtacggtaaccgggacggtacccgtaacccgaccgtacctacggttacgtacgttacgtacggtacgtacggtacgtacggtacggtacgtagttcgtaagtggcgtacgcggacgtcggacggtacgacgtaccgtcgtaccgtccg

SEQ ID NO: 12636 - DNA, 623 bp, Homo sapiens
  misc_feature: GYAE6OF02GT88P.10.5.A05.1.454.CMB.1.raw
tcagcatagtagtgcacgaccggtgctcgatttagatagatagacagggggagtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtgaaaaagcccggggagtctgtgaagatctcttgcacgggttcaggagacagatttagcagcgactggctcggctggttgcgccagatggcccggggaagccgtggagtggagtggggatcgatcgaatccgttgggtacgctcgtacgaaaccaggtaactaacccgacccccgttccttacccgaaacgggtcccggggtaccaacccgtactacctaccgacgcccgaaccgtacgggtacccacgtaccgacgttaacctacccgttacgttgggaagttggtacttacgcctaggaacggtcctacggaccacccgccattcgttacttacgtgtacgacgtacgttaggacgggtattacgtaattagtcggcgtacgagttcgtcggggaccctacggggtacccttggtcccgtacccg

SEQ ID NO: 12637 - DNA, 680 bp, Homo sapiens
  misc_feature: GYAE6OF02HJ8FT.10.5.A05.1.454.CMB.1.raw
tcagcatagtagtgcacgaccggtgctcgatttagatagatagacagggggagtctccctcactgcccagctgggatctcagggcttcattttctgtcctccactatcatggggtcaaccgccatcctcgccctcctcctggctgttctccaaggagtctgtgccgaggtgcagctggtgcagtcgggagcagaggtagaaaaagcccggggagtctgtgaagatctcttgcacgggttcaggagacagatttagcagcgactggctcggcgtggttgcgccagagtcggcccggggaagccgtgggagtggagtggggatcgaatcaattcgttaggtagctctagaaaccagaactacccaccccgttccttaccgaacgggtcccgggtacacccgtattccgtacgacgacccgacgaacgggtccctaacgtcgtaacgttaccttaaccgttacgtttagggaacgttcgggttaacttaacggtcccgttagggaaacggtcccggtacggaacccgacccgaccgtaagttcggttaactttaccgtacggttaacgaacgttaacgttacgggaacgggttactttacgtttaaggttacgtcggtccggtacgtacgttccggtacggggaccgaacggggtaccccgttagggtaccccgtaaccccgg

SEQ ID NO: 12638 - DNA, 754 bp, Homo sapiens
  misc_feature: GYAE6OF02FS8NP.10.5.A05.1.454.CMB.1.raw
  modified_base (190)..(190): a, c, t, g, unknown or other
  misc_feature (190)..(190): n is a, c, g, or t
tcagcatagtagtgcacgaccggtgctcgatttagatagatagacagggggagtctccctcactgcccagctgggatctcagggcttcattttctgtcctccactatcatgggtcaaccgccatcctcgccctcctcctggctgttctccaaggagtctgtgccgaggtgcagctggtgcaggtcgggancgagaggtagaaaaacggccggggatctggtagaagactctcgttagcgtaccgggttacagggaacgacgtagtatttagcgagcgacgtcggctcggcgttggtcgccgcgagtacgtcgggaccccggggaaggcccgtagggtacggtacgggtaggtggggtaactgtacctacgtaaacgttcgttgggtacgtcttaccgtaacgaaacccgtagtaaccgtacccgtaacccccgttccttaaacccggggaacgggtcccccgggttaaccgaccctaacgttcccgacggtacccggaccggtacccggtaaccggttaccgaacttaccggtaaaccgtaccttaaacccgttacggttagggtaacgttacgggttaacgttaaccggtccgttagggtaaccggtaccggtacccggaacccgacccgtaccgtattacggttacgttaacgttacgaacgtacgtagttccgggtagttcgttacgtacttacggcggtcgtagtacgtcgggtacggtaccgggaccgtaccgttcgggacctccccgg

SEQ ID NO: 12639 - DNA, 210 bp, Homo sapiens
  misc_feature: GYAE6OF01BOYJG.49.83.H06.1.454.CMB.1.raw
  modified_base (210)..(210): a, c, t, g, unknown or other
  misc_feature (210)..(210): n is a, c, g, or t
tcagagtcgagagacacgaccggtgctcgatttagatcacgtgcgtcgcgggcacgaccggtgctcgatttagagagagtgtgttgggtttggggaagaggaagactgacggtcccccaggagttcaggtgctgggcacagcggccctgggctgcctggtcaaggactacttcctctctcgactctgagcgggctggcaaggcgcatagn

SEQ ID NO: 12640 - DNA, 192 bp, Homo sapiens
  misc_feature: GYAE6OF01DRU6Y.49.83.H06.1.454.CMB.1.raw
  modified_base (191)..(192): a, c, t, g, unknown or other
  misc_feature (191)..(192): n is a, c, g, or t
tcagagtcgagagacacgaccggtgctcgatttagatcacgtgcgtcgcgggctcgatttagatcacgtgcgtcgcgggcacgaccggtgctcgatttagtcacgcgagaaaggaaaggggctggccctgacgtgtttctgttcccgccctcctctctctcgactctgagcgggctggcaaggcgcatagnn

SEQ ID NO: 12641 - DNA, 192 bp, Homo sapiens
  misc_feature: GYAE6OF01A7NOE.49.83.H06.1.454.CMB.1.raw
  modified_base (187)..(192): a, c, t, g, unknown or other
  misc_feature (187)..(192): n is a, c, g, or t
tcagagtcgagagacacgaccggtgctcgatttagatcacgtgcgtcgcgggctcgatttagatcacgtgcgtcgcggcacgaccggtgctcgatttagtcacgcgagaaaggaaggggctggccctgacgtgtttctgttcccacctcctctctctcgactctgagcggctggcaaggcgcatagnnnnnn

SEQ ID NO: 12642 - DNA, 214 bp, Homo sapiens
  misc_feature: GYAE6OF02I5QTA.49.83.H06.1.454.CMB.1.raw
  modified_base (211)..(214): a, c, t, g, unknown or other
  misc_feature (211)..(214): n is a, c, g, or t
tcagagtcgagagacacgaccggtgctcgatttagatcacgtgcgtcgcgggcacgaccggtgctcgatttagagagagtgtgttgggtttgggggaagaggaagactgacggtcccccaggagttcaggtgctgggcacagcggccctgggctgcctggtcaaggactacttcctctctcgactctgagcgggctggcaaggcgcatagnnnn

SEQ ID NO: 12643 - DNA, 533 bp, Homo sapiens
  misc_feature: GYAE6OF01DC6OX.2.72.G06.1.454.CMB.1.raw
  modified_base (412)..(412): a, c, t, g, unknown or other
  misc_feature (412)..(412): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcaagaaaccagggaaagcccctaaaactcctgatctatgttacatccagtttgcaaagtgggtcccatcaaggttcagtggcagtggatcgtgggacagatttcactctacaccatcagcagtctgacaactgaatattttgactaactttactactntacaacagtaagttaccacgttaccccctgggaccgtttacgggaccgaaacgggaaccaaagggtacggaaaatacgaaaacgaacgtaggtggactgactaccaatctgttcttcgtac

SEQ ID NO: 12644 - DNA, 543 bp, Homo sapiens
  misc_feature: GYAE6OF01DIY1A.2.72.G06.1.454.CMB.1.raw
  modified_base (217)..(217): a, c, t, g, unknown or other
  misc_feature (217)..(217): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggnaagtcagagcattagcagctatttaaattggtatcagcagaaaccagggaaagcccctaaactcctgatctatgttacatccagtttgcaaaagtggggtacccatcaaggttcagtggcagtggatcgtgggacagtatttcactctcaccatcagcagtctgacaacctgaagtattttgactaactttactacttagtacaactagaagttacacgttaccccctaggaccgtttacggaccgaaagggaccgaaagggtaggaaaactacgaaaaccgtaactaggtcggacgtagacctaaccattcctgttcttcgtaac

SEQ ID NO: 12645 - DNA, 497 bp, Homo sapiens
  misc_feature: GYAE6OF01EAEQN.2.72.G06.1.454.CMB.1.raw
  modified_base (487)..(487): a, c, t, g, unknown or other
  misc_feature (487)..(487): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcagaaaccaggaaagcccctaaatcctgatctatgttacatccagtttgcaaagtgggtccatcaaggttcagtgcagtgatctgggacagattcactctcaccatcagcagtctgcaactgaagtattttgactaacttactactgtacaacagattacacgtacccctggtaccgttcgaccaaggaccaaggtacgaaactacgaaacgtaactaggtcgactgacacatntcgtctctac

SEQ ID NO: 12646 - DNA, 534 bp, Homo sapiens
  misc_feature: GYAE6OF01EGQR1.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaaccagggaaacgcccctaaactcctgatctatgttacatccagtttgacaaagtgggtccatcaaggttcagtgcagtgatctggacagatttcactctcaccatcagcagtctgcaacctgaagtattttagaacttaacttactactactacaagaagtactacgtacccgtacccgtacggtacgtaccgacgaacggtaacgtaacggtaacgtaacgtaacgaaacgtagtaggtcgtacgtcgacctactacttactcttctctaccg

SEQ ID NO: 12647 - DNA, 601 bp, Homo sapiens
  misc_feature: GYAE6OF01BMEAY.2.72.G06.1.454.CMB.1.raw
  modified_base (589)..(589): a, c, t, g, unknown or other
  misc_feature (589)..(589): n is a, c, g, or t
  modified_base (595)..(595): a, c, t, g, unknown or other
  misc_feature (595)..(595): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttggccgggcaagtcagagcattagcagacttaatttaattggtatcagcaagaaaccgagggaaaccgacccctaaaactccgtagattacgtattacgttacactcctagtttcgacgtaaaggtcgggtacccaagttcgtaaggttcgaggttggactaggtggactcgtagggactagtactttcgactcgtacacctatcacgtactagtctacgacctaaccgttagaagtattttacgacctaacttactactacgtacaacgtcgtaacttacgaccgtaccccgtaggtaccggttccgacgaacgggtacaacgggtagtaacgtacgtaaacgtacgtaggtcggtcgtacaccgtaactcgttacgtnttcctntacccg

SEQ ID NO: 12648 - DNA, 682 bp, Homo sapiens
  misc_feature: GYAE6OF01C2EB9.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagcttatttaaattggtatcagcaagaaaccgaggaaacgacccctaaactcctagatctatgttacatcctagtttgacgtaaaggtggggtaccctagtacgtaaggtttccaaggttcggacgtaggttagggaacgttcggtacggggtactaaggttaacttttccaaccttaccttaccaaccgtaacttaccaagtacctaagttccgttacgacctaaacccgttaggtaaacgttagtttttacgaacctaaactttaaccgttaaccttaggttaccaaacgtacgtaacgtttaaccgaaccgttaacccccgtagggtaaccgtttaccgggaccgaaacgggaacctaaacgggtaacggtaaaactaccgaaacggtaacgtcggtacggaccgtacgaccgtaacctacttacgttacgttcttccttaacccg

SEQ ID NO: 12649 - DNA, 496 bp, Homo sapiens
  misc_feature: GYAE6OF01A4S57.2.72.G06.1.454.CMB.1.raw
  modified_base (493)..(493): a, c, t, g, unknown or other
  misc_feature (493)..(493): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaactcctgatctatgttacatccagtttgcaaagtgggtcccatcaaggttcagtggcagtggatctgggacagatttcactctcaccatcagcagtctgcaacctgaagtattttgctaacttactactgtacaacagacgttacacgtacccctggtacgttcggaccaaggaccaaggtaggaaatcgaaacgatggtgctgcacatctgtctntac

SEQ ID NO: 12650 - DNA, 562 bp, Homo sapiens
  misc_feature: GYAE6OF01CY50X.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccggcaagtcagagcattagcagctattaaattggtatcagcaagaaaccagggaaacgcccctaaactcctgatctatgttacatccagtttgactaaaggtcggggtcccatccaaggttcagtggcagtggatcgtgggactagatttcactctcaccatcagcagtctgctaacctgaatattttgactaactttactactgtacaacgaagtacttaacgacgttaccccctggtaccggttaccggaccgtaaacggggaaccctaagggtacggtaaacgtacgtaaaaccggtaactcggtacggccttaggcctaaccgacttcgttcgtccttctaacccg

SEQ ID NO: 12651 - DNA, 528 bp, Homo sapiens
  misc_feature: GYAE6OF01CFONX.2.72.G06.1.454.CMB.1.raw
  modified_base (518)..(518): a, c, t, g, unknown or other
  misc_feature (518)..(518): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcagaaaccagggaaacgcccctaaaactcctagatctatgttacatccagtttgcaaagtgggtccatcaaggtcagtggcagtgatctgggacagtatttcactctcaccatcagcagtctagctaacctgaagtatttgactaacttactaactgtacaacagtagttaccacgttaccccgtaggtaccgttaccggacgaacgggaccgtaaaggtacggaaatacgaaaacggaacttacggtggctagcgaccatcttntcgttctacg

SEQ ID NO: 12652 - DNA, 515 bp, Homo sapiens
  misc_feature: GYAE6OF01E0WCM.2.72.G06.1.454.CMB.1.raw
  modified_base (277)..(277): a, c, t, g, unknown or other
  misc_feature (277)..(277): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctattaatgtatcagcagaaaccagggaaacgcccctaaacncctagatctatgtacatccagtttgcaaagtgggtcccatcaaggttcagtggcagtgatcgtgggactagatttcactcacacatcagcagtctgacaactgaagtatttgacctaactttactactgtacaactgaacgttacacgttacccctaggtaccgttcggaccgtaagggaccgaaggtagaaactacgaaacgtaatggtcgctgacctacatcttcgtcttcgtacc

SEQ ID NO: 12653 - DNA, 608 bp, Homo sapiens
  misc_feature: GYAE6OF01AJZQF.2.72.G06.1.454.CMB.1.raw
  modified_base (272)..(272): a, c, t, g, unknown or other
  misc_feature (272)..(272): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagcttaatttaatggtatcagcaagaaaccagggaaacncccctaaactcctagatctatgttacatcctagtttgactaaaggtcgggtacccatcgaaggttcaggtggcaggtggatcgtgggacagtatttcactctcaccatcagctagtctgactaaccgtagaacgtattttacgaccttaactttaccttaacgttacgtacctaaacgtaacgtaacgtttaacccgaaccggttacccccgtagggtaaccgttaccgggaccgtaacgggtaaccgtaagggtacggtaaaacgtaccgaaaacggtaacgtacgggtacggaccgtacgacctaacctacttaccgttcgttccttctacccg

SEQ ID NO: 12654 - DNA, 564 bp, Homo sapiens
  misc_feature: GYAE6OF01A33TS.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaacgcccctaaaactcctagatctatgttacatccagtttgacaaagtgggtcccatcaaggttcagtggcagtggatcgtgggacagtatttcactctcaccatcagcagtctgacaacctagaagtatttgactaacttactactagtacaactacgtaagttaccaccgtacccccgttagggtaccgtttaccgggaccgaaacggggtaccaaacgggtaggtaaaacgtaaccgaaacggtaacttacgggtcggacctagcctaacctactaccttcgttcttcctaccg

SEQ ID NO: 12655 - DNA, 553 bp, Homo sapiens
  misc_feature: GYAE6OF01BU2YH.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcagaaaccagggaaagcccctaaactcctgatctatgttacatccagtttgactaaagtcgggtcccatcaaggttcagtggcagtggatcgtgggacagtatttcactctcacatcagcagtctagcaacctgaagtatttgactaacttactactgtacaactagtaacgttacacgttaccccctaggtaccgttcggacccgtaagggacctaaagggtacggaaaacgtaccgaaaaacggtaacgtacggtcggactcggacctaccctattccgtcgttaccttcgtaacccg

SEQ ID NO: 12656 - DNA, 527 bp, Homo sapiens
  misc_feature: GYAE6OF01E063X.2.72.G06.1.454.CMB.1.raw
  modified_base (272)..(272): a, c, t, g, unknown or other
  misc_feature (272)..(272): n is a, c, g, or t
  modified_base (523)..(523): a, c, t, g, unknown or other
  misc_feature (523)..(523): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcaagaaaaccagggaaancccctaaaatcctgatctatgttacatcctagtttgcaaagtggggtcccatcaaggttcagtggcagtggatctgggacagatttcactctcaccatcagcagtctgacaacctgaagtattttacgactaacctttactactcgtacaactagacttaacacgttaccccctggtacgttcggacccgaagggaaccgtaaggtaggaaatcgaaaacgaactggtggactgccaccatctgttccttntacc

SEQ ID NO: 12657 - DNA, 497 bp, Homo sapiens
  misc_feature: GYAE6OF01EXE48.2.72.G06.1.454.CMB.1.raw
  modified_base (487)..(487): a, c, t, g, unknown or other
  misc_feature (487)..(487): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcaagaaaccagggaaagcccctaaatcctgatctatgtacatccagtttgacaaagtgggtcccatcaaggttcagtggcagtggatcgtgggacagtattcactctcacatcagcagtctgacaactgaagtattttgactaacttactactgtacaacagtattacacgtacccctggacgttcggacaacgggaccaaggtagaaatacgaaacgatgtgactgacacatntcgtctctac

SEQ ID NO: 12658 - DNA, 577 bp, Homo sapiens
  misc_feature: GYAE6OF01DETRK.2.72.G06.1.454.CMB.1.raw
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
  modified_base (378)..(378): a, c, t, g, unknown or other
  misc_feature (378)..(378): n is a, c, g, or t
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagacttatttaaattggtatcagcaagaaaccgagggaacnccctaaactcctgatctatgttacatcctagtttnactaaggtcgggtaccatacaaggttcagtcggacaggtggatcgtgggactagtatttacacttacncaccatcagcagttctcgacaaccttgaagtatttcgactaacttactactgtacaacgagtacgttacaccgttacccctagggtacccgttacggaccgaaccgggtaaccgtaagggtacggtaaaacttaccgaaaaccggtacgttaggtcggactcgaaccgtaccctaagttccttcgttctttcgtaaccg

SEQ ID NO: 12659 - DNA, 542 bp, Homo sapiens
  misc_feature: GYAE6OF01D7S2V.2.72.G06.1.454.CMB.1.raw
  modified_base (218)..(218): a, c, t, g, unknown or other
  misc_feature (218)..(218): n is a, c, g, or t
  modified_base (249)..(249): a, c, t, g, unknown or other
  misc_feature (249)..(249): n is a, c, g, or t
  modified_base (266)..(266): a, c, t, g, unknown or other
  misc_feature (266)..(266): n is a, c, g, or t
  modified_base (538)..(538): a, c, t, g, unknown or other
  misc_feature (538)..(538): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaaggagacagagtcaccatcacttgccgggnaagtcagagcattagcagctattaatgtatnagcagaaccaggaaacnccctaaactctgatctatgttacatacctagtttagactaaagtgggtacccatacgaaggttcagtggacagtggatcgtagggacagtactttcactctacacctatcagactagtctagacaaccgtagaacgttattttacgactaacgtttacctaacgttacgtacaacgtagtaacgttaccgaacgttacccccgtaggtaccgttacgaccgtaacggacgaagtacgaaatacgaaacgatgtgctagctacatactgtctntacc

SEQ ID NO: 12660 - DNA, 509 bp, Homo sapiens
  misc_feature: GYAE6OF01EL2PM.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcagaaaccagggaaagcccctaaaatcctgatctatgttacatccagtttgcaaagtggggtcccatcaaggttcagtggcagtggatctgggacagatttcactctcacatcagcagtctgcaacctgaatattttgacaacttactactgtcaacagaagttacagtacccccgtggaccgttcggaccaacgggacaaggtggaaaataccgaaaacgaactagtcggcttagcaccatactcgtcgttctac

SEQ ID NO: 12661 - DNA, 603 bp, Homo sapiens
  misc_feature: GYAE6OF01EVHNR.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgtcgggcaagtcagagcattagcagctatttaaattgtatcagcaagaaaccagggaaacgcccctaaactcctagactctattgttacatccagtttgctaaagtgggtcccatcgaaggttcagtggcagtggatctgggacagtattcactctcacctatcagcagtctgacaacctagaatattttgactaactttactacttagtacaacgtaacgtacgttaaccgaccgttaacccccgtagggtaacccggtttacgggaccccgtaaaggggtaacccgtaaacggggtacggtaaaacgttaaccgaaaaaccgtaacgtagggttacggtaccgttacggaccctaaccctaacgttaccttacggttccttcgttaacccg

SEQ ID NO: 12662 - DNA, 629 bp, Homo sapiens
  misc_feature: GYAE6OF01A77D5.2.72.G06.1.454.CMB.1.raw
  modified_base (312)..(312): a, c, t, g, unknown or other
  misc_feature (312)..(312): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaccatcacttggccgggcaagtcagagcattagcagctatttaaatggtatcagcaagaaaccagggaaacgcccctaaaactcctagactctatgttacatcctagtttnacgaaagtgggtcccatcaaggttcagtgcagtgatcgtgggacagtatttcactctacaccatcagcagtctgacaacctgaagtattttacgactaactttactacttacgtactaactacgtaacgttacctaacggttaccccccgtagggtacccggtttaccggaacccgtaaacggggaacccgtaaaacggggttacgggaaaaacgttaacccggtaaaaaccggtaaccgttacgggttaccggtaccggttacgaaccgtaacccgtatttacccgttcgtttacccgttaccgttttaacccccg

SEQ ID NO: 12663 - DNA, 536 bp, Homo sapiens
  misc_feature: GYAE6OF01B7YNA.2.72.G06.1.454.CMB.1.raw
  modified_base (429)..(429): a, c, t, g, unknown or other
  misc_feature (429)..(429): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagacaagaaaccgagggaaacgcccctaagcctcctgatctatgctgcatcctagtttaacaaaggtcgggtacccagtcgaaggttcaggtggcaggtgatcgtgggactagtattcactctaccacatacagtactctaactaactagtaagtatttacgactaacttactactntacaactagtacgttacgacctacccctccgtctcgtacgttcggacggacgggtacgaagggtgagtatacgaaacgtacgtgtacgtctacgacactgtcgtacg

SEQ ID NO: 12664 - DNA, 602 bp, Homo sapiens
  misc_feature: GYAE6OF01B4I3U.2.72.G06.1.454.CMB.1.raw
  modified_base (224)..(224): a, c, t, g, unknown or other
  misc_feature (224)..(224): n is a, c, g, or t
  modified_base (272)..(272): a, c, t, g, unknown or other
  misc_feature (272)..(272): n is a, c, g, or t
  modified_base (352)..(352): a, c, t, g, unknown or other
  misc_feature (352)..(352): n is a, c, g, or t
  modified_base (403)..(403): a, c, t, g, unknown or other
  misc_feature (403)..(403): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccggcaagtcagngcattagcagcttatttaaattggtatcagcaagaaaccagggaaacncccctaaatcctagatctatgttacatccagtttgactaaaggtcgggtacccatcgaaggttcagtggcagtggatcgngggacagtattcactctacaccatcagctacgtctagacaactgaacgttnttttcgaacttaaccttactaactacgtacaacgtaagtaacgttaacacgttaacccccgtaggttacccgttaccggaaccgaaacgggtaaccgtaaagggttacgaaaacgttaaccgaaaacggtaacgttacgggtacggtacctacggaaccctaacccgtacttaaccgttcggttccttaccgtaacccg

SEQ ID NO: 12665 - DNA, 623 bp, Homo sapiens
  misc_feature: GYAE6OF01D8G60.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtccaccatccacttcggccgggacaagtcaaggagctagttagcaggtacttaatttaaagttggtatcagacaacgaaaccgaagggaaaccgtacccctaaactcctagtactactatagttacatccgtagtttagacgtaaaggtcggggtacctatacgtaaggttctaggtggacgtagtaggatcgtagggactagttacttcacttctacaccgattacagactagtctgacctaacgtagaacgttatttacgacttaaacttacttacgtacgtacaagtacgtaacgttaaccaccggttacccccgtaggtaccggttcggaccgtaaacgggaccgtaaggtacgaaagtaccgaaaacgtacgtacggtcgacgtacgacccgtacctactattcgttccttcgtaacccg

SEQ ID NO: 12666 - DNA, 511 bp, Homo sapiens
  misc_feature: GYAE6OF01A3HNB.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcaagaaaccagggaaacgcccctaaactcctgatctatgttacatccagtttgacaaagtgggtcccatcaaggttcagtggcagtggatctgggacagatttcactctcacatcagcagtctgacaactgaagtattttagactaacttactactgtacaacagtagttacacgttaccccgtggaccgttcggaccgaacgggacaaggtagaaactacgaaacgactaggtcgactgacacatcctgtcttctac

SEQ ID NO: 12667 - DNA, 587 bp, Homo sapiens
  misc_feature: GYAE6OF01BN9BG.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaaccatcacttcggccgggacaagtcagagctattagcagtacttaattttaaattggtatcagacaagaaaccgaagggaaacgcccctaaactcctagatactatcgttacacttaccagttttgacgtaaacggtcgggtacccagtacgtaaggttcaggtggacgaggtggtattcggagggtacagttattacactcgtacacctatcagcagtctgacaacgtgtaattacgtttgactaacttacgtactacgtacaactagtagttaccgacgtaccccgtaggtaccgtacggaccgtaacgggtaccgaaggtacgaaacgtacgaaacggtactaggtcgacgtacgacctactattccgtcttcgtccttacg

SEQ ID NO: 12668 - DNA, 555 bp, Homo sapiens
  misc_feature: GYAE6OF01EG0KP.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaccatcacttgccgggcaaagtcagagcaattagcagctatttaaattggtatcagcaagaaaccagggaaagcccctaaaactcctgatcctatgttacatccagtttgcaaagtggggtaccatcaaggttcaagtggcagtggatcgtggacagatttcactctcaccatacagcagtctagacactagaagtattttagctaacttacctaactgtacaaacaagtaacgttaacgaccgttaaccccgtggtaccgtttcggaccgtaaagggacccaaagggtacggaaatacgaaaacgaaagtacggtacggctagaccacctaactaccttgttccttcgtaacc

SEQ ID NO: 12669 - DNA, 713 bp, Homo sapiens
  misc_feature: GYAE6OF01DM0AT.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtcgccagatgtgacatcctgatcgacccagtcctccactccctccctgtctagctattcgtagtaggagacagacgtcaccatcctacgttcggaccgggactaagtccgaggacgctagttacgacctagtactttaatttaaagttggtaactacgacgacgaaacggaaaccgaacgggaaacctacccctaaactcctagtacttacgtagttacgttactaccgtaccgttagtttacgaacgtaaacggtccgggtaccctaagtacgtaaacggttcgaggtcggcgtaggtggactggtacggaactacggttactttaccactcgtaccaccgtattacgacgtactacgtaccgtacggaacctaacgtagtaacgtttacttaccgaccttaaacgttactaacgtagtacctaaacggtacgttaacgtacccgtacccgttacccgtagggtacccgttacggaccgtaaacgggaactaagggtaacctaaacgtaaccgtaaacggtacgttagtccggtactaccgtacctacgttactaccgttccgttaactcccgttaccg

SEQ ID NO: 12670 - DNA, 512 bp, Homo sapiens
  misc_feature: GYAE6OF01C15NO.2.72.G06.1.454.CMB.1.raw
  modified_base (506)..(506): a, c, t, g, unknown or other
  misc_feature (506)..(506): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctattaaattggtatcagcagaaaccaggaaagcccctaaactcctgatctatgttacatccagtttgcaaagtggggtcccatcaaggttcagtggcagtggatctgggacagatttcactctcaccatcagcagtctgcaacctgaagtattttagctaacgtttactactgtacaactagagttacgactacccctcgcttcactttcggcggtaacggaccgaaggtggaagatacgaaaacgaactggtacgcgttacgccaaccntcttcg

SEQ ID NO: 12671 - DNA, 507 bp, Homo sapiens
  misc_feature: GYAE6OF01ESW5G.2.72.G06.1.454.CMB.1.raw
  modified_base (500)..(500): a, c, t, g, unknown or other
  misc_feature (500)..(500): n is a, c, g, or t
  modified_base (504)..(504): a, c, t, g, unknown or other
  misc_feature (504)..(504): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaactcctgatctatgttacatccagtttgcaaagtggggtcccatcaaggttcagtggcagtggatctgggacagatttcactctcaccatcagcagtctgacaacctgaagtattttgactaacttactactgtcaacagtaagttacacgtaccccctggtaccgttcggaccgaagggaccgaaggtagaaatacgaaacgatggtggactgcacatactntctntac

SEQ ID NO: 12672 - DNA, 581 bp, Homo sapiens
  misc_feature: GYAE6OF01DDZ83.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctattaaattggtatcagcagaaaccagggaaacgcccctaaaactcctagatctatgttacatccagtttgactaaagtggggtcccatacaaggttcagtggcagtggaatctgggactagatttcgactctacaccatcaagcagtctgactaaacctgaacgtattttcgactaactttactaactgtacaacaagtacgttaactaacgtaccccgtaggtaccgttaccggacccgaaagggaacccgtaaagggtacggtaaagtaccgaaaaacggtaaactggttaggaccgttacggacctaacctaaattcccttacgtccgtttccgtaacccg

SEQ ID NO: 12673 - DNA, 572 bp, Homo sapiens
  misc_feature: GYAE6OF01CXFQ4.2.72.G06.1.454.CMB.1.raw
  modified_base (217)..(217): a, c, t, g, unknown or other
  misc_feature (217)..(217): n is a, c, g, or t
  modified_base (273)..(273): a, c, t, g, unknown or other
  misc_feature (273)..(273): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggnaagtcagagcattagcagctaatttaaattggtatcagcagaaaaccagggaaacncccctaaaactcctgatctatgttacatcctagtttgacaaaggtcgggtacccatcaaggttcagtggcagtggatcgtgggacagtattcactctcaccatcagcagtctgcaacctgtaagtattttgactaacttactactgtacaactagtaacgttactaccgttaccccgtggtaccgttaccggaccgaaaggggacctaaagggtacggaaaacgttacgaaaaccggtaacgttacggtcggaccgtacggacctaaccctacttacgttcggttcctttcgtaacccg

SEQ ID NO: 12674 - DNA, 629 bp, Homo sapiens
  misc_feature: GYAE6OF01CAXNE.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagcttaatttaaattggtatcagcaacgaaaccgagggaaacgtcccctaaaactcctgatctattgttacatcctagtttacgacgtaaacggttcgggtacccagtaccgtaaggttcaggtggacgtaggtggtatcggtagggactagtagtttcactccgtcactatccagctagtctacgacaaccgtagaagttacttttagaccttaacgttactaacgtactacgaactagtaacgttaaccgaccggtttacccccgtagggttaccgttaccgggaccgtaaacgggtaacccgaaagggttacggaaaactaccgtaaaaccggtacgttacggtccggaaccgtgacccgtaacgtacttacgttaccgttcttacctacccg

SEQ ID NO: 12675 - DNA, 819 bp, Homo sapiens
  misc_feature: GYAE6OF01BEQ7O.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaccatcacttggccgggcaagtcagagcattagcagacttaatttaaattggtatcagcaacgaaaccgaaggaaacgacccctaaactcctagatactagtgttactataccgtagtttagacgtaaacggttcggggtaccccaagttaccgtaaaggtttccgtaaggttcggtacgtaagggtcgggtaacgttcggttaggggaactaaggttaacttttaccgtaaccttccgtaacctaccgtacttaccgaacgtacctacggttacccttaccggaaccttaaacccgttagtaaacggtttaaccttttttacggaaacccctttaaaaccttttaacccgttaaccgtttacgtaaacccgttaaaaccggtaacgtttaaaccggtttaaaccccgtaccccgggtttaaacccccccgttacggggttaaccccgtttacccgggggaacccggttaaaaccggggggaaccccgttaaaacggggttaaaccgggtaaaaaccttaaccggtaaaaaccggtaaccgttacggggttacgacccgttacggaaccctaacccgttacgttacccgtttacggtttcccgtttacccttaacccg

SEQ ID NO: 12676 - DNA, 592 bp, Homo sapiens
  misc_feature: GYAE6OF01AKL3A.2.72.G06.1.454.CMB.1.raw
  modified_base (271)..(271): a, c, t, g, unknown or other
  misc_feature (271)..(271): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaacncccctaaatcctgatctatgttacatccagttgctaaagtgggtcccatcaaggttcagtgcagtgatgtggactagatttcactctacaccatcagcagtctcgactaacctgaacgtattttacgacctaactttactaactacgtactaactagtaacgttaacgtacgttacccccgtaggtaccgttaccggaccgtaaaccggggaaccgtaaacgggttacggtaaaaccgtaaccgtaaaacggtaaccgttaggttccgggaccttacggaccctaaaccgtacttaccgtcgttcccgttccgttaacccg

SEQ ID NO: 12677 - DNA, 532 bp, Homo sapiens
  misc_feature: GYAE6OF01DJSM4.2.72.G06.1.454.CMB.1.raw
  modified_base (415)..(415): a, c, t, g, unknown or other
  misc_feature (415)..(415): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccggcaagtcagagcattagcagctattaaattggtatcagcagaaaccaggaaagcccctaaactcctagatctatgttacatccagtttgacaaagtgggtcccatcaaggttcagtgcagtggatctgggacagatttcgactctcaccatcagcatctgacaactgaagtattttagactaacttactactgtacaacanagttaccacgttacccctggtacgttcggaccgtaagggaaccctaagggtacgaaataccgtaaaacgtaactacggtaggacctcgacgtaccacttcttacgtccttctacccg

SEQ ID NO: 12678 - DNA, 638 bp, Homo sapiens
  misc_feature: GYAE6OF01BQK3Q.2.72.G06.1.454.CMB.1.raw
  modified_base (271)..(271): a, c, t, g, unknown or other
  misc_feature (271)..(271): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagcttatttaaatggtatcagcaagaaaccagggaacncccctaaactcctgatctatgttacatcctagtttgactaaaggtcgggtacccagtcaaggttcagtggacagtggatcgtgggacagtatttcactctacaccatctagctagtcctgacctaaccgtaggtaacgttattttacgacttaaaccgtttaccttaacgtttcgtaacctaacgtaggtaacgtttaacctaacccggttaaccccccgttagggtaaccccggtttacgggaaccccgtaaacggggtaacccgtaaagggttaacggtaaaaccgtaaccgtaaaaacggtaccgttagggtacgggacgttacgacccgtaaccgtacttaccgttcgttccgttcgtacccg

SEQ ID NO: 12679 - DNA, 753 bp, Homo sapiens
  misc_feature: GYAE6OF01DEL90.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagctattagcagacttaatttaattggtatcagcaagaaacgaaggaacgacccctaaatcctagactctatgttacatcctagtttcgactaaacggtcgggtaccctagtacgtaacgggtttcaaggtcggacgtaggtacgggtaactcggtaggggtacctagtaacttttcgaacgttcctacaaccctataccaacgtcgaacgttctacggtaaccctaaaccgtagtaacgttacttttacggaaccttaacctttaaccgttactacgttaacctaaacgtaacggttaacggtttaccctaaccggtttaccccccggtaggggttaacccgtttaccgggacccggtaaaacgggggtaaccccgttaaacgggggtaaacgggttaaaaaccgtaaacccgggtaaaaaacccggtaaccgggtttacggttaacccggggtaccgtttacgggaacccgtaaacccttaacggtttacccttttaccgggttacccttttaccccgttaaacccg

SEQ ID NO: 12680 - DNA, 679 bp, Homo sapiens
  misc_feature: GYAE6OF01B3IW9.2.72.G06.1.454.CMB.1.raw
  modified_base (220)..(220): a, c, t, g, unknown or other
  misc_feature (220)..(220): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacgttcggccgganaagtcagagcattagcagacttaatttaaattggtatcagacaacgaaaccgaagggaaacgacccctaaactcctagactctatgttaacactaccagtttagacgtaaaggtcgggtacccagtacgtaaggttcaggtggcgtagtggatcgtaggacagtacttacacttcaccaacctactacgagctaagttctacgaacctaaaccgttaggtaaacgtttacgttttacgaaccttaaaccgtttaacctacgttacgtaacctaaacgtaaggttaaccgttaaccgtaacccggttaaccccccgttagggtacccggtttacccgggaccggaaaacggggtaacccggtaaacgggtacggtaaaacgtaaccgaaaacggtaaccggttaggtaccggtacgtacggacctaaccgtacgttaccgttcgttaccttacgtacccg

SEQ ID NO: 12681 - DNA, 576 bp, Homo sapiens
  misc_feature: GYAE6OF01ETQMW.2.72.G06.1.454.CMB.1.raw
  modified_base (236)..(236): a, c, t, g, unknown or other
  misc_feature (236)..(236): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggacaagtcagagactattagnagtcttaatttaaattggtatcagacaagaaaccgagggaaaccgacccctaaactcctagtactctattgttaactatacctagtttacgacgtaaaggtcgggtacccatacgtaaaggttcaggtggacaggtcggatcgtaggggaacagtatttcgacttctacacctatcagctagtctagactaactagtaattatttcgactacgttactactagtacaactagtaacttaccgtacgtacccctaggtaccgttacggaccgaacggaccgaaggtagaaactacgaaacgtaagtggtcgacgtacgactacattactgttcctctaccg

SEQ ID NO: 12682 - DNA, 614 bp, Homo sapiens
  misc_feature: GYAE6OF01CPVET.2.72.G06.1.454.CMB.1.raw
  modified_base (216)..(216): a, c, t, g, unknown or other
  misc_feature (216)..(216): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccggnaagtcagagcattagcagcttaatttaaattggtatcagcaagaaaccgagggaaacgacccctaaactcctagactctatcgttaacacttcctagtttgacgtaaaggtcgggtacccagtacgtaaggttcaaggtggactaggtggatcgtagggactagtactttcactctacaccatcacgcacgtctcgactaaaccgtgtaagtattttacgactaactttactactgtaacaacgtagtacgttaaccgaccggttaccccgtagggtaccgttaccggaccgtaaacggggaacccgtaagggttacggaaacgtaaccgtaaaaccggtacgttagggtcggtacctacggtacctaaccgtacttaccgtacgttccttcgtaccg

SEQ ID NO: 12683 - DNA, 605 bp, Homo sapiens
  misc_feature: GYAE6OF01BLVLK.2.72.G06.1.454.CMB.1.raw
  modified_base (587)..(587): a, c, t, g, unknown or other
  misc_feature (587)..(587): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgctatctgtaggagacagagtcaccatcacgttggccgggacaagtcagagcattagcagcttaatttaatgtatcagcaagaaaccgaggaaacgacccctaaactcctagatactatagttacatcctagtttgactaaaggtcgggtaccagtacgtaaggttcaaggtggacgtaggtgacgtgtacgggactagtacttcgactctaccgacctatacgacgtcagttctacgacctaaacgttaggaagtttctttacgaacttaaccttacgtactcgtaaccaacgtagaacgtttaccgacccgttaccccgtacgggtacttcccggaacgtaacgggtaacctagggtaagaaacctaacgtaaacgagttacggtcggctacgacctacacgttnttaccgtcttacgtaccg

SEQ ID NO: 12684 - DNA, 746 bp, Homo sapiens
  misc_feature: GYAE6OF01BPAKL.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtcctccatccctccctgtctgctatctggtaggagacagacgtcacctatcacgttcggccgggacaagtcgaggacgactaagttagacaacgtacttaattttaaagttggtaactacgaacgacgaacggaaaaccgaacggggaaacctaaccccgttaaacctaccgtacgtaacttactaacgttacgttaacctacttaccgttagtttacggaacgtaaacggttccggggtacctaacgttacggtaacggttccgtaaagggtcggtacgtagggttacggtaacgttcggtaggggtaactaaggttacgtttacctaaccttccgtaacctaccgtacgtaccgaacgtcgtaacgttccgtacgaacctaaacgttagtaacgtttactttacgtaaccttaactttaaccgtacgtacgtaaccgtaacgtagttaaccgttaaccgaccggttaccccgtaggttacccggttaccggaccggtaaacggaacgtaaggtaacgtaaacgtaccgaaacgtacgtacggcgtaccgtacgaccgtaacacgttactcgttctcgttaccg

SEQ ID NO: 12685 - DNA, 746 bp, Homo sapiens
  misc_feature: GYAE6OF01DFLUC.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtagagacagagtcaccatcacttgccggcaagtcagagctattagcagtacttatttaaattggtatcagcaagaaaccaggaacaccctaaactcctagatactatcgttaacatcctagtttgacaacggtcgggtccagtctaaggttcaaggtggacagtggactcgtagggactagtattttacgacttaccgtaccaaccgtaactccgtaacggtacctaagttacccgttacgaaccgttaaacccgttaggtaaacgtttaacgtttttaccggaaccgtttaaaacttttaacccgttaaccgttaacgggttaaccctaaaaccggttaaacgttaaacccggtttaaacccgttaaccccgggtttaacccccgttacggggttaaccccggtttaccggggacccggtaaaacggggtaaccccggttaaaagggttaccggtaaaacgttacccgaaaaaccggttaaacgttcgggtacgggttacccgttaggacccgtaaacccgttaacgttaccgttacgtttcgttaacccgttaacccg

SEQ ID NO: 12686 - DNA, 848 bp, Homo sapiens
  misc_feature: GYAE6OF01EQWMD.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcccgtgtactctgcgtccgtacggtggtcgacgagtagtgtacactctcgtagtagtaccgaccgtcgttccctacctaccttccccttccgtcgttcgtcactacttcggttagggtaaggaacgaacgaaggtaccgtacccaacctactaccttacggtccggggaccggaacgtaacgtacgaaggacgacttaagtacgacgtacgttaactttttaaaagttttaaggtagttacacggacgaaacgaaaaaccgaaaccggggaaacggtaaccccccttaaaccccttaacgtccgtaagtaccttaacgttacgtttaacctaactaccgtacgttttaggttacgaaacggttacggggttcccgtaactagtaacggttacgtcgtagggtcgagtagggtagtacgtagggtacgtaacgtattttaccgtacctcgttacctaaccactacgtagacgtattccgttgaccgtaaccctaggtaaagttacgtttttacgtaaccgtaaaccttttaaccgtaacttcgtaacgtaaacctaaaggttacgtttaacccgtaacccggtaaccccccgttaccgggtacggtttacccggtacccggaaaccgggtaacggtaaaccggttaagggtaaacctaaaaccgtaaaacccggaacgttgggtaggtaccgccgtaacgaacccctagtacttcggttacttacctcgttaccccg

SEQ ID NO: 12687 - DNA, 734 bp, Homo sapiens
  misc_feature: GYAE6OF01AVVK3.2.72.G06.1.454.CMB.1.raw
  modified_base (727)..(727): a, c, t, g, unknown or other
  misc_feature (727)..(727): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcgagacgactattagcacgtactttaaatttaaattggtactacgaacgacgaaacggaaaccgaacggggaaaccctaaccccttaaactccgtagtacttacttagttacgttaactactccgttagttgaacgtaaggttccggtacccagtacgtaacggttcgaggtcggacgtaggtacggtacgttcggtacgggaacgtaacgtttaccttttacccgaccgtttccctaaccctacctacgtaaccgacgtaccgtacgttaccgtacgtaacccgaaccgttaaggtaacgtttacgttttacgtaaccttaaaccgtttaaccttacgttactaaccgaaacgttacgtaaccgttaccggtaacccgttaccccgttaagggtacccgttaccggaacccggtaacgggtaaccgtaagggtaaacgtaaacgtaaccgtaaacgtacgttaggccgtcgtaaccgcctaacctcgttaccttcgttcccgttnttacccg

SEQ ID NO: 12688 - DNA, 666 bp, Homo sapiens
  misc_feature: GYAE6OF01A7MW5.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttggccgggacaagtcagagcattagcagtcttaattttaaattggtatcgaagcaaaggaaacccgaagggaaaacgaccccctaaaacgtcctgtaacttacttatacgttaacacttacctaggttttcgaacgtaaaacgggttcggggtacccctaagttaccgtaaagggttacgaacggtcggggtacaagggtggacgttccgggtacggtaagtacgtttacttacgtaccttactaccaactacgtacacgtacgtccgtcgtaccgaaccttaacgtaggtaacttagtttacgaacctttaaccttactacgtactaacgagtaacgtacgtacctacccgtaccgtaccggtacggaccggacggtaacggaacgtaggaacgtaacgtaacgaaacgtacgtaggtcgacgtcgacctacgtacttcgtcttcctcgttacccg

SEQ ID NO: 12689 - DNA, 616 bp, Homo sapiens
  misc_feature: GYAE6OF01BZRE4.2.72.G06.1.454.CMB.1.raw
  modified_base (219)..(219): a, c, t, g, unknown or other
  misc_feature (219)..(219): n is a, c, g, or t
  modified_base (276)..(276): a, c, t, g, unknown or other
  misc_feature (276)..(276): n is a, c, g, or t
  modified_base (494)..(494): a, c, t, g, unknown or other
  misc_feature (494)..(494): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtccaccatcacttgccgganaagtcagagcattagcagcttaatttaaattggtatcagcaagaaaccagggaaacncccctaaactcctagactctatagttacatcctagtttcgactaaaggtcgggtaccctagtaccgtaaggttcaggttggacctaggttggacttcggtagggaactaaggtacttttaccgacgttcccttaccgaacctaacttaccgaacgtaccgtacgttcgtacgaccctaaaccgtagtaagttacgtttacgacttaacttactacgtntaaccaagtaagtacttacgaccgttacccgtgtaccgtcgacgaaacgggaccaaggtagaaactcgaaaaccgtagtaggtcgactacgaccgtacctataccgtattccgtactacccg

SEQ ID NO: 12690 - DNA, 662 bp, Homo sapiens
  misc_feature: GYAE6OF01DDX0F.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagcttaatttaaattggtatcagacaagaaaaccgaagggaaacacccctaaaactcctagactctatgttacatcctaagtttcgacgtaaggtcgggtaccctagtactaaggttacaaggttggacgtaggttaggacgtcgtacgggactagtactttaccgacttacctacaacctatccgaacgtctagtcctagacctaacgtaggtaacgttattttaccgaacttaaccgtttaccttacgtacgttaacaacgtaacgtaacgttaaccgtaaccggttacccccgtagggtacccggtttaccgggaccggtaaacgggaacccgtaaagggtacggaaactaaccggtaaaaccgtacgttaggtacggtaccgtacggaacctaccgtattccgttacgttccttaccgttacccg

SEQ ID NO: 12691 - DNA, 571 bp, Homo sapiens
  misc_feature: GYAE6OF01D4E6Z.2.72.G06.1.454.CMB.1.raw
  modified_base (459)..(459): a, c, t, g, unknown or other
  misc_feature (459)..(459): n is a, c, g, or t
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctgatcgacccagtctccatccctccctgtctgcatctgtaggagacagagtcaccatcacttggccgggacaagtcagagctattagcagtacttaatttaaattggtatcagacaagaaaccgaagggaaacacccctaaactcctagatctatgttacactcctagtttgacgtaaggtcgggtacccagtacgtaaggttcaggtggacaggtggatcgtagggactagtacttcacttctacacctatcacgctacgtctacgacctaaccgtagaagttatttcgaccttaactttactactntacaatagtacttaccaccgttaccctaggtaccgttacggaccgaacggaccgaaggtacgaaactacgaaacgtagtggtcgctacgacctacctattctcttctctacc

SEQ ID NO: 12692 - DNA, 689 bp, Homo sapiens
  misc_feature: GYAE6OF01BJTAV.2.72.G06.1.454.CMB.1.raw
  modified_base (145)..(145): a, c, t, g, unknown or other
  misc_feature (145)..(145): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagagggtntgacatcctgatgacccagtctccatccctccctgtctgcatctgtaggagacagagtcaccatcacgttggccgggacaagtcagagcagttagcagtacttaatttaaagttggtatcagacgaagaaaccgagggaaaaccaccccctaaactccgtagtactactattagttaacatcctagtttacgacgtaaagggttccgggtaccctaagtacgtaaaggtttcaagggtggacgtaggtagggtacttggagggtaactaggttactttaccgtaccttccgttaccaaccgtactaccgaacgtcgtaacgtcctacggacctaaacccgttaggtaagtttacttttacgaaccctttaaactttacctacttacgtaacaacgtacgttaaccttaccgaacccgttaccccgtacgggtaccgttacggaaccgaacgggtaaccggtaacggtagtaaaacctaccgtaaaacgtaccgttaggacggtacctagaaccctactacttacgttcgttccgttacttaccg

SEQ ID NO: 12693 - DNA, 817 bp, Homo sapiens
  misc_feature: GYAE6OF01BTZE3.2.72.G06.1.454.CMB.1.raw
tcagacgctcgacacacgaccggtgctcgatttagctacgactgcaagggaaaggggagtctcagtcaggacacagcatggacatgagggtccccgctcagctccgtggggctcctgctactctggctccgaggtgccagatgtgacatcctgatcgacccagtctccatccctcctgtctgctatctgtaaggagacagactcaccatcctacgttcggccgggactaaacggtcaaggagtactaagttacggctaaggtactttaaagttttaaacgttggtaatccgaacgtacgaaaacggaaaccgaacggggtaaaaccctaccccttaaaacgtcccgttaagtaccttaccgttaagttacgttaacctacgttaacccggttaggtttacggaacggttaaacggggtccgggttaaccctagttaaccggtaacgggtttacctaagggttacgggacgttaaggggttacggtaacgttccggtaacggggtacttaacgttaccgtttaccgaaccgtttacccgtaaccgtacccgttaacggtaaccgtaacgtaccgttacgttaccccgtaacgtaacccttaaccgggttaagttaaacgtttttacgttccggaaaccttttaaaccgttaccgttaaacgttcggttaaaccgtaaacgttacggttaaccgtttaaccgaacccgtttaccccggtgggttaaccgttccggaacgtaaccgggtataacgggtacgtaaacacggtaaacgtctaggcgtacgtacgactacgtataccgttctcctacgtaccg

SEQ ID NO: 12694 - DNA, 612 bp, Homo sapiens
  misc_feature: GYAE6OF01AODDL.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcaagaaccagggaaacgacccctaaactcctagactactatgttacattccagttttgcgtaaacggtgggtaccctagttcgaacggtttcaaggtgggacaggtggacttcgtaggggactaggtattttccaaccgttctacctaaccgtattaccgagcctaggttcctacgtacaaaccgttaggaagtagtttttacgactaaactttacctacttagtacaacgtagtaacgttacctaccgtacccccgtaggtaccgttacggacccgaagggaccgtaaacgggtaggaaactacgaaaccgtactcggtaggacgttacgacgtacctagtcctcgttacgttctacg

SEQ ID NO: 12695 - DNA, 698 bp, Homo sapiens
  misc_feature: GYAE6OF01BO59C.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtcctccatccctccctgtctgcatctgtaggagacagagtcaccatctacgttcggccgggacaagtcagagctattagcagtactttaattttaaaagttggtatcgaagacaaacgaaaaccgaagggaaacctacccctaaactcctacgtacttacttaattacgttaactacttacctagtttacggaacgtaaacgggttccggggtaccctagttaccggtaaggtttaccagggtacgggacgtaggttagggacgttcggtaggggtactaacggttcttttaccaccttctacctaacattacgtaacgttacgtacctaaccgtaaccttaggtaaactttacttttacgaaccttaacttacctactacgtaacaacgtagttaacgttaaccgtaacccttaccccgtccgtaccttccttacggttcgggacgggacggaccgtaagggtcgaacgtactaaccggaaagtacgttgggtccgtacctacgtaccctaacgtatttccgttgttcccttaccg

SEQ ID NO: 12696 - DNA, 751 bp, Homo sapiens
  misc_feature: GYAE6OF01C14L7.2.72.G06.1.454.CMB.1.raw
  modified_base (480)..(480): a, c, t, g, unknown or other
  misc_feature (480)..(480): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgactcgaccctagtcctccactccctccctgtctgcatctagaggagacagacgtcaccatcctacgttcggaccggacgtaacgtacgaagacgtactaagttacgacctagtaacttaagtttaaagttggtactacgacgacgaaacgaaaaccgaacgggaaaccgtaacccctaaacgtcctagtactacttaagtacgttaactactcctaagttcgacgtaaaggtcgggtacctagtacgtaggttcgaggtcgacgtagtagtacgtcgtaacggtactaacggtactttaccgaaccttaccgtaacctaaccgtaacnccgtaacgtacgtacgtacgtaccgaaacctaacgttaacggtaatttacgtttacgaacctttaaacttaaccttacgtaacgtaacctaacgtaacgttaaccgttaacccgtaccgttaccccggtaaggtacccgtaacgggtacccggtaaaacgggtaccgaaacgggtaaacgaaaaccgtaaccggtaaaccgtacgttaacggtccgtaacgttaccgaccgttaaccctaagttaccgttacgttacttcccggttaaccc

SEQ ID NO: 12697 - DNA, 677 bp, Homo sapiens
  misc_feature: GYAE6OF01C9GEC.2.72.G06.1.454.CMB.1.raw
tcagacgctcgacacacgaccggtgctcgatttagctacgactgcaagggaaaggggagtctcagtcaggacacagcatggacatgagggtccccgctcagctcctgggctcctgctactctggctccgaggtgccagatgtgacatcctgatgacccagtctccatcctccctgtctgcatctgtaggagacagagtcaccatcacttggccggcaagtcagagctatagcagacttatttaaattggtatcagcaagaaaccgaggaacgaccctaaactcctagattctatacgttacatccgtagtttagacgtaaagtccggggtaccctagtacgtaaggttacaggtaggccgtaggtggatcgtaggggactagttattactacctctacctaaccctataccacgtacgacgttactcgaacctaaaccgttgaacgttattttacgaaccgttaccctttaactacttacgtactaaacgtaacgttacgttaaccgaaccccgttacccccgtagggtttacccggtttaccgacccgggtaaacgggtaacccgtaaacgggtaaacggtaaaaccgttacccgtaaaacggtacgttacgggtaccggtaccgtacggtaccctaccgttaccgtttacttacccgttccgttcgttacccccg

SEQ ID NO: 12698 - DNA, 809 bp, Homo sapiens
  misc_feature: GYAE6OF01DHNYW.2.72.G06.1.454.CMB.1.raw
tcagacgctcgacacacgaccggtgctcgatttagctacgactgcaagggaaaggggagtctcagtcaggacacagcatggacatgagggtccccgctcagctccgtggggctcctgctactctggctccggaggtcgccaggatgtagacatcctaggactcgacccagtcctcccacttccctccctgtcctgactacttcgtaggtaggacgacgagacgtaccacctatcctacgttcgggccggtaacaagtcgaggacgtctaagttacgacgtaacgtactttaaattaagttcggtaactacgagaccgtaaaacggaaacccggaacgggtaaacccgtaacccccgtaaaacgtttccgtaacgtacgttacgttaacgttaccgttaacgtacctttaccggttaaggtttaccggaaaccgggttaaaaccggggtccgggttaacccctaacgttaacgggttaaacggttacggaaccggttgggaaccggttaggtagggtacgtaccggtaacggggtacttaagttccgtttaccacgtttaccaaccgtactacgtaccgaagtccgtagtaccgtacgtaacttaaccgtagttaaccgtttcgttaccgtaaacctttaaccgttaacgtagttaccggaaactaacggtaacgttaccttaacccggtaccttaacccgggtgggtaacctacccgggtagaaaccgtaggtaaccgaagtaacgtaacgtacggtacggtagtaccggctacggtacaacgttctaccgtttcgcttccggttaccc

SEQ ID NO: 12699 - DNA, 728 bp, Homo sapiens
  misc_feature: GYAE6OF01DQYFK.2.72.G06.1.454.CMB.1.raw
  modified_base (241)..(241): a, c, t, g, unknown or other
  misc_feature (241)..(241): n is a, c, g, or t
  modified_base (466)..(466): a, c, t, g, unknown or other
  misc_feature (466)..(466): n is a, c, g, or t
tcagacgctcgacacacgaccggtgctcgatttagctacgactgcaaggggaaaggggatctcagtcaggacacagcatggacatgagggtccccgctcagctccgtggggctcctgctactctggctcgaggtgccagatgtgacatcctgatcgaccagtcctccactccctcctgtctgctatcgtgtaggagacgagagtccaacctatactacgttcggccggataacgcaagganacctagttacgacgtaacttattaaagtttaaaggttcgtaataccgaagaacaaacggtaaaaccggacggtaaacctacccctaaacgtctagacttacagtttacgtacctatacgttagttagacgttaacggtccgggacctagtacggtaacgtcgtaacgtggacgtaggtacgtcgtaggacggtatacgttacttacctacgttccacgtaacttnacgatccgaacttcgaccgaacttacgtagttaacgtttactttacgaaaccttaacgtctaactacaaccgtaaacttacgggtaactaccccggtaccggttaccccggtacgggttaaccggttaacccgaacgggttaaaaccgggaacgttaacgggaaaccgtaaaaccgtaacggttaaaccggacggttagggtacccgtaacgtacgtaacccgtaccttacgtttaccgacgtttttcccacggttaacccc

SEQ ID NO: 12700 - DNA, 637 bp, Homo sapiens
  misc_feature: GYAE6OF01E1MO5.2.72.G06.1.454.CMB.1.raw
  modified_base (392)..(392): a, c, t, g, unknown or other
  misc_feature (392)..(392): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttcgccgggacaagtccagagcattacgcagcttaatttaaagttggtatcgagactaagaaacccgaaggggtaaactacccccctaaaactccgtagaattctaattacgttaacacttaccgagttttcggacgtaaaggtcggggtcccatacgtaagttcgaggtggacagtgagtcgngggacagtacttacactctacgaccatccagctacgtctcgacctaacgtagtaagttatttacgaccttaaactttaccctaacgttcgtaaccaactaacgtaacgttaacccgtaccggttaacccccgtgggttacccgttaccggacccgtaacgggaaccgtaagggtaacggaaactaccgtaaacgtaacgtggtcgaccgtacgaccctaacgacttactccgttcttccgtaccg

SEQ ID NO: 12701 - DNA, 827 bp, Homo sapiens
  misc_feature: GYAE6OF01E3AQX.2.72.G06.1.454.CMB.1.raw
  modified_base (269)..(269): a, c, t, g, unknown or other
  misc_feature (269)..(269): n is a, c, g, or t
  modified_base (283)..(283): a, c, t, g, unknown or other
  misc_feature (283)..(283): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccggcaagtcagagcattagcagctatttaatggtatcagcagaaaccgagggaaacncccctaaactcctnatctatgtacatcctagtttcgactaaaggtcggggtaccctaagtaccgtaaacggtttctaaggttcgggaccgtaagggttcgggtaacgttaccggttaggggggaaacctaaggttaactttttacccgtaaccctttacccttaccctaacccctaacgtttaaccgaacggtaccgtaacggttacccttaacggtaaccctaaaacccgtttaacggtaaaacggtttaacgtttttttaacggaaacccttaaaaccgttttaacccgttaaaccgtttacgtaacccgtaaaacctaacggttaaaccggtttaaacccgtaacccgggttaaaccccccccgttaggggttaaccccggtttacccggggaaccccggtaaaacggggtaacccggtaaaacgggggttaaacggtaaaaaccgttaaaccgaaaaacccgggttaaaccgttacgggtacgggttacccgtacgtaacccgtaaccccgtaacgtttaccgtttaccgtttacccgtttaccgttaaccccg

SEQ ID NO: 12702 - DNA, 728 bp, Homo sapiens
  misc_feature: GYAE6OF01D3D2X.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtccaccatcacttcggccggcaagtcagagctagttagcagtacttaatttaaagttggtatacgagacaacgaaaccgaagggaaaccgtacccctaaactcctagtactacttaagtacgttactacttaccgttagtttacgaacgtaacgggttccggggtaccctaagtaccgtaaggttacgaggttacggacgtaggtaggtaacttcgtaggtagaactagttactttaccgaaccttcctaacctaaccctacttacgacgtctacgttcgtacgaacctaacgtagtaacgtttacgtttaccgacttaacctttacttacgttacgtaacctaaacgtaacggttacgttaacccgtacccggttaaccccgttacgggtaacccggttacccggaaaccggtaaaccggggtaaaccgtaaacggggttaaacggaaaccgtaaaccggtaaaaccggtacggttcgggaccggtacgaccgtacctaaccttagttccgttcgttcccgttaacccg

SEQ ID NO: 12703 - DNA, 708 bp, Homo sapiens
  misc_feature: GYAE6OF01EL799.2.72.G06.1.454.CMB.1.raw
  modified_base (228)..(228): a, c, t, g, unknown or other
  misc_feature (228)..(228): n is a, c, g, or t
tcagacgctcgacacacgaccggtgctcgatttagctacgactgcaagggaaaggggagtctcagtcaggacacagcatggacatgagggtcccccgctcagctcctggggctcctgctactctggctccgaggtgccagatgtgacattcctgatcgacccagtcctccatccctccctgtctgcatctggtaggagacagacgtcaccatcacgttcggccggganaagtcagagctattagcagtcttaatttaaattggtatcagacaagaaaccgaggaaaccgaccctaaactcctagtactctatacgttacacgtcctagtttcgacgtaacggtcgggtacccaagtacgtaaaggttccgaaggtgggtacctagggttcggtaacgttacggtcgggaaactacgttaacgttttccaaccgttcctaaccaccgtaacttaccgaagggtacctaacgtttcccaacggtacccgtaaaccgttacggtaaacgtttagttttaccgaaacctttaaaccgttaccttaacgttacgacccgtaaaagtcgttaacgttaccgtaacccgttccccgtagggtaccgtaccgggaacgtaacgggacgtaacggtacgtaaacgtaacgaaaaccggttactacgggtcgacttacggaccctaactacgttaccgttcgttacctgttaaccccg

SEQ ID NO: 12704 - DNA, 1008 bp, Homo sapiens
  misc_feature: GYAE6OF01B5S11.2.72.G06.1.454.CMB.1.raw
  modified_base (234)..(234): a, c, t, g, unknown or other
  misc_feature (234)..(234): n is a, c, g, or t
tcagacgctcgacacacgaccggtgctcgatttagctacgactgcaagggaaaggggagtctcagtcaggacacagcatggacatgagggtccccgctcagctccgtggggctcctgctactctggctccggaggtcgccagatgtgacactcctagatcgacccagtcctccactccctccctgtcctgactatcgtgtaggagacagactcaccatcgacgttcggccgganaagtcagagactaagttacgactagtacttaatttaagttaggtatacagacgaacgaaaccgaacggaaaccgtaacccgtaaacctacctacgtactactacttacgttactaactaccgttacgttacgtacgtaacggtacggtaccgtacgtacgtaacggttagtaccccccccccccccccccccggtaggtacgtacggtaggtacgtacggtacgggtaacgtaacgttacgtttaccgtaccgttaccgtacctaaccgtaacgtaccgtaacggtaccgtaaccggttaccgttaccggtaacccggttaaacccggttaaacgggttaaacggtttaaaccggtttttaaccggttaaaccccgtttaaaacccgttttaaacccgtttaaacccggtttaaacccggttaaacccgttaaaacccggttaaaaccgggtttaaacccgggtttaaaccccggtttaaacccccgggtttaacccccccgggtttaaacccggggtttaaaccccggggtttaaaccccgggggttaaaccccggggttaaaacccgggggttaaaacccggggttaaaaaccgggggttaaaaccggggttaaaaacccggttaaaacccggttaaaaaccgggttaaaacccgggttaaccgggttaacccgggttaacccggttaaccggttaaaccccggttaaacccgttaaacccggtttaacccggtttaacccggtttacccgtttaaccccgtttaaaccccg

SEQ ID NO: 12705 - DNA, 748 bp, Homo sapiens
  misc_feature: GYAE6OF01BWWQ5.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtctccatccctccctgtctgcatctggtaggagacagagtccaacctatccgtaacgttcggacccgggactaaagtcaggagactagttacgctagtactttaatttaagttaggtatcgaagacaaacggaaaccgaacggaaaccgtaccccttaactccgtagtacttactagttagtaacctagtcctagttacgacgtaacggtcgggtacctagtacgtaacgttacgagtcgggctaggtaggacttcggtacgggactagttactttcgaccttcgtacccaactactacgtacgtacttacgtactacgtacctaaacgttacggtaactttacggtttacctaaccgtttaacctttaccgtacttaagtaccctaaacggtaacgtttaaccggttaaccgtaaccccggtttacccccggtagggttaaccccgtttacgggaacccggtaaacggggtacccgtaaacggggtaagtaaaaccgtaaccggaaaaccgttacggttcggtaacggtcccttaacgggaccccttaagtaccctttaccgtacggttcccttacggttacccg

SEQ ID NO: 12706 - DNA, 723 bp, Homo sapiens
  misc_feature: GYAE6OF01BIDM5.2.72.G06.1.454.CMB.1.raw
  modified_base (194)..(194): a, c, t, g, unknown or other
  misc_feature (194)..(194): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtctccatccctccctgtctgcatctgtagganacgagacgtccaccatcacgttcggaccgggacaagtcaagacgctaagttagctagtacttaaattttaaagttggtatacgaagtacaaagaaaccgagggaaacctaccccgtaaactccgtagtactctaacgttagttaacctacgtacctaaggtttacgaacgtaaacgggttccgggtaaccctagtaccgtaaacggttcgaagggtcggaacgtaggtacgggtacgttacggtacggggtaataaggttacctttacctaccgtcctaccgtaacctacgtacgacgtcgtaacgtacctacgtaactaaccgtaacggtaacgttacgtttacgtaacctttaaccttacgttaacgttacgtaaccgtaacgtaaccggtaacttaacccgtacccgttaacccccggtaggttacccggtaccggtaccggaaacggtaacggtaaacggtacgtaaaacgtacgtaaacgtacgtagtacgctacgacgtactactataccgtcgttcctaccg

SEQ ID NO: 12707 - DNA, 756 bp, Homo sapiens
  misc_feature: GYAE6OF01BJ3TF.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctcctgtctgcatctgtaggagacagagtcaccatcacttgccgggcaagtcagagactagttagctaagtacgttaattttaaagtggtactacgagacaacgaaacccgagggaaaaccgtaccccctaaactccgtagtactacttaacttacgttaacagttacccgtagtttacgaaccgtaaaggttccgggtaacccctaacgttaccgtaaaggtttcgaggtcggtacgagggttaggtacgtacggtagggtaactacgttatttaccgaacttaccgtacccaacctacgtaccgagtacctaacgttacccgtacgtaacccgaaaccgtttagaacgtttaagttttaccgaacctttaaaccgtttaaccctttacgaacgttaacccaaagtaacggttaacgttaaccccgtaaccggttaccccccggttagggtaaccccggtttacgggaacccggtaacgggaaccgtaaagggtaaccgtaaaaccggttaacgaaaacccgtacgtcgggtacgtacctcgggaacctacccggtaacttacgttacgttccctcgttaacccg

SEQ ID NO: 12708 - DNA, 627 bp, Homo sapiens
  misc_feature: GYAE6OF01AMQMW.2.72.G06.1.454.CMB.1.raw
  modified_base (197)..(197): a, c, t, g, unknown or other
  misc_feature (197)..(197): n is a, c, g, or t
  modified_base (474)..(474): a, c, t, g, unknown or other
  misc_feature (474)..(474): n is a, c, g, or t
  modified_base (620)..(620): a, c, t, g, unknown or other
  misc_feature (620)..(620): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatccctggatcgacccagtctccatccctccctgtctgcatctggtagganacagatcaccatccacgttcggccgggacaagtcaaggagctagttagcagtacttaagtttaaagttggtatcagacaacggaaaccgaacgggaaacctacccctaaactccgtagactactagtgttaactactaccgtagtttacgaacgtaagggtcgggtacccagtacgtaaggtcgaggtcgcgtaaggtggtacgtcggtagggactagttacttcacctctaccactagtacacggtcacgtcgtacgtactaacgtagtaacgttntttacgacttaacttactacgtacgacaacgtacgtacgtaccgtaccgtacccgtaggtaccgtacgaccgaacggtacgaagggtacaaacgtaacgaaacgtacgtacggcgtacctacgacctacgtacttccgtcttcctntacccgg

SEQ ID NO: 12709 - DNA, 707 bp, Homo sapiens
  misc_feature: GYAE6OF01CWXRV.2.72.G06.1.454.CMB.1.raw
  modified_base (196)..(196): a, c, t, g, unknown or other
  misc_feature (196)..(196): n is a, c, g, or t
  modified_base (457)..(457): a, c, t, g, unknown or other
  misc_feature (457)..(457): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcctccatccctccctgtctgcatctagtagganacagacgtacaccatcacgtgccggacaagtcagagctagttagcagtacttaagtttaaagttggtaactacgagacgaacgaaaaccgtaagggaaaccgtaacccccttaaaacgtcctagtaacttaccgttaattacgttaacacttacccgtagtttacgacgtaaacggtcgggtaccctagtacgtaaggttcaggtcggactaggtacggagtcggtagggtaacctagtaactttcgacttctacacctanacgaacgctagtccgtcgtaactaaccgtagtaaacgtttcgttttaaccgtaactttacttaacgtacgttaacaaaccgtaacgtaaccgtttaaccgtaacccggttacccccgtaggttacccggtacggaacccgtaacggggtaaaccgtaagggtaaccgtaaacgtaaccgaaaacggtaccgtggaccggtccttacggacctaaccgttagttcccttagtccttacgtccgttaccccg

SEQ ID NO: 12710 - DNA, 637 bp, Homo sapiens
  misc_feature: GYAE6OF01EUR22.2.72.G06.1.454.CMB.1.raw
  modified_base (215)..(215): a, c, t, g, unknown or other
  misc_feature (215)..(215): n is a, c, g, or t
  modified_base (601)..(601): a, c, t, g, unknown or other
  misc_feature (601)..(601): n is a, c, g, or t
  modified_base (628)..(628): a, c, t, g, unknown or other
  misc_feature (628)..(628): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtagagacagagtcaccatcacttgccggnaagtcagagcattagcagtactaatttaattgtatcagacaagaaaccgagggaaactacccctaaactcctagtacttacctattacgttaacacttacctagtttacgacgtaaaggttccggggtaccctaagtaccgtaaacggttcagggttggacgtaggtaggactcgtagggactagtacttcacgtctacgacctatccgagtctaacgtctacgacctaaccgtagtaacgttagttttacgaaccttaactttacctacgttacgaacctacgaagttaacgttaccgaacccggttacccgttggtaccggttcggaaccgtaagggaaccgtaagggtaacgaaactaacggaaaccgtagttaggtaccggntaacgaccgtaacctgttactcggttntccgtaccg

SEQ ID NO: 12711 - DNA, 828 bp, Homo sapiens
  misc_feature: GYAE6OF01B8FE2.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctggtaggagacagagtcaccatcacttcggccgggacaagtcaggagctattacgcagtcttaatttaaagttggtactacgaacgacaaacggaaaaccggtaagggaaaacccgtaccccctaaaactcccgtagtaacttaccttagttacggtttaacctacttacccgtaggttttacgaaccgtaaacgggttccggggtaccctaagtaccggtaaacggtttccgaagggtcggacgtagggtacggtacgttacggtacgggaacctaggttacttttacccgaaccgtttcccgttaccaacccgtacgttaccgacggtactaacggttacccgtaacgtaacccgtaaaccgttaagggttaaactttacgtttttaccgaaccgtttaaaccctttaaccgttacgtttaaccggtaaccgtaaacttaacggttaaccggttaacccgttaccccggttaacccccggttagggttaaccccgggttaccgggaacccgggtaaacggggtaaacccggtaaaggggttaacggtaaaaccgtaccggtaaaaccgtacggttacgggttaccggacgttacggaccccgttaactacgttacttcggtttacctttaccgtaaccccg

SEQ ID NO: 12712 - DNA, 690 bp, Homo sapiens
  misc_feature: GYAE6OF01AF4N6.2.72.G06.1.454.CMB.1.raw
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctgatcgacccagtctccatcctccctgtctgcatctgtaggagacagactcaccatcacttggccgggacaagtcagagcagttacgcagtacttaatttaagttggtatcagacgaacgaaaccgaagggaaacctacccctaaactcctagatactatcgttacactccgtagttgacgtaaggtcgggtaccatacgtagttcgaggtgacgtaggtagtagtcggtaggactagtacttcactcctacgacctatacgacgtactacgtctacgaacctacgttagtaagtttactttaccgaactttaaccgttacttacgttacgtaaccgtaacgttaacgtaaccgttaacccgtacccgttaaccccggtcggggttaaccccgttaccgggaacccggtaaaccggggtaaaccgtaagggtaaaccggtaaaacctaaccggtaaaccggtacggttcggttaccggtaccgtaccggtaacccgtacctacggttaccgttacgtttccgttacccgttaaccccgg

SEQ ID NO: 12713 - DNA, 647 bp, Homo sapiens
  misc_feature: GYAE6OF01A2XHF.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaccatcacttgccggcaagtcagagcattagcagacttaatttaaatggtatcgagacaacgaaaccgaaggaaccacccctaactcctagatactatacgttaccaccgtagtttcgacgtaaacggtcgggtaccctagtacgtaacggttacaggtcgcgagtgtagtcgtaggacagtactttcactctacacatacgacgtcacgttctacgacctaacgtagtaagttactttacgacttaacctttaactacctagtaaccgtaaacgtacgttaaccggtttaacctaccccggttacccccggttaggtaccggttacccggaaccggtaacgggacccgtaaagggtaacgtaaaactaaccgtaaaccggtacgtacgggtacgccgtacggaccctaaccgtacttacgttaccgttacttccgtcttaccccg

SEQ ID NO: 12714 - DNA, 865 bp, Homo sapiens
  misc_feature: GYAE6OF01EMO12.2.72.G06.1.454.CMB.1.raw
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctagatcgacccagtcctaccacttccctccctgtcctgctatctggtaggacgacagacgtccacctatcacgttcggccgggacaacgtcaggtacgctaagttacgcgtagtactttaaagttttaaacgttggtaactcaacggaacaaacggaaaacccggaaggggtaaaacccgtaccccctaaaccgttaccgtagtaactttacgtagttacgttaacctcttaccgttagtttacgacgtaaacgggttccgggtacctacgttacgtaacggtacgtagggtacggtacgtacgggtaggtaacggtacgggttacgggacgtacggttttaacctttacgtacccggtttaccaaccctaaccgttacgttaccgaacgtaccttaacggttaccaacggtaacctaaaccgttaagggttaaacgttttaccggtttttaaccgaaacccgttttaaacctttaaccttggtttaaccgtaaccgttaaacgtacggtttaaaccgttacccctaaccggggtttacccccgttacgggttaaacccgggttaccgggtaacccggtaaaccggggtaaccggtaaacgggtaacgtaaaacccgtaacggtaaaacccggtaggttacgggtaacgtacccgttaccgaccgttaaacccgtacgtttacccgtttcttacccggtttaccttaaccccgg

SEQ ID NO: 12715 - DNA, 859 bp, Homo sapiens
  misc_feature: GYAE6OF01EVWE7.2.72.G06.1.454.CMB.1.raw
tcagacgctcgacacacgaccggtgctcgatttagctacgactgcaaggggaaagggggagtctcagtcaggacacagcatggacatggacgggtccccgctcagctccgtggggcctcctgctactctggctccgaggtgccagatgtgacatcctgatcgacccagtcctccactccctccctgtctgctatcgtggtaggagacagacgtccaccactcctacgttcggcccgggacaagtcgagagactaagttacgactagtactttaaagttttaagttgggtaactaccgaacgacgaaacggaaaacccggtaacggggaaaacccctacccccgttaaaactccgttagtaactttacgtagttacgtaactacgttaccgtaggtttacgaacgttaacgggtccgggtaccctaagtacggtaacggttcgagggtcggtagtagggtacggtacgtcgggtagggtaccgtagtttaacctttccaaccgtttcctaccgaactacgttacgacggtacctacggttactaaccggtaaccctaacggttaacggttaacgttttacgttttaccgtaaaccctttaactttacccgttaacgtttaccgtaaacccgtaacgttaaccgggtttaaccggttaacccggttaacccccgggttaacccgggttaccgggttaacccgggtttaaccgggaacccgggtaaaacggggtaccggttaaaagggtaccggtaaaaacttaaccccgggaaaaccggttaggtacgggttaccgtaaccggtcccgttaaacctacccgttaggttccccttacgggttttacccttccggttaacccc

SEQ ID NO: 12716 - DNA, 824 bp, Homo sapiens
  misc_feature: GYAE6OF01DIQ9R.2.72.G06.1.454.CMB.1.raw
  modified_base (162)..(162): a, c, t, g, unknown or other
  misc_feature (162)..(162): n is a, c, g, or t
  modified_base (277)..(277): a, c, t, g, unknown or other
  misc_feature (277)..(277): n is a, c, g, or t
  modified_base (325)..(325): a, c, t, g, unknown or other
  misc_feature (325)..(325): n is a, c, g, or t
tcagacgctcgacacacgaccggtgctcgatttagctacgactgcaaggggaaaggggagtctcagtcaggacacagcatggacatgagggtcccccgctcagctcctggggctcctgctactctggctccgaggtgcagatgtgacatcctgatcgacccngtcctccactccctccctgtctgctatctggtaggacgacagacgtccaacctatctacgtcggccgggacaagtcagagactatagactagtatttaaagtttagttacgttanacgagtaccgaaacgaaaccgaacggaacccctaccctaaagtcctanacttactagttacgtaactacttaccgtaggtttacaacggtaggtccggtacctatacggttaggtacaggtgacgtggtagttcgcgggttacggattacgtactttaccctattaccgtactaaccttactaccggaacgttacgtaacccttacgttaccgaaacccgttaaacgttaggttaacttttacggttttaaccgtaacccttaaaccgttttaacccgttacgtaacttaaccgtaaacgggttaaccgttaaccccgggttttaaaccgttaaccccccgggttaccccgggttaaccggggttaaccccggttaacccccggggtaaaccggggtaaaaccgggttaaaccggggtaaaaccggggtttaaaacggaaaccgttaaacccggtaaaaaccgggtttacggtaacgggtaggaccccggttaccgaaacccgttcctaacggtttccctttaacttcccgtttaaccgtttccccg

SEQ ID NO: 12717 - DNA, 720 bp, Homo sapiens
  misc_feature: GYAE6OF01DB6ZR.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgctatctggtaggacgacagagtccaccatccacttcggccggacaagtcagagcattagacagtacttaatttaagtggtaactcagacaacggaaaaccgaacgggaaaccctaccccgtaaaactccgtagtaacttccgtaagttacgtaacctagttacccgtaaggttttacgaaccgtaagggttccggggtaccctaagttaccgtaagggtttcagggttggacgttagggtacggtacttacgggcgggtaacgtaaggttacctttaccgtacccttccgtaacctaaccgtaactacccgtacgtacgttaccgttacccgtacgaacctaaccggttagtaacggtttacttttaccggaacctttaaccgtttacctacgtacgttaaccgaacgtaacgtaccgttacccgtacccggtacccgtacggtaccgttaccggacgtaaacggacgtaagggtacgaactaacgaaacgtagtcggtcgtacgacgtccaccttagttcgttcgtctaccggtcccg

SEQ ID NO: 12718 - DNA, 729 bp, Homo sapiens
  misc_feature: GYAE6OF01A3IIL.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctcctgtctgcatctgtagagacagagtcaccatcacgttcggccggacaagtcagagcattagcagtcttaatttaagttggtatacagacaacggaaaccgaacgggaaacaccccttaaacctcctagtactacttattgttaaccacttaccgttagtttcgaacgtaaggttccggggtaccctaacgttacgtaacggtttaccgagggtcggacgtacggtaggacgtttcggacggggtactaagttaacgtttacctaccttacgtaccctaacctactaccgacgcgtaacgtccggtacgaaccctaaccgttaggtaacgttttacgtttacggtaaccttaaactttacctaacgttacgtaaccaacgtaaggttaaccgttaccgttaacccgttacccccggttacggttacccggttacccggaccggtaaccgggtaccgtaacggtaaacggtaaacgtaaccgtaaacggtaccgttaggtaccggtaccgttacgacccgtacgtaccgttacccgtttacgttcccgtccgttacccg

SEQ ID NO: 12719 - DNA, 754 bp, Homo sapiens
  misc_feature: GYAE6OF01ADNJW.2.72.G06.1.454.CMB.1.raw
tcagacgctcgacacacgaccggtgctcgatttagctacgactgcaagggaaaggggagtctcagtcaggacacagcatggacatgagggtcccccgctcagctcctggggctcctgctactctggctccgaggtgccagatgtgacatcctgatgacccagtctccactcctccctgtctgcatcgtgtagagacagacgtaccaccatactacgttggccgggactaagtcagaagtcctaagttacggcctaagtacctttaatttttaaaacgttggttaactccgaacgtaccgtaaagaaaaccggacggggtaaaacctacccccgttaaaagtcctaggtacttaccgtaattacgtttaccacgttacccgttaagtttacgaacggtaaacggtcgggtaccctaagttacggtaacggttacgagggtggtacgtaggtcggtaactcggtacggggtaactagttactttcccgtacgtcctacgtacctactacgacgtacgtacgtccgtaagaccctaacggtaacgtaacgttacgttttacaaccttaacgttacgtacgttactacgtaaacgcgttaacttaccgtaccggttaccccgtagggttaaccgtacccgtacggtaaaccggtaacgtaacgggttacgtaaaccgtaccggtaaacgtaccggttacgtcggtaccgtaaccgtaccgtaaccgttctaccgtttaccgttccgtacttaaccccg

SEQ ID NO: 12720 - DNA, 689 bp, Homo sapiens
  misc_feature: GYAE6OF01AP3LJ.2.72.G06.1.454.CMB.1.raw
  modified_base (154)..(154): a, c, t, g, unknown or other
  misc_feature (154)..(154): n is a, c, g, or t
  modified_base (193)..(193): a, c, t, g, unknown or other
  misc_feature (193)..(193): n is a, c, g, or t
  modified_base (254)..(254): a, c, t, g, unknown or other
  misc_feature (254)..(254): n is a, c, g, or t
  modified_base (276)..(276): a, c, t, g, unknown or other
  misc_feature (276)..(276): n is a, c, g, or t
tcagacgctcgacacacgaccggtgctcgatttagctacgactgcaagggaaaggggagtctcagtcaggacacagcatggacatgagggtccccgctcagctccgtggggcctcctgctactctgctccgaggtgccagatgtagactatccnggatcgaccctagtcctccatccctcccgtgtcctgctntctggtagagtacaggtctaccacatctacggtggccgggacaagtcagactctatacgcngtacttaatttaagtgtactanacgacaagtaaacgaacggaacgtaccctaaactcgtgtactacgtattacgtactacttacgtagttacggtaacgtacggtacggtactaacgtacggtaacggtaccgtaggtacgggagtacggtaggtacgtcggtacggggaaacttacggttaattcccgaacgttcctaactaaccgttataccaaggtctaacgttacgtacaaccgttaacgtaacggttaattttaacgtttaacggtaacttttaccgtacttacggtaactacggtaataccgttaaccgtcccgtaaccgttacgacggttaccgtacggaacgaggttaaacgtagaaacgtaccgtaaagcgttaaggcggtctacgtacaccggtacttcgttaccgttctaacgttcctaccccg

SEQ ID NO: 12721 - DNA, 712 bp, Homo sapiens
  misc_feature: GYAE6OF01C6BC8.2.72.G06.1.454.CMB.1.raw
  modified_base (194)..(194): a, c, t, g, unknown or other
  misc_feature (194)..(194): n is a, c, g, or t
  modified_base (678)..(678): a, c, t, g, unknown or other
  misc_feature (678)..(678): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcctccatcctccctgtctgcatctgtagganacagatccaccatcacttcggccgggactaagtccagacgactagttagcaagtaccttaattttaaacgttggtacttacgaagactaaacggaaaccgtaagggaacccgtacccctaaaactccctagtaacttacttacgtttacgtaacgtactccgttaaggtttacgaacgtaaacggtccgggtaccctagtacggtaacggttcgtaggtcggacgtacggtaggtacttcggtacgggactaacggttactttaccgtaccttaccgtaccaaccgtactacgaacgtacctacgttccgtacgaacctaaccgtagttaagttactttacgaaccttaacgttactacgtacgtaaccaacgtacgtaaccgttaaccgtcccgttaaccccggtaggtacccggttaccggaccggtaaacgggaacttaaacgggtacgaactaaccggaaacgtacgtcggcgtccgtanacccgtaacgtacttcgttcttaccgtctacccg

SEQ ID NO: 12722 - DNA, 776 bp, Homo sapiens
  misc_feature: GYAE6OF01B3Y7A.2.72.G06.1.454.CMB.1.raw
  modified_base (523)..(523): a, c, t, g, unknown or other
  misc_feature (523)..(523): n is a, c, g, or t
tcagacgctcgacacacgaccggtgctcgatttagctacgactgcaagggaaaggggagtctcagtcaggacacagcatggacatgagggtccccgctcagctccgtggggctcctgctactctggctccgaggtgccagatgtgacatcctgatcgacccagtcctccatccctccctgtctgctatcgtgtaggagacgagtacgtccaccatccgtacgttcggccgggtacaaacgtcgagacgtctaattacgactaggtactttaaagttttaaacgttggtaataccgaagaaccgtaaacggaaaacccggaacggggtaaaacccgtacccccttaaaactccgttagtaacttaccttaagttaccgttaactaccgttaaccgttaggtttacgaacggtaaacggggttccgggtaccctaagtacgggtaacgttcgaaggggtcggacgtagggtagtacgtacggtaggggactacggttacttaccaccgttcctaacacccgttanaccgtacggtacctacggttccagtaaccgttaacgtaggttaacgttacttttaccggaaacctttaactttaccgttaagtccgttaacctaacggttacgtaaccttaccgtaaccccgttacccggtagggttacccggttaccggaaaccgtaaccggggaaccgtaaggttacgtaaaaccctcggtaaaaccgtggttacggtacgtcgactacgaaccttggtaccttgttaacctcccgtaccg

SEQ ID NO: 12723 - DNA, 742 bp, Homo sapiens
  misc_feature: GYAE6OF01A988Y.2.72.G06.1.454.CMB.1.raw
  modified_base (189)..(189): a, c, t, g, unknown or other
  misc_feature (189)..(189): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcctccatccctccctgtctgcattcnggtaggagacaggacgtccaccatcacgttcggccgggacaagtcaggagctagttagctagtactttaaattttaacgttggtaactcgacggaccgtaaaacggaaaccggaacggggtaaaacctaccccttaaaacgtccgtagtacttaccttaagttacgtttaaccatttacccgtagtttaccgaacggtaaacgggttccgggtacctaagtaccgtaaggttacgacgggtcggagtaggtcgggtattacggtagggtaactacgtttaacttcccgaccttaccgtaccgacctagtccgtaagctacggtactaccggaccttaacgtagtaacgttacgtttacaaccgttaacttacgtactacggtaaccaacgtagtaacgttacccgaacccggttacccgtacgggttaccgtaccgggaaacggtacgggtaaccggaaggttaccggtaaaactacggtaaaaccgtaggttaccgggtacgtaccgtaccgtaaccgtaccgttcgtacctttcgttcccgttccaccccg

SEQ ID NO: 12724 - DNA, 659 bp, Homo sapiens
  misc_feature: GYAE6OF01EQD4Y.2.72.G06.1.454.CMB.1.raw
  modified_base (97)..(97): a, c, t, g, unknown or other
  misc_feature (97)..(97): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (289)..(289): a, c, t, g, unknown or other
  misc_feature (289)..(289): n is a, c, g, or t
  modified_base (311)..(311): a, c, t, g, unknown or other
  misc_feature (311)..(311): n is a, c, g, or t
  modified_base (629)..(629): a, c, t, g, unknown or other
  misc_feature (629)..(629): n is a, c, g, or t
tcagacgctcgacacacgaccggtgctcgatttagctacgactgcaagggaaaggggagtctcagtcaggacacagcatggacatgagggtccccgntcagctcctggggctcctgctactctggctccggaggtgccagtatgtgacattcctgatcgacccagtcctccatccctccctgtctgcagtctgtagganacngagtcaccatcacttcgccgggacaagtcagagctagttagcagctaatttaagtggtatcagcaagaacagggaaactccctaaanccgtgacttcgtattgttaacncttccgtagtttcgactaaaggtcgggtacccagtacgtaaggttcaggtgcgaggtgactcggaggacagtattccgacttctacactatcacgtactacgtctacgacctaactagtaattactttcgaaccttaacgttactaacgtacgtaacctaacgtaacggttaacgttaaccgtacccggttaaccccgttacgggttacccggtttaaccgggaacccgttaaacgggaccggtaaacgggttaacggtaaaacgtacccgtaaaaccgggtaagtacgggttacgaccgttacggaccgttaaccgngtttaccgtacgtttcccgtacgttacccg

SEQ ID NO: 12725 - DNA, 705 bp, Homo sapiens
  misc_feature: GYAE6OF01CAV1H.2.72.G06.1.454.CMB.1.raw
tcagacgctcgacacacgaccggtgctcgatttagctacgactgcaagggaaaggggagtctcagtcaggacacagcatggacatgagggtccccgctcagcctcctggggctcctgctactctggctccgaggtgccagatgtgacatcctgatcgacccagtcctccatccctccctgtctgcattcgtggtaggagacagagtcaaccatcacgttggccgggacaaggtcaagagactattagcacgtattaatttaaagttggtaactcgaacgacgaaacgaaaccggaacggggaaaacctacccccttaaaactcctagtaactacttaagtacgtttaactactaccgtagtttagaacgtaaagggtccggggtacccaagttacgtaaacggttcacgggtacggagtaaggtcggaacgttcgtaggggaaccaggttaatttacccacttccctacaccctattacgaacgtacaacgtctacgtacctaaacgtacgtaagttacgtttacactttaaaccttactaactagtaacctaacgtaagtaaccgttaaccgaccgttaacccccgtaggtaaccggttaccggaaccggaaagggtaaccgtaaagggtaaacgtaaacgtaaccgaaacgtaaggtcgtacggacttacgactaaccgacttactacgttccgttctaaccg

SEQ ID NO: 12726 - DNA, 862 bp, Homo sapiens
  misc_feature: GYAE6OF01AD4O3.2.72.G06.1.454.CMB.1.raw
tcagacgctcgacacacgaccggtgctcgatttagctacgactgcaagggaaaggggagtctcagtcaggacacagcatggacatggagggtccccgctcagctccgtggggctcctgctactctggctccggaggtgccagatgtgacatcctgatcgacccagtctccactccctccctgtctgactattcgtaggtaaggagacgagacgtccaacctatcctacgttcggacccgggtactaacggtcgaaggacgtactaattacggacctagtactttaaagttttaaacgtttaggttatacgtaagaaccgaaacggtaaaacccggaacggggaaaacccgtaaccccccttaaaaccgttaccgttacgtaacctttacgttaacgtttacgttaactacttaccgttaggtttacggaacggtaaacgggttccggggtaccctaagttacggtaacggttacgtacggtacgggtacgtaggtaggtacgtcggtaacgggaacgtacgttacttacctaccttacctacctacctacgtacgtacgtacgtacgttacgtacgtaccgtaacctaacgggggggggggggggggggggttaactttaacgtttacgttaaccttaaccttaaccttaacgttacgtaaccgtaacgtaacgttaaccgttaacccgttaacccggttaaccccggttacccgggttaaccggttaccgggtaacccgggtaaaccgggtaaaccgggtaacgggtaaaccggtaaacgtaaaccgtaaaccgtaacggtacggtcggtaccgtacgtaccgtaccgtacgttaccgttaccgttccgttccgttacccg

SEQ ID NO: 12727 - DNA, 849 bp, Homo sapiens
  misc_feature: GYAE6OF01E5NZ7.2.72.G06.1.454.CMB.1.raw
tcagacgctcgacacacgaccggtgctcgatttagctacgactgcaagggaaaggggagtctcagtcaggacacagcatggacatgagggtccccgctcagctccgtggggctcctgctactctggctccgaggtgccagatgtgacatcctgactcgacccagtcctccactccctccctgtctgctatcgtaggtaggacgacgagacgtaccacctatccgaccgttcgggaccccgggacaacgtcgaaggtacgactaagttacgacgtaaggttactttaaagttttaaacgttggtaactacgaagaaccgtaaaccgggaaaacccggtaaacgggtaaaccccgtaacccccttaaaacgtccgttaacgtacttacgtatttaccggttaactacgttaccgttagtttacgaacggttaaccgggtccggttaacctagtaacgtaacgggttgacggtacgggtacagggttacgtacgtcgggttaacggtaacctacggtttaccttacctacccgttccgtaaccgtaaccggtactaacgggacgtaccgttaaccgttacgtaacccggtaaaccgtaacttaacgggtttaacgttttacctttaaaccgtaaaccctttaaaccttacccgtaaggtttaaccaaccggttaaaccgtaaccggtacctttaaacccggacccggtttaccccgggtacggtaaccggtaacccggaaacgggaaacgggttaacgtaaacggggtaaactaaacgtaaccggtaaccggtccgtaagggtcgtacccgtacaaccggttaacctgttcccgttatttccctcctacccg

SEQ ID NO: 12728 - DNA, 567 bp, Homo sapiens
  misc_feature: GYAE6OF01BUPQN.2.72.G06.1.454.CMB.1.raw
  modified_base (379)..(379): a, c, t, g, unknown or other
  misc_feature (379)..(379): n is a, c, g, or t
  modified_base (406)..(406): a, c, t, g, unknown or other
  misc_feature (406)..(406): n is a, c, g, or t
  modified_base (421)..(421): a, c, t, g, unknown or other
  misc_feature (421)..(421): n is a, c, g, or t
  modified_base (442)..(442): a, c, t, g, unknown or other
  misc_feature (442)..(442): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacgttcgccgggacaagtcagagcattagcagtcttaatttaaatggtatcagacaagaaaccgagggaaaccgacccctaaactcctagtactctatagttacactcctagtttcgactaaaggtcgggtacccatacgtaaggttcaggtgacagtgatcgtggactagtnttacactctacacatcgacactagtcncgacaacgtagtatntttagactaacttactacgtnacaagtagtacgttaaccaccgtaccccgttaggtaccgttccggacgtaacgggaccgtaggtaagtaacacgtaaacgtagtcggtcgtaccgtacgaccctacacttactcgttctctaccg

SEQ ID NO: 12729 - DNA, 741 bp, Homo sapiens
  misc_feature: GYAE6OF01BPBPJ.2.72.G06.1.454.CMB.1.raw
  modified_base (144)..(144): a, c, t, g, unknown or other
  misc_feature (144)..(144): n is a, c, g, or t
  modified_base (610)..(610): a, c, t, g, unknown or other
  misc_feature (610)..(610): n is a, c, g, or t
  modified_base (723)..(723): a, c, t, g, unknown or other
  misc_feature (723)..(723): n is a, c, g, or t
  modified_base (732)..(732): a, c, t, g, unknown or other
  misc_feature (732)..(732): n is a, c, g, or t
tcagacgctcgacacacgaccggtgctcgatttagctacgactgcaaggggaaaggggagtctcagtcaggacacagcatggacatgagggtcccccgctcagcctccgtggggccttcctgctactctggcctccgagggtcnccgagtagtgtacgactactcctgatcgaccctagtcctaccacgttccctccttgtctcgctatcgtaggtaggaacgacgagtacgtccaacctacgttcctacggttccggcccgggtaatacgtacgaaggtacgactagttacgcgtaacgttacgttttaaagttttaacgtcggtactacgaacgaaccgaaaacggaaacccggaacgggtaaaccccgtaccttaaaccgttcgtacgtaacttacgttaagttaccgtacctacttacgtagttacgaaccggtacggttccgacgtactaggtacgtcgtaggtcggatggtacgtagtagacggtaataccgttactccctactccgtaacctactaacgtccgaccgtagttacccgttacaccgttaaccgtaacgttaagttacgtttctttaccgaaactttaacgtttacaaccgttanaaccgtagtacgtaaccgttacgcccgttaacgtccgtacgtaaccggacgtaacggacgttaaggacgtaacgtacgtacggtgtcgtactacgacgacctaggttccttancctttccgntaaccccgg

SEQ ID NO: 12730 - DNA, 781 bp, Homo sapiens
  misc_feature: GYAE6OF01EULEM.2.72.G06.1.454.CMB.1.raw
  modified_base (201)..(201): a, c, t, g, unknown or other
  misc_feature (201)..(201): n is a, c, g, or t
  modified_base (509)..(509): a, c, t, g, unknown or other
  misc_feature (509)..(509): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgaccctagtcctccactccctccctgtctgctatcgtaggtagganacagacgtccacctatccgtacgttcggaccgggactaacgtcgaggtacgactaagttacgctaacgtactttaaagttttaaagttggtaattccgaagtacaacgaaaacccggaagggtaaaccctaccccttaaactccgtagtacttactaagttacgtaactacttaccgttagttcgaacgtaaacgggttcgggtaccctagtacgtaaacggttcgaggttacggacgtaggtacgtacgttacggtacggtaactaggttaacctttaccacttacctacccaacgtactcgaaccncgtaacgtctaacgaccgtaacttaggtaactttactttacaaccgtttaacctttacgtaacgttacgtaaccgtaacgtaacggttaacgtaccccggtaaccccggttaccccggttaagggtacccgggtaacggaacccgggtaacgggtaaaccgggtaacgggtttaaacgaaacccgttaacggaaaacccggttaggtacggtacccggagttacccggaccttaaccgttacttccgtacgtttaccccgtcgttaccccgg

SEQ ID NO: 12731 - DNA, 695 bp, Homo sapiens
  misc_feature: GYAE6OF01A92X9.2.72.G06.1.454.CMB.1.raw
  modified_base (242)..(242): a, c, t, g, unknown or other
  misc_feature (242)..(242): n is a, c, g, or t
  modified_base (658)..(658): a, c, t, g, unknown or other
  misc_feature (658)..(658): n is a, c, g, or t
  modified_base (675)..(675): a, c, t, g, unknown or other
  misc_feature (675)..(675): n is a, c, g, or t
  modified_base (680)..(680): a, c, t, g, unknown or other
  misc_feature (680)..(680): n is a, c, g, or t
  modified_base (687)..(687): a, c, t, g, unknown or other
  misc_feature (687)..(687): n is a, c, g, or t
tcagacgctcgacacacgaccggtgctcgatttagctacgactgcaagggaaaggggagtctcagtcaggacacagcatggacatgagggtcccccgctcagctccgtggggcttcctgctactctggctccgaggtgccagatgtgacatcctgatcgacccagtctccatcccgtccctgtctgcactcgtggtaggagacgaggactccaccatctacgttcggccggacagtcaaggntactagtacgcagtactttaattttaacgtttgtaattacgaagtaccgaaacggaaaacccggtaacggggaaaaccctacccccttaaaacgtccgtagtaccttacttagttaccgtttaacacgttaccgtagttacggaacgtaacggttccggtacctaacgtacgtaacgttggagtcggacgtaggtcggacttcggtaggactagtcttacacttccgactacctagacgtacgacgttacgtacctacgaacccttaacgtaagttaagtttactttaccggaacctttaacttaccttacttaccgaaacgttacgtaccggttaaccgttaacccgtacccggtacccgttacgtaccgggttacgacggtaacgacgtaagggtaccaagtaacgaacgttancggtcactagccttacncgttntccgttnccgttacc

SEQ ID NO: 12732 - DNA, 649 bp, Homo sapiens
  misc_feature: GYAE6OF01C1ZZ6.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcctccatccctccctgtctgcatctgtaggagacagagtcaccatcacgttcggccggcaaagtcagagactagttagctagtacttaagtttaaagttggtaattacgaagacgaacgaaaaccgtaacgggaaacctaccccttaaacgtcctagacttactatacgtactattccgtaagtttagacgtaaggtcgggtacccatacgtacgttcgaggtcggacgtagtacggtatcggtagggactaggtactttacgacttactaccgtaacctataccgacgtacgtacgtacgttacgaacctaaccgtagtaacgttactttacgaaccttaactttactaccgtataaccgaacgtacgttaactaccgtacccgtacccggtacggtaccgtaccgacggaacggtacgaaggtacgaaactacgaaacgtagtacggtgaccgagtaccacttatcgtacgtccttcgtacccg

SEQ ID NO: 12733 - DNA, 950 bp, Homo sapiens
  misc_feature: GYAE6OF01D4BNI.2.72.G06.1.454.CMB.1.raw
tcagacgctcgacacacgaccggtgctcgatttagctacgactgcaaggggaaaggggagtctcagtcaggacacagcatggacatgacgggtccccgctcagctccgtggggcctcctgctactcgtggctccgaggtcgccagatgtgacatcctagactcgaccctagtcctccactccctccctgtctgactacttcgtaggtaggaacgaacaggtacgtaccaacctactacctaccggttacgggacccgggataaacgtaccgaaggacgtacgtaagttacggactaacgttaacttttaaagttttaaaacggttggtaactacgaacgaacgaaacggaaacccggaacgggtaaaaccccgtacccccttaaaacgttccgtaggttaacttacgttaaagtttaccgttaaccttaacgttacccgttaagggtttaacggaacggtaaaccggggtttacccggggtacccttaacggttaaccggtaaaccggtttacggtaacgggttacgggacggtacgggttacgggtaacgttcgggtaacgggtaacgttaacgttacgtttacctaaccgttacccgtaaccctaacccgtacgtaaccgaccgtacgttaaccgttcccgtaaccgtaaccgttaaccggttaaagttaacgttttacgttttaaccgtaaacccttttaaaccgtttaaccgttaaaccgttaacgtaaacccgtaaacgttaacgggtttaacccttaacccggtaccccgggttaaccccgttacggggttaacccggtaccgggaaaccgggtaaccggggtaaaccgttaaacggggtaaactaaacccggtaaccgtaaaccggttaacggttacggtacccgtacctaccgaaccgtacttaccggttacggtttacccttaccgtacctttaaccccgg

SEQ ID NO: 12734 - DNA, 723 bp, Homo sapiens
  misc_feature: GYAE6OF01EHMQE.2.72.G06.1.454.CMB.1.raw
  modified_base (165)..(165): a, c, t, g, unknown or other
  misc_feature (165)..(165): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcnccatccctccctgtctgcatctggtaggagacagagtccaccatcacttcggacccgggctaaagtcaggagactattagcagtacttatttaattggtatcagacaagaaaccgaagggaaactacccctaaactcctagtactacttaactgttaccaattcctagtttagcggtaaacgcggaaaccttgaccgttaaagttccaagggttcgacgtagggtggtactcgggtacggtaacaggttactttacacgtttctacccaacgtactaacgactacgtacgttcgtacgtaaccctacgttaaaggaacttttagtttacgaaaccttttaaaccgttacctacgtttcgaaacctaacgtaggtttaaacctacggttaaacccccgtttaccccggtacggttaacccgggttccggaaaccgggtaacccggtaaacggtaaccggggttaaaacggtaaacccgtaaaccggtaaaaccgtacggttacggtaccgtacggtacgtacccaaccgtactttaccgttcgtttcccgtcttaaccg

SEQ ID NO: 12735 - DNA, 702 bp, Homo sapiens
  misc_feature: GYAE6OF01AI9I7.2.72.G06.1.454.CMB.1.raw
  modified_base (588)..(588): a, c, t, g, unknown or other
  misc_feature (588)..(588): n is a, c, g, or t
  modified_base (667)..(667): a, c, t, g, unknown or other
  misc_feature (667)..(667): n is a, c, g, or t
  modified_base (685)..(685): a, c, t, g, unknown or other
  misc_feature (685)..(685): n is a, c, g, or t
  modified_base (693)..(693): a, c, t, g, unknown or other
  misc_feature (693)..(693): n is a, c, g, or t
tcagacgctcgacacacgaccggtgctcgatttagctacgactgcaaggggaaaggggagtctcagtcaggacacagcatggacatggagggtccccgctcagctccgtggggcctcctgctactcgtggctccgaggtcaccagagtgtcgactactcctgactcgaccctagtcctccacttccccgtcctgtacctgactacttcgtaggtacggaacgactaagccttaccgaacctactccgtaacgttccgggacccgggaactaaggtccgaaagcgttacgacttacgagtacttacgtttaaatttaacgtggtactacgacgacgaaaacgacggaacggaaccctaccctaacgtcgtatactactatactaactcgtacgttaattacgaacgtacggccgttacacgtacgtacgtacgaggtgacggtaagcgtcgttaggacgtaattaccgtatccgacttactacactacgcaccgtataccgttgaaacccgtctaaacgttacgtagtttcctttaacgaagttttaccaacgttgaacctttaacgacgtttaactaacggttacccncccggttaacgtacggtacccgggacgtaaccgaacggttaacggagtaaccgaactacggtactcggtagacccgttnaacgcttacgacctttanaccgtttnacccggtac

SEQ ID NO: 12736 - DNA, 746 bp, Homo sapiens
  misc_feature: GYAE6OF01ASM77.2.72.G06.1.454.CMB.1.raw
  modified_base (137)..(137): a, c, t, g, unknown or other
  misc_feature (137)..(137): n is a, c, g, or t
  modified_base (719)..(719): a, c, t, g, unknown or other
  misc_feature (719)..(719): n is a, c, g, or t
tcagacgctcgacacacgaccggtgctcgatttagctacgactgcaagggaaaggggagtctcagtcaggacacagcatggacatgagggtccccgctcagctcctggggcctcctgcctactctggctccgaggtnccagatgtacgacattcctgatcgaccctagtctccactccctcctgtcagccatctgtaggacgactaggactacacctagcctagttcgcccgggactaagtccaggacggcctaagttacgccgaagtcctttaaagtttaagtacggtatctaacgacgaaccgtaaaaccggaacggggtaaacctaccccgttaaactccgttacgtaacgtacttaacgttacggtttaaccacgtttacccgttaagggttttaccgaacggttaaaaccgggttccgggttaccctaaccgttaacggtaaagggtttcccgtaagggtacggaacctagggtacggttaacgttacggtacgggtaacccgtaagttaccgttttcccgaaccttaccgtacctaaccgttacgaccgtacgtacgtacgttacgtacaacccgtacgttacgtaacgttacttaagttaaccgtaacttaccttacgtatacaaacggtgtaaccgtaccgtactcccggaattccgggtacgtacggaacgtacgaggtaacgacgtacgaaccgttagacgtcgacgtntaccgactcggtataccgtgactaccg

SEQ ID NO: 12737 - DNA, 748 bp, Homo sapiens
  misc_feature: GYAE6OF01DND4B.2.72.G06.1.454.CMB.1.raw
tcagacgctcgacacacgaccggtgctcgatttagctacgactgcaagggaaagggggagtctcagtcaggacacagcatggacatgagggtcccccgctcagctccgtggggctcctgctactctggctccgaggtgccagatgtgacatcctgatcgacccagtctcccatccctccctgtctgctatctaggtaggagacgagagtccacctaatctaccgtggacccgggacaaggtcaagagctaagttagcagtacttaagtttaaagttaggtaactacgaagaccaaacggaaaaccgaaggggaaacccgaaccccttaaaacctcccgtagaccttactaacttacgttaactaactaccgtaggttttacggaacgtaaacggtacggggtacccctaagtacgtaacggttacgtaggttcggacgtaggttacggaatccggtaggactaagttacttactacctactaccacgtactacgtacgtactagtacccgtacgtaaccgtaaaccgttagtaaacgttcgttttaacgaaccctaaacttttacctaacgtacgtaacccaaagtaacgtaacgtttaacccgtaacccggttacccccgtacgggtaacccgtaccgggaccgtaaacggggaaccgtaagggaacgtaaacgaacgtaaaaccggtaagttacggtacgtaccgtacaaccctacgttactacgttacgttcctacgttaccccg

SEQ ID NO: 12738 - DNA, 720 bp, Homo sapiens
  misc_feature: GYAE6OF01EKGNH.2.72.G06.1.454.CMB.1.raw
tcagacgctcgacacacgaccggtgctcgatttagctacgactgcaagggaaaggggagtctcagtcaggacacagcatggacatgagggtccccgctcagctccgtggggctcctgctactctggctccgaggtgccagatgtgacatcctgatcgacccagtcctccacttccctccctgtctagctatcgtaggtaggagacagtacgtaccaaccgtactacgtaccgttacgggacccggggaactaacggtaccaggacgtacgtaagttacgactacgttactttaaagtttaaagttggtaactacgagaacgtaaaacggaaaacccggtaagggaaaacccctacccctaaaacgttcctagttaacttacttaagttacgtaacctacgtaccgtttaggttacgaacggtaaaacggttccgggaaccctagtaacggtaaggttcgaggtcggactaggtacgtactcggtaggtactagtactttaccactacgtacctaacccgtgtacagtctatcgtacgacctaaacgtagttaagtttacttaacacctttaacttcgtaactacgtaactaacgagttactacccgaccgttacccggtagtacccgacggtacgaacggaagtaacgagtaaaacctacggaaacgttagcggtacgaccgacgaccctacgtccttagttacctcgttacgtaccccg

SEQ ID NO: 12739 - DNA, 937 bp, Homo sapiens
  misc_feature: GYAE6OF01BG4E6.2.72.G06.1.454.CMB.1.raw
tcagacgctcgacacacgaccggtgctcgatttagctacgactgcaagggaaaggggagtctcagtcaggacacagcatggacatgagggtccccgctcagcctcctgggggctcctgctactctggctccgaggtgccagatgtgacatcctgatcgacccagtctccactccctccctgtctgctatctaggtacggagacgagataccacctactcctacgttcggcccgggacgaacgtcgaggacactagttacgcgtaacgtacctttaagttttaaaacggtttaggttaactaccgtaacggaaccggtaaaaccgggtaaaaccccgggaaaaccggggtaaaaccccggtaaccccccccttaaaaccggttacccgttaggtaaccttacgtttaaccgtttaccgtttacgtttaaccctttaccggttaaacggtttttacggaaaccgggttaaaccgggggttaccggggttacccccgtaaacgttaacccggttaaacgggttaacccgggtagggttacgggtaccggtaaaggggtttacgggtaccggttcgggttaaccggggtaacgttaaacgtttaccgtttaaccctaccccgttacccttaacccggtaacccacctacccggtaaccgtccggtacccgttacgaccgttaccctaaccggtttaaaggtaacggtttaccttttacgaacccgttttaaacttccgtaaccgtttactaaccgttaacgtaaggtttaacccgttaaccgaacccccgggtttaccccgggttacggaccccggttaccggaaccggtaaccgggtaaaccggtagggtaaaccgtaaacgtaacccgtaaaggtaccgtcgggtaccgccgtaccacccgttaccgttacttaccgttccgttaccctcgttaccccg

SEQ ID NO: 12740 - DNA, 806 bp, Homo sapiens
  misc_feature: GYAE6OF01AOJ4V.2.72.G06.1.454.CMB.1.raw
tcagacgctcgacacacgaccggtgctcgatttagctacgactgcaagggaaaggggagtcgtcagtcaggacacagcatggacatgagggtccccgctcagctcctggggctcctgctactctggctccgaggtgccagatgtgacagtcctgactcgacccagtctccatccctccctgtctgcactcgtgagacacgagtagtccaccatccgacttcggccggaccaaagttccagtacgactagttacgccagtcttaagtttaaagtcggtaactcgagacctaagaaaccgaagggaaacctaccccgtaaactccgtagtactctagttagtacactaccgtaagtttcgaacgttaaggtccgggtacctagttcgtaaaggtccgaggtcgacgtaagtcggtagtaccgtaggggtactacggtactttccaacgttccctacgacctacgtaccacgttaccgtacggtaccttaccgggacctaaaccgtttagggaaactttacgttttacgaaaccctttaacgtttaacccttcgttaccgtaaaccgtaaacggttacccgttaaacgtttaacccgtaccccgggttaaacccggttaacccggggtaacccgggtttaaccccggggaaccgtaaacccggggggttaaccgtaaaaacgggggttccgggaaaaaccctttaaacccgggaaacggggtttacttacggggttaaccgtaaccccgtacggtaacccggtaccctttaacccgtaggttccccgtttacctaaccccgttcccggg

SEQ ID NO: 12741 - DNA, 500 bp, Homo sapiens
  misc_feature: GYAE6OF02GS6KD.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaactcctgatctatgttacatccagtttgcaaagtggggtcccatcaaggttcagtggcagtggatctgggacagatttcactctcacatcagcagtctgcaacctgaagtattttgactaacttactactgtacaacagacgttacacgtacccctggaccgttcggaccaagggaccaggtagaatcgaaacgaactggtagctgcaccatctcgtctctac

SEQ ID NO: 12742 - DNA, 507 bp, Homo sapiens
  misc_feature: GYAE6OF02HEBZD.2.72.G06.1.454.CMB.1.raw
  modified_base (269)..(269): a, c, t, g, unknown or other
  misc_feature (269)..(269): n is a, c, g, or t
  modified_base (504)..(504): a, c, t, g, unknown or other
  misc_feature (504)..(504): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcagaaaccagggaaancccctaaactcctagatctatgttacatccagtttgacaaagtgggtcccatcaaggttcagtgcagtgatctgggacagtatttcactctcacatcagcagtctgacaacctgaagtatttgactaacttactactagtacaacagtacgttacacgtacccctggaccgttcggacaacgggacaaggtagaaatacgaaacgaactgtacggctgactacagtctagttctntac

SEQ ID NO: 12743 - DNA, 533 bp, Homo sapiens
  misc_feature: GYAE6OF02JW89E.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcagaaaccagggaaagcccctaaactcctgatctatgttacatccagtttgacaaaggtcggggtacccatcaaggttcagtgcagtggatcgtgggacagatttcactctcaccatcagcagtctgacaacctgaagtatttgactaaacttactacttcgtacaactagtagttaccaacgttacccctagggtacgttaccggaccgaaacgggtaccaaggtacgaaataccgaaacgtaactaggtacggactagacaccatctacgtctactac

SEQ ID NO: 12744 - DNA, 536 bp, Homo sapiens
  misc_feature: GYAE6OF02HZ260.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaatggtatcagcagaaaccagggaaacgcccctaaactcctgatctatgttacatccagtttgactaagtgggtacccatcaaggttcagtggcagtggatcgtgggacagatttcactctcacatcagcagtctgacaacctgaatatttgactaacttactactgtacaacagtagttaccacgttaccccctggtaccgttccggaccgaaacgggaccgaaggtacggtaaactacgaaaacggtaactggtacggtactagaccaacctacgtctcgttacttctaacg

SEQ ID NO: 12745 - DNA, 651 bp, Homo sapiens
  misc_feature: GYAE6OF02FUR9S.2.72.G06.1.454.CMB.1.raw
  modified_base (240)..(240): a, c, t, g, unknown or other
  misc_feature (240)..(240): n is a, c, g, or t
tcagacgctcgacacacgaccggtgctcgatttagctacgactgcaagggaagggggagtctcaggtcaggacaccagccatggactactgagggttccccgcttcgagctcctggggctcctgctactctggactccgaggtgccgagtagtgtgacatccgttgtattgacccagttacgtccatcctcctgtactgcatctgtaggagtacaggagtcacgatcacttgggcccggnaagtcagacgcattagcagtcttagtttaaattggtaattacagtcttagaaacctagggaaacgtccccgttaaactcctagacttccggtaagttcgttacgattccgtagttttgacctaaagttcggggtacccaagtaccgtaaggtttccaaggttacggactaggttggatcgtaggggaacctagtatttcgaacgtcctactaccactcacgccagtactacgaccaaacctagtaacgttacttttgacttaacttactaactagtacaacgtagtacgttacgacgttaccccgtggtaaccgttaccggaccgaacgggtacctaaggtagtaactacgtaaacggaactaggtacggacgtacgacgtacctacgtacgttaggttccttacgttacg

SEQ ID NO: 12746 - DNA, 540 bp, Homo sapiens
  misc_feature: GYAE6OF02HHO2P.2.72.G06.1.454.CMB.1.raw
  modified_base (391)..(391): a, c, t, g, unknown or other
  misc_feature (391)..(391): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaaactcctgatctatgttacatccagtttgcaagtggggtcccatcaaggttcagtgcagtggatcgtagggacagatttcacttctcaccatcagcagtctagcaactgaagtntttgactaacttactactgtacaacagattacacgttaccccgtggtaccgttcggaccaagggtaacccgaaggtacggaaactaccgaaaacggaaccgttggtacggactaggacctaccgtacgttctacgtttccttactaccg

SEQ ID NO: 12747 - DNA, 537 bp, Homo sapiens
  misc_feature: GYAE6OF02G3U1H.2.72.G06.1.454.CMB.1.raw
  modified_base (385)..(385): a, c, t, g, unknown or other
  misc_feature (385)..(385): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaactcctagatctatgttacatcctagtttgactaaaggtggggtacccatacaaggttcagtggcaggtgatcgtgggacagtattcactctacaccatcagcagtcngaccaacctgaagtattttacgactaactttactactgtacaacagtaacgttacaacgttacccctggaccgttcggaccaacgggaccaaggtagaaactacgaaacggtaactggtagcctagaccacctattcctcgttacttctacc

SEQ ID NO: 12748 - DNA, 576 bp, Homo sapiens
  misc_feature: GYAE6OF02JB7US.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttcgccgggcaagtcagagcattagcagcttaatttaaattggtatcagcaagaaaccgagggaaacacccctaaactcctagatctatgttacatcctagtttcgacgtaaaggtcggggtacccatacgaaggttcaggtggacagtggatcgtagggacagtactttcactctcacctatcagctagtctagacaaccgtgaagttatttcgaccttaacttactactgtaacaactagtacgttaccacgttaccccgtggtaccgttcggacccgaagggtaccgtaaggtacgaaacgtaccgaaaacggtactaggtacggtactacgacccaaccgtatccgtcgttaccttacttaccg

SEQ ID NO: 12749 - DNA, 547 bp, Homo sapiens
  misc_feature: GYAE6OF02H99PE.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagccctaaactcctgatctatgttacatccagtttgcaaagtgggtccatcaaggttcagtggcagtggatctgggacagatttcactctcacatcagcagtctgcaacctgaagtatttgactaacttactactgtaccaacgtagtaagttacacgttaccccctagggaaccgtttcgggaccaaacggggaccgaaggtagggaaacttcgaaaaccggtaaccttaggtacggacttacggactacccgattaccgtcggttaccttactaacg

SEQ ID NO: 12750 - DNA, 522 bp, Homo sapiens
  misc_feature: GYAE6OF02H3I4I.2.72.G06.1.454.CMB.1.raw
  modified_base (408)..(408): a, c, t, g, unknown or other
  misc_feature (408)..(408): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccaggaaagcccctaaactcctgatctatgttacatccagtttgcaaagtggggtcccatcaaggttcagtggcagtgatctgggacagatttcactctcaccatcagcagtctgacaacctgaagtattttgactaacttactactntacaacagtagttacacgttaccccctggtaccgttcggaccaacgggaccaaggtacggaaactacgaaaacgtaacgtggtaggactggaccaccatctgttccttactacg

SEQ ID NO: 12751 - DNA, 510 bp, Homo sapiens
  misc_feature: GYAE6OF02G8A83.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaactcctgatctatgttacatccagtttgcaaagtggggtcccatcaaggttcagtggcagtggatctgggacagatttcactctcaccatcagcagtctgcaacctgaagtattttgctaacttactactgtcaacagagttacacgtacccctggaccgttcggaccaagggaccaaggtacggaaatacgaaacgtaactggtaggactgaccaccatctcgttctatacc

SEQ ID NO: 12752 - DNA, 577 bp, Homo sapiens
  misc_feature: GYAE6OF02JS72J.2.72.G06.1.454.CMB.1.raw
  modified_base (192)..(192): a, c, t, g, unknown or other
  misc_feature (192)..(192): n is a, c, g, or t
  modified_base (273)..(273): a, c, t, g, unknown or other
  misc_feature (273)..(273): n is a, c, g, or t
  modified_base (408)..(408): a, c, t, g, unknown or other
  misc_feature (408)..(408): n is a, c, g, or t
tcagacgctcgacacacgaccggtgctcgatttagctacgactgcaagggaaaggggaggtctcagtcaggacacagcatggacatgagggtccccgctcagctcctgggctcctgctactctggctccgaggtgccagatgtgacatcctgatgacccagtctccatcctccctgtctgcatctgtagganacagagtcacctatccacgttgccggtcaagtcagagcattagcagtctatttaattgtatcagacagaaccgagggaacnccctaaactcctgacttactattacgtacatcctagtttcgacaaggttcggaccatacaggttcaggtgacaggtcgatcgtagggacaggttatttacgcttacgtcaccatcaacgctatctagtacacgtntaagtatttcgacctattactatactcaacgtataacgttacctacgttaccccgtaggtaccgttaccgacgaaacgggtaccaggttacggaaccttaaccgaaaccggtaattccgggaggtttaacccgacgtactaccgactttggttacctcgttacctaccg

SEQ ID NO: 12753 - DNA, 633 bp, Homo sapiens
  misc_feature: GYAE6OF02F85AF.2.72.G06.1.454.CMB.1.raw
  modified_base (215)..(215): a, c, t, g, unknown or other
  misc_feature (215)..(215): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctcctgtctgcatctgtaggagacagagtcaccatcacttgccggnaagtcagagcattagcagctatttaaattggtatcagcagaaaccagggaaacgcccctaaactcctagatctatgttacatcctagtttgactaaaggtcggggtaccatcaaggttcagtggcagtgatcgtgggacagatttcgactctacacatcagcagtctgacaacctgaatatttagacttaacgttacctacttagtacctaacgacgtaacgttaaccgtaaccgttaacccccgtagggttaacccgtttacccggacccgggtaaaacgggtaacccgtaaaggggttaacggtaaaacttaacccggtaaaaaccgggtaaaccgttacggggttaaccggtaccgtacggtaaccctaacccgttaacgttacccgtttacggtttacccttaccgttaacccg

SEQ ID NO: 12754 - DNA, 682 bp, Homo sapiens
  misc_feature: GYAE6OF02FENR5.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcctccatccctccctgtctgcatctgtaggagacagacgtccaccatcacttcggccggacaagtcagacgctattagcagtacttaatttaaagtggtatcgagacaacgaaaccgagggaaaccaccccttaaactcctagacttacttatacgtactacgttccgtagtttacgaacgtaaacgggttccgggtaccctaagtaccgtaacggttcgtaaggtcggcgtaaggtggtacgttcggtacggtaacgtacgttactttacctacctacctacctacctataccgagacctacggttccacgtaaccgtaaccgtagtaaacgttttacttacgaaaccttttaaaccttaccgtaacgttacgtaaccaaacgttacgtaaccttaccgtaacccgttacccggtaggtaccgtaccgaaacggtacggaacctaagggtacaaacgtaccgtaaacggtctcggtaccgtactacgacctactacgttctccgttactacctacccg

SEQ ID NO: 12755 - DNA, 576 bp, Homo sapiens
  misc_feature: GYAE6OF02IBKK2.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaccatcacttgccgggcaagtcagagcattagcagctatttaaattggtatcagcaagaaaccgagggaaacgacccctaaactcctagactctatgttacactcctagtttcgacgtaaaggtcggggtacctatacgtaaggttcctagtgcgagtggatcgtgggacagtattcactctcacatcagcagtctcgactaacgtgaagttactttgacctaacttacctactagactaagtacgtaacgttaccaaccgttaccccgtaggtaccgttcggaccgaaacgggtacgaacggtacggaaactaccgtaaacgtacgttggtaacgtctacggactaaccgtagttaccgtcgtccttactaccg

SEQ ID NO: 12756 - DNA, 547 bp, Homo sapiens
  misc_feature: GYAE6OF02JCZ26.2.72.G06.1.454.CMB.1.raw
  modified_base (542)..(542): a, c, t, g, unknown or other
  misc_feature (542)..(542): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagcttatttaaattggtatcagcaagaaaccagggaaacgacccctaaactcctagatctatcgttacatcctagtttgacgtaaaggttcggggtacccatacgtaaggttcaggtggactagtggatcgtggacagtattcactctcacatcagcagtctagacaacgtagtaatagtttacgactaacttactactcgtacaacagtacttacacgttaacccctggtaccgttcggacgtaacgggacctaagggtacgaaactacgaaacgtactaggtacgcgtagacactgtctcgttcctntaccg

SEQ ID NO: 12757 - DNA, 534 bp, Homo sapiens
  misc_feature: GYAE6OF02GXDLI.2.72.G06.1.454.CMB.1.raw
  modified_base (273)..(273): a, c, t, g, unknown or other
  misc_feature (273)..(273): n is a, c, g, or t
  modified_base (398)..(398): a, c, t, g, unknown or other
  misc_feature (398)..(398): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcaagaaaaccagggaaacncccctaaactcctagatctatgttacatcctagtttgacaaaggtcggggtcccatcgaaggttcagtggcagtggatcgtgggacagatttcactctcaccatcagcagtctgacaactgaatntttgactaacttactactgtacaactagtacttacgacgtaccccgtggtaccgttcggaccgaaagggaccaagggtacgtaactaaccgaaacgtaactggtacgcgtacgaccacctatctcgttactctacc

SEQ ID NO: 12758 - DNA, 536 bp, Homo sapiens
  misc_feature: GYAE6OF02JIP3L.2.72.G06.1.454.CMB.1.raw
  modified_base (417)..(417): a, c, t, g, unknown or other
  misc_feature (417)..(417): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaactcctgatctatgttacatccagtttgcaaagtggggtcccatcaaggttcagtggcagtggatctgggacagatttcactctcaccatcagcatctgacaacctgaagtatttagctaacttactactgtacaacganacgttacagtaccccttaggtaccgttcggaccaacgggaccaaggttacggaaatccgaaaaccgtaaacgtacggtacggtacgtacgcaccgacttccgtcgttacttactaaccg

SEQ ID NO: 12759 - DNA, 536 bp, Homo sapiens
  misc_feature: GYAE6OF02G6LUC.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaaactcctgatctatgttacatccagtttgcaaagtggggtcccatcaaggttcagtggcagtggatcgtgggacagatttcactctcacatcagcagtctagacctaacctgaagtatttgacctaacttactactgtacaacagtacttacacgttacccctggtaccgttcggaccgaaacgggaccgaagggtaggaaactacgaaaacgtaacgtggtacggtctagacctacctattcttacgttctactaccg

SEQ ID NO: 12760 - DNA, 673 bp, Homo sapiens
  misc_feature: GYAE6OF02IV4PW.2.72.G06.1.454.CMB.1.raw
tcagacgctcgacacacgaccggtgctcgatttagctacgactgcaagggaaagggggagtctcagtcaggacacagcatggacatggacgggtccccgctcagctccgtggggctcctgctactctggctccgaggtgccagatgtgacatcctgatcgacccagtcctccatccctccctgtctgcatctgtaggagacagagtcaccatcacttcggccgggacaagtcagagctattagcagtacttaatttaaagttggtatcagacaacgaaaccgaagggaaaccgacccctaaactcctagatctatagttacatcctagttgacgtaaggtcgggtacccatacgtaaggttcaggtcggctaggtggatcggtagggactagtactttacgaccttctacaccgtactacgacgtacgtacgttccttacgaaccctaaccgttaaggtaaacgtttagtttttacgaacctttaaacctttaaccttaaccgtgtaaccaaacgtaacgttaacgttaacccgtaccggttaacccccgttgggttaacccggtttccgggaaaccggtaaacgggtaaccgtaacgggtacgtaaacgtaccgaaaacggtacgtagggtcgtaccgtacgtacctacgtacttcgtcgttacctctaccg

SEQ ID NO: 12761 - DNA, 550 bp, Homo sapiens
  misc_feature: GYAE6OF02F95RL.2.72.G06.1.454.CMB.1.raw
  modified_base (217)..(217): a, c, t, g, unknown or other
  misc_feature (217)..(217): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggnaagtcagagcattagcagctatttaaattggtatcagcagaaaccagggaaagcccctaaaactcctagactctatgttacatccagtttgcaaagtcggggtcccatcaaggttcagtggcagtggatctgggacagatttcactctcaccatcagcgctgcagcctgaagattctgcaaacttactattgtacagtacgtttctgtatttcctttcccgcgtcctacgttttcggaccgtacgggggaacctaagggtaacgaacggtaactaaccgaaaaccggtaacttcgggtacgggaccgttacggaccctaacccgtattcccgg

SEQ ID NO: 12762 - DNA, 532 bp, Homo sapiens
  misc_feature: GYAE6OF02GZQ6D.2.72.G06.1.454.CMB.1.raw
  modified_base (410)..(410): a, c, t, g, unknown or other
  misc_feature (410)..(410): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctaatttaaattggtatcagcagaaaccagggaaacgacccctaaactcctgatctatgttacatccagtttgacaaagtcggggtaccatcaaggttcagtggcagtgatcgtggacagattcactctcacatcagcagtctgacactagaagtatttgactaacttactactntacaacagtacgttacaccgtaccccgtaggtaccgttcggacctaacgggactaagggtacgaactaccgaaacgtaacgtacggtcgtacgtgaccacctagtcctgttacttactaccg

SEQ ID NO: 12763 - DNA, 841 bp, Homo sapiens
  misc_feature: GYAE6OF02JFO37.2.72.G06.1.454.CMB.1.raw
tcagacgctcgacacacgaccggtgctcgatttagctacgactgcaagggaaaggggagtctcagtcaggacacagcatggacatgagggtcccgctcagctcctgggctcctgctactctggctccgaggtgccagatgtgacatcctgatgacccagtctccatcccttccctgtctgcacttcgtgtaggacaccagtagtcaacccattccacttcggacccggggtacaacggttcaagagcctaattacgctacgactaatttaaacttggtaattaccgtagtacaacgaaaccgtaagggtaacgaaccccttaaaactcccttaggtaactacgtaactttacgttaacctacttacccgtaagtttacgtaaccggtaaacggttacgggggttacccaattaccggtaaacggttttacaaacggtttcgggacctaacgggtacggttaagttaccggtaggggtacctaacggtacgtttaccgtacttaccgttaccgaaccttacgttaccgaaggtccacggtttaccgttaggacccttaaaccgtaaccggttaaaggtttacgttttaacgggaaccctttaaaccgttaaaccgtttaccgttaacggtttaacccaaacggttaacggtaaccgtttaaacccggtaccggtttaaccccccggtaagggtttaccccgtttacgggtaacccggaaaacggggttaacccgtaacggggttaaacgtaaccggtaaccggtaaacggtaaacccttacgggtaacggtacgttaccgaacctaacccgtacgttacgtacgttacccgttactaacccg

SEQ ID NO: 12764 - DNA, 665 bp, Homo sapiens
  misc_feature: GYAE6OF02G4TSS.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcacatcacttgccgggcaagtcagagcatagcagctaattaatggtatcagcaagaaaccagggaaacaccctaaactcctagatctatcgttacatcctagtttcgacgtaaacggtcgggtaccctagtacgtaaaggttcaagttggacgtagtaggagtcgtagggaactagtactttaccgacttactaccaacctactacaacgtcacgttctacgacctaaaccgtagaaacgttagttttacgaacttaactttaactaactacgttaacaaactaacggtaacgttaaccgtaaccgtaccccggttagggtaacccgtttaaccggaccggtaaaacgggtacccgtaaaacgggtacggtaaaactaaaccggaaaacccgtaagttacgggtacggtaccgttacggaacccgttaaccgacggtttaccttaccggttaccttaagtaccccc

SEQ ID NO: 12765 - DNA, 523 bp, Homo sapiens
  misc_feature: GYAE6OF02FYBII.2.72.G06.1.454.CMB.1.raw
  modified_base (425)..(425): a, c, t, g, unknown or other
  misc_feature (425)..(425): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctaatttaaattggtatcagcaagaaaccagggaaacgcccctaaactcctagatctatgttacatcctagtttgactaaagtggggtcccagtacgtaaggttcagtgcaggtggatcgtgggacagtatttcacttctcaccatacagcagtctgactaacctagagtatttgactaacttactactntacaatagtagttacacgtacccgtaggtacgttcgacgaagggaccgaaggtacgaactacgaaacgaactggtgacgtgacactatctgtctctac

SEQ ID NO: 12766 - DNA, 585 bp, Homo sapiens
  misc_feature: GYAE6OF02HWC2L.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatccacttcgccgggacaagtcagagctattacgcagcttaatttaaatggtatcagacaagaaaccgaagggaaacgacccctaaactcctagactactatagttacacttcctagtttagacgtaagtcgggtaccatacgtaagttacgagtcggactaggtagatacgtgggtactagtactttcgacttcacaccagtcacgctacgtctacgacctaacgtagtaaagttatttcgactaacttactacgtataccaacgtacgtaacttaaccgacccgttacccgtaggtaccgttcggaccgaacggacgtaaggtagaactaacgaaacgacgtggacgtactacgactactacgtactcgttactataccc

SEQ ID NO: 12767 - DNA, 527 bp, Homo sapiens
  misc_feature: GYAE6OF02FGRQX.2.72.G06.1.454.CMB.1.raw
  modified_base (217)..(217): a, c, t, g, unknown or other
  misc_feature (217)..(217): n is a, c, g, or t
  modified_base (269)..(269): a, c, t, g, unknown or other
  misc_feature (269)..(269): n is a, c, g, or t
  modified_base (300)..(300): a, c, t, g, unknown or other
  misc_feature (300)..(300): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggnaagtcagagcattagcagctatttaaattggtatcagcagaaaccagggaanccctaaactcctgatctatgtacatcagttnacaagtgggtccatcaaggttcagtgcgagtgatcgtgggacagtattcactctcacctatcagctacgtctacgactaacctgaagtattttcgacttaacttactactgtacaacagtagttacacgtacccctggtaccgttccgaccgacgggaaccaaggttacgaaactcgaaaacgactaggtcggacgtacggacacctagttctcgttcttactaccg

SEQ ID NO: 12768 - DNA, 635 bp, Homo sapiens
  misc_feature: GYAE6OF02GFH8J.2.72.G06.1.454.CMB.1.raw
  modified_base (218)..(218): a, c, t, g, unknown or other
  misc_feature (218)..(218): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttggccgggnaagtcagagcattagcagctatttaaattggtatcagcagaaaccagggaaacgcccctaaactcctagatctatgttacatccagtttgacgtaaaggtggggtacccatactaaggttcagtggacaggtggatcgtgggaactagtatttcactctcaccatcagcagtctgaccaacctagaatatttacgacttaaactttactacttacgtacctaaactaacggtaacgtttaacctaaccgttaacccccgttacgggtaacccggtttccgggaacccggtaaaaccggggaacccgtaaacggggttaaggaaaaccgtaaccgtaaaaacccggtaacttacgggtacggtaccgtaggtacccgaaccgtacgttacccgttacgtttacccgttacttaacccg

SEQ ID NO: 12769 - DNA, 570 bp, Homo sapiens
  misc_feature: GYAE6OF02IUN9V.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcaagaaaccgagggaaacgacccctaaaactcctagatctatgttaacatcctagtttcgacgtaaggtggggtcccatcaaggttcaggtggcgaggtgatcgtggactagtactttcactcctacacctatacagctagtcctagacctaacgtagaacgttatttagaccttaactttactactcgtaccaactagtaacgttacgaccgttaccccgtggtaccgttccggaaccgtaaacgggacgaaggtacgaaactacgaaacgtaacgtggtacgtcgtcgacaccgtactcgtcgttcctctaccg

SEQ ID NO: 12770 - DNA, 601 bp, Homo sapiens
  misc_feature: GYAE6OF02IDEIA.2.72.G06.1.454.CMB.1.raw
  modified_base (362)..(362): a, c, t, g, unknown or other
  misc_feature (362)..(362): n is a, c, g, or t
  modified_base (436)..(436): a, c, t, g, unknown or other
  misc_feature (436)..(436): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtcctccatccctccctgtctgcatcgtgtaggagacagagtcaccatcacttggccgggacaagtcagagctattagcagctaattaaatggtatcagcaagaaaccgagggaaacacccctaaactcctagatctatgtacatcctagttcgacgtaaaggtcgggtaccatacgaagttcagtgcaggtgatcgtgganagtacttcactctacactatcacgcgtagtctacactaacctagaagttatttcgaactaacgttactaacgtntaacaaacgtaagtaacgttaaccgtaaccgttaacccccgtaggtaaccgttcccggaaccgaaaacggggtaccgaaacgggttaacgaaacgtaacgtaaaaccggtaagttacggtacggtctacgtaccgtaaccacgttcgttacttccgttactaccg

SEQ ID NO: 12771 - DNA, 575 bp, Homo sapiens
  misc_feature: GYAE6OF02G5QU8.2.72.G06.1.454.CMB.1.raw
  modified_base (385)..(385): a, c, t, g, unknown or other
  misc_feature (385)..(385): n is a, c, g, or t
  modified_base (443)..(443): a, c, t, g, unknown or other
  misc_feature (443)..(443): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagcttatttaaattggtatcagcagaaaccgagggaaacgcccctaaactcctagatctatgttacatcctagtttgacgaaaggttcggggtacccatacgtaaggttcaggtggactaggtggacgtcgtagggacagtatttcacttcncaccatacagctagtctgacaactgaatatttacgacttaacttactactctaccaanagtacgttacgaccttacccctcgtaccttactaccgtttcggacgggtaacgggaccgtaagggtacgggaacgtaacgtaaccgaaaacgtcgtaggtacggtcgtaccgacctacctacgtccgttacg

SEQ ID NO: 12772 - DNA, 546 bp, Homo sapiens
  misc_feature: GYAE6OF02GYFFQ.2.72.G06.1.454.CMB.1.raw
  modified_base (276)..(276): a, c, t, g, unknown or other
  misc_feature (276)..(276): n is a, c, g, or t
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttggccgggcaagtcagagcattagcagctaatttaaattggtatcagcaagaaaccgagggaaacncccctaaatcctagatctatgttacatcctagtttgactaaaggtcggggtacccatcgtaaggttcagtggcaggtggatcgtagggacagtattcactctcacatcagcagtctgacaaccgtagaagtatttagacctaacttactactgtacaatagtaacgttacaccgtacccctaggtaccgttccggaccgaagggaccgaagggtacgaacgtacgaaacgactggtacgaccgtagaccactactctcgttccttatacc

SEQ ID NO: 12773 - DNA, 549 bp, Homo sapiens
  misc_feature: GYAE6OF02HMVSP.2.72.G06.1.454.CMB.1.raw
  modified_base (272)..(272): a, c, t, g, unknown or other
  misc_feature (272)..(272): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcaagaaaccagggaaacncccctaaactcctgactctatgttacatcctagttgacaaaggtcgggtcccatcaaggttcagtggctaggtggatcgtgggacagtatttcacttctcaccatcagcagtctgaccaacctgaagtatttacgactaacttactactatacaacagtacgttaccacgttaccccgtggtaccgttccgggaccgaacgggacctaagggtacggtaaactaccgaaacggaacgtaggtacggtctaggaccacctatctacgttcttactacg

SEQ ID NO: 12774 - DNA, 592 bp, Homo sapiens
  misc_feature: GYAE6OF02HADC0.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaccatcacttggccgggcaagtcagagcattagcagcttaattaaattggtatcagacaagaaaccagggaaacgacccctaaactcctagatctatgttacatcctagtttgactaaaggtcggggtaccctatacgtaaggttacaggtggacaggtggatcgtagggaacagtattcactcgtacacatacagcagtctcgactaactagtaatacgtttagaaccttaacgtactacgtacaactaacgtaagtaccgtaacgtacccgtaccgtacggttaccggaccggtaaacggaaccggtaacgtaacggtaagtaactaacggaaacgtacgtacggtacgtacgtacgtacctacgtcttacgtacttacctattacccg

SEQ ID NO: 12775 - DNA, 765 bp, Homo sapiens
  misc_feature: GYAE6OF02JXA69.2.72.G06.1.454.CMB.1.raw
  modified_base (227)..(227): a, c, t, g, unknown or other
  misc_feature (227)..(227): n is a, c, g, or t
tcagacgctcgacacacgaccggtgctcgatttagctacgactgcaagggaaaggggagtctcagtcaggacacagcatggacatgaggtccccgctcagctcctggggctcctgctactctggctccgaggtgccagatgtgacatcctgatgacccagtctccatccctccctgtctgcatctgtaggagacagagtcacatcacttgccgggacaagtccagancattacgcagacttaagtttaatggtatcagtacaagaaaccgaggaaactaccccgaaacttccgtagacttactatacgttaacactaccgtagtttagaaccgtaaaggttccggggtacccaacgttacgtaaacggttacgaagttcggacgtaacggtcggtaatcggtaggggaaccttaggtaacctttaccgaccttccgtaaccgtacctacgttacccgaagtacccgttaagtcccgtagtaacccgtaaccgtacggtaaacttacggttttacaaaccttaaccgtttaacttaccgttacgtaaccctaaaagtacgttaaacggttacccgttaaccgttaacccccgtaggggtttaaaccccggttacggaccccgggtaaaacgggtaacccgtaaaggggttaccgtaaaacggttacccgaaaaaccgggttaccgttaccggtacggttaaccgtttacccgaaccgttaacccgtacggtttacccgttagttttacccgaccctttaacccggg

SEQ ID NO: 12776 - DNA, 562 bp, Homo sapiens
  misc_feature: GYAE6OF02HXW43.2.72.G06.1.454.CMB.1.raw
  modified_base (400)..(400): a, c, t, g, unknown or other
  misc_feature (400)..(400): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctaatttaaattggtatcagcagaaaccagggaaacgacccctaaactcctagactctatgttaacattccagtttgacaaaggtcggggtacccatctaaggttcagtgcaggtggatcgtgggacagtattcactctcaccatcagcagtctgcaactgaatntttagctaaactttactaactcgtacaaacgtagtacgttactaccgttaccccgtgggtaccgtttcgggaccaacgggtaccgaagggttaggaaactaccgaaaacggtaaccttaggacggtacgtagaccaccgtaatccgtacgttcttacgtacc

SEQ ID NO: 12777 - DNA, 586 bp, Homo sapiens
  misc_feature: GYAE6OF02FQF4H.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttgccgggcaagtcagagcattagcagctatttaaattggtatcagcagaaaccagggaaagcccctaaactcctgatctatgttacatccagtttgacaaaggtggggtacccagtacaaggttcagtggcagtggatcgtggacagtattcactctacaccatcagcagtctgacaaccgtgaagtattttgactaaacgtttactacgttagtaccaactaaggtaagtttaccgtacgttaacccccgtagggtacccgtttcggacccgtaaacggggaaccctaagggttacggaaacgtaccgaaaaccggtaacgtacggtacggtaccgtagaccgtaccgtacgttctacgttaccttacttaacccg

SEQ ID NO: 12778 - DNA, 753 bp, Homo sapiens
  misc_feature: GYAE6OF02HVTXE.2.72.G06.1.454.CMB.1.raw
  modified_base (270)..(270): a, c, t, g, unknown or other
  misc_feature (270)..(270): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtcctccatccctccctgtctgcatctgtaggagacagagtcacatcattgccgggacaagtcagagcattagcagctaatttaatggtatcagcagaaacagggaaacnccctaatcctagatctatcgttacactcctaagtttacgacgtaaacggtcggggtaccctagtacgtaaaggtttccgaggtcggtacgtaggtaggtacgttcggtacggggtaactaagtacttttaccgaaccttactacctaacctaacttaccgaagtaccgtaacgttacgtacgtaaccgtaaacccgtacggtaaacgttaacgttttaacgtaccttaaaacttttaaccgtaccgttacggtaacctaaacgtaacgttaaggtttaaccctaaccggttaccccccgttaaggggttaacccggttttacccgggaaacccgtaaacggggtaacccgaaaccggggttaacgggtaaaacgttaacccggtaaaaaccggtaaccggttaacgggtaccggttaaccgttaccgaacccggtacccgttaacggttacccgtttaccggttacccgtttaccttaacccg

SEQ ID NO: 12779 - DNA, 685 bp, Homo sapiens
  misc_feature: GYAE6OF02JASMP.2.72.G06.1.454.CMB.1.raw
  modified_base (214)..(214): a, c, t, g, unknown or other
  misc_feature (214)..(214): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtagagacagagtcacatcacttgccggnaagtcagagctattagcagctatttaaagttggtatacagacaagaaaccgagggaaacgacccctaaactcctagtactctatgtacatcctagtttacgacgtaaacggtcggggtaccctagtaccgtaacggttacgaggttcggctaggtaggtacgtacggtagggactaggttaactttcgaccgtttctaccgtacctactacgtacgtctacgtctacgtacctaaaccgtagtaaagttagttttacgaccttaaacctttaccgtaacttacgtaacctaaacgtacgtaaacgtttaacccgaaccgttaaccccccggtagggttaacccgttaccgggaacccggtaaacggggtaacccgtaagggtacgtaaacgtaacggtaaaaccgtaacgttacgggtcgtacgtacgtaccgtacgtacgttaccgtacgtttaccttaccgttaacccg

SEQ ID NO: 12780 - DNA, 652 bp, Homo sapiens
  misc_feature: GYAE6OF02JJLFX.2.72.G06.1.454.CMB.1.raw
  modified_base (311)..(311): a, c, t, g, unknown or other
  misc_feature (311)..(311): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtcctccatcctccctgtctgcatctgtaggagacagagtcaccatcacttggccgggcaagtcagagcattagcagcttatttaaattggtatcagcaagaaaccgagggaaacgacccctaaactcctgatctatgtacatcctagttnacgaaagtcgggtaccatacgtaggttcagtggcaggtgtatcgtagggactagtatttcacgttcctacacctatacagtacgagttctagacctaaccgtagtaaacgttcgttttacgaccttaaacgtttacctacttacgtacctaaacgtacggttaacttaacccgtaacccgttaacccccgttagggtacccggtttaccgggtaaccggtaaacggggtaacccgttaaggggtaaccgttaaacgtaaccgtaaaaccggtaacgttacggtacggtaccgtacggaacccgtaccgtaacgttccgttacgttaccttacccttaaccg

SEQ ID NO: 12781 - DNA, 740 bp, Homo sapiens
  misc_feature: GYAE6OF02GF72J.2.72.G06.1.454.CMB.1.raw
tcagacgctcgacacacgaccggtgctcgatttagctacgactgcaagggaaaggggagtctcagtcaggacacagcatggacatgagggtccccgctcagctccgtgggctcctgctactctggctccgaggtgccagatgtgacatcctgatcgacccagtctccatcctcctgtcctgactatctgtaggagactagatccaccatccattcggccggataagtcaagacgactagttacgacagtacttaagtttaaaagttggtaattacgaacgctaacggaaaaccgaacgggtaaaacgtaccccttaaaactacccgttagtactacttacttacggttaacctacttacctaggtttacgtacgtaaacgggttacgggggttacctaacgttacgtaacggtttacaaggttcggtacgttaacggtagggtaacgtcggtacgggtaacgtaacgttaggtttaccttaactaccgttaccacctacgtacgtacgttaacgtaccttacgtaaccagttaaacgtctttaggtaaccttaacgttacttacgtagttaacaacgtagacgttaacaccgttaacccgtccgttacctaccttacgttacccggtaggtaaccgggtaaccgtagggttacgtaagtaccgttaaaccgtaaacgtaacggttaccgttacgggtccttaacggcctaacccgttataccgttacgttcgtttaaccc

SEQ ID NO: 12782 - DNA, 706 bp, Homo sapiens
  misc_feature: GYAE6OF02HO0BL.2.72.G06.1.454.CMB.1.raw
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttcgccgggacaagtcagagcattagcagtcttaatttaaattggtatcagacaagaaaccgaaggaaacgacccctaaactcctagatctattagttacattcctagttcgacgtaaaggtcgggtaccctaatacgtaaggttacaggtggacgtaggtggatcggtagggactagtactttcacttctacctaacgatcgaacgtctacgtcgtacgaccgtaaaccttaggtaaagtttaacttttcgaacctttaaacgtttaacttaactaggtaacctaaagtaacggttaacgtttaaccctaacccgggttacccccgttaggggtacccggttaccgggaacccgtaaacggggaacccgtaaacggggttacggaaaaccgttaacgaaaaacccggtaacgtttaacgggtaccgggtaaccgttacggtaacccgtaacccgttacgtttacccggttacgtttacccgttacccgttaacccg

SEQ ID NO: 12783 - DNA, 666 bp, Homo sapiens
  misc_feature: GYAE6OF02GW86V.2.72.G06.1.454.CMB.1.raw
  modified_base (178)..(178): a, c, t, g, unknown or other
  misc_feature (178)..(178): n is a, c, g, or t
  modified_base (191)..(191): a, c, t, g, unknown or other
  misc_feature (191)..(191): n is a, c, g, or t
  modified_base (217)..(217): a, c, t, g, unknown or other
  misc_feature (217)..(217): n is a, c, g, or t
  modified_base (227)..(227): a, c, t, g, unknown or other
  misc_feature (227)..(227): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctcctgtcngcatctgtagganacagatcacctatcacttggccgganaagtcagganctatacgacagtacttaatttaaagtggtatcagtacaacgaaacgaggtaaaccgaccctaaatcctagactacgtatacgtactactctagttgaacgtaaggttcgggacctatacgtaacggttacgaggtcgtacgaagtcggaacttcggtaacgggaactaggttacttaccgtaactcgtacctactacgtacgagacgtcttacgtgacctaacgtagtaatttacgtttacgaaccttaaacgttaccgtaacgttacgtaaccaaaggtacgtaacgtttaccgtaaacccgtaccccgttagggtacccggttaccgtaacgggaaaccgtaaacggtaacggttacgtaaacgaacccggtaaaaacggtacggttcggttaacggcgttacgacctacgtatacgttcgttactacgttaacccg

SEQ ID NO: 12784 - DNA, 756 bp, Homo sapiens
  misc_feature: GYAE6OF02JJAH1.2.72.G06.1.454.CMB.1.raw
  modified_base (250)..(250): a, c, t, g, unknown or other
  misc_feature (250)..(250): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcctccattccctccctgtctgcatctggtaggagacagacgtcaccatctacgttcggaccgggacaagtcagacgacaattaacgngtacttaatttaattagtagtacacgacaacgaaacgaacggaacgaaccctaacctactagactactacgtagtactactacctacgttagtacgtaaacggtcgggtacccacgtacgtaacggttacgtagtacggtacgtaggtacggtagttacgtcgggtaagtaactaacgttttaccacccttaacctccttaaccgaacttcgaaccggtcgttacggtactcttaaaccggaaccctttaaggggtaattttaacgtttacgtacccttaaaaacctttccgtttaaacggtttacccgaactaaaacggtaaccgtttaacggttaccccttaaacccggtaccccgttaccgggtaacccgggggttaacctaaccccgggaaagggtaaaacccgaggtttaaacgggaaccttaaacggaaaccggtttaaccgagtcggtaccgacgttaacccaacggtttacttcgtcctttaacgtcctactacccgg

SEQ ID NO: 12785 - DNA, 818 bp, Homo sapiens
  misc_feature: GYAE6OF02FNTXI.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccggaggtgccagatgtgacatcctgatcgacccagtctccatccctccctgtctgctatctgtaggagacagacgtccacctatcctacgttcggcccgggacaacgtcaggacgctagttacgcagtacttaagtttaaagtttaggtattaccgagaaccgtaaacggaaaacccggaacggggtaaaccctaacccccgttaaaaccgtcccgtagtaacttaccgttaacgttacgtttaaccgtacgtttccgttaaggttttaccgtaacggtaaacgggtttaccgggggtaccctaacggttacggtaaaccggtttacgtacgggttacgggacggttagggtacggttaacgttacggtaggggtaactaaggtttaactttaccctaaccgttcctaccctaaccgtaagtacctacggtacgtacgttaccgtacgtaacccgttaaccgtagtaacgtttacgtttacgtaaccctttaaccgtttaaccgtacgttaccgtaaccgtaaacgttacggtaacgttaacccgtacccgttacccgtacgggtacccggtaccggaaccggtaacgggtaaccgtaaaggggtactaaccgtaacggtaaaccgtaaggtacggtacggaccgtacggacctaccggtagttcccgttacgtaccttaccgttacccg

SEQ ID NO: 12786 - DNA, 677 bp, Homo sapiens
  misc_feature: GYAE6OF02FQLMM.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtccaccatccacgttcggccgggacaagtcagagctagttagcagtactttaagtttaaagttggtatacgaagacgaacgaaaaccggagggaaaccgacccctaaacgtccgtagactacttagttacgttactacgttacctaggtttacgacgtaaacgggttccggggtacctagtacgtaaggttaccaggtcggacgtaggttacggacgttcggtagggaacgtagttactttaccgtaccttacgtaccaaccgtaaagtaacgtacgtacgtccgtacgaacctaaccgttaggtaacttagtttacgacttaaccttactactacgtacaacgtagttactaccgtaccgtaccccgtgggtaccgttacggtacgtaacggaacgtaagggttaacgtaactacgaaaccggttgtcggtacgtacgacgtaccgactacgttccgtgttaccttcgtacgttcccg

SEQ ID NO: 12787 - DNA, 883 bp, Homo sapiens
  misc_feature: GYAE6OF02IUSSM.2.72.G06.1.454.CMB.1.raw
  modified_base (184)..(184): a, c, t, g, unknown or other
  misc_feature (184)..(184): n is a, c, g, or t
  modified_base (753)..(753): a, c, t, g, unknown or other
  misc_feature (753)..(753): n is a, c, g, or t
tcagacgctcgacacacgaccggtgctcgatttagctacgactgcaagggaaaggggagtcgtcagtcaggacacagcatggacatgagggtccccgctcagctccgtgggctcctgcctactctggctccgaggtgccagattgtgacatcctgatgacccagtctccatcctcccgtgtacncgacacttcgttgtaaggacgtaaccagacggttccacctatcccgaacgtttcggcccgggggtaactaacggttccaaggaggcctaacgtttagaccagtacttaacgtttttaaaaccgttgggttaactaccgtaaggtaaccgaaacggtaaaacccggaacggggtaaaaccggtacccccttaaaaacctaccgttaaacgttaccgtaacctttaagttaccgttttaaaaccgacgtttaccccgttaaggtttttaacggaacccgttaaaacggggtttaccccggggggttaccccttaaaacggtttacccgttaaaaacggggtttttcccgtaaaacgggtttacgggtaaacccggtttaaggggtttacgggttaaccggttaaccgggtttacgggggtaaaacctaaacggggtttactttttaacccggaccttttaccggttaaccgtaacccgtaacgttacgtaacgtaccgtaacgttacgtacgtacctaaccgtaacgtaacgttatttacggtacttaacgttactacttacgtacctaanaacgttacgtataccgtacccgttacggtaccgtaccgtacaaccgggtacgaacggtacgtaaactacgaacggtaaccgtacggttcgtacgtacgaccgtacgtactacgtacgtactttaccgtac

SEQ ID NO: 12788 - DNA, 626 bp, Homo sapiens
  misc_feature: GYAE6OF02HIQVI.2.72.G06.1.454.CMB.1.raw
  modified_base (191)..(191): a, c, t, g, unknown or other
  misc_feature (191)..(191): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctcctgtctgcatctgtagganacagagtcacatcacgttcggccgggcaagtcaggagcaagttagcagtacttaatttaaagttggtatcagacaacgaaaccgagggaaacacccctaaactcctagtactactaagtacgttaacacttacccgtagtttcgacgtaaagggtccgggtacccaagtacgtaacggttcgaaggtcggacgtaggtggactacggtaggactagtacttcactctacactcacgagtctagttcacgactaaccgttagaacgttatttacgaccttaacgttactatcgtaacaacgtagtaacgttaccgtacccgttacccgttaggaccgttcggaaccgaacggtacgtaaggacgtaaacctacgtaaacgacgttcgggacgtacgtacgaccctacgtacgttacgtccttaccgtcctaacccg

SEQ ID NO: 12789 - DNA, 657 bp, Homo sapiens
  misc_feature: GYAE6OF02GNXZ4.2.72.G06.1.454.CMB.1.raw
  modified_base (97)..(97): a, c, t, g, unknown or other
  misc_feature (97)..(97): n is a, c, g, or t
  modified_base (192)..(192): a, c, t, g, unknown or other
  misc_feature (192)..(192): n is a, c, g, or t
  modified_base (223)..(223): a, c, t, g, unknown or other
  misc_feature (223)..(223): n is a, c, g, or t
tcagacgctcgacacacgaccggtgctcgatttagctacgactgcaagggaaaggggagtcgtcagtcaggacacagcatggacatgaggtccccgntcagctcctgggctcctgctactctggactccgaggtgccagatgtgacatcctgatgacccagtactccatcctcctgtctgcatctgtaggancagagtcacatcacttgccggcagtcagtanctattagcagtacttaatttaaagtggtatcacgacgaacgaaaccaggaaactccctaaactcctagtactactaagtcgttacatcctagtttgactaagtcggtccagtcgaagttcagtgacagtgatcgtaggactagtatttcgactcctacaccgtatacgacgtatacgttactacgtactaaccgtagtaagttacgttttagaaccttaactttaaccgtacgttacgtaacctaaacgtacggtaacgtttaaccgtaccgttaacccccgtagggttaacccggttacggaacccggtaaacgggtaacccgttaacgggtaacggttaaacgtaacccggaaaacggttacgttacgggtaacggtaccgttaccgaccgtaaccgtacgttaccgtttacggtttaccctaacgtttccc

SEQ ID NO: 12790 - DNA, 689 bp, Homo sapiens
  misc_feature: GYAE6OF02GBWPV.2.72.G06.1.454.CMB.1.raw
  modified_base (192)..(192): a, c, t, g, unknown or other
  misc_feature (192)..(192): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtagganacagagtcaccatcacttgccgggcaagtcagagcattagcagacttatttaaattggtatcagacaagaaaccgagggaaacgacccctaaactcctagactctatcgttacactcctagtttacgacgtaaacggttcggggtaccctatacgtaaggttcgaggtacggcgtaggtggtaactcggtagggtaactaggttactttacaccgtacctccgaacctaataccgagtcctacgttactacggtaaccctaacccgttaaggtaacgtttacgttttacgaaccctttaaacgtttacctaacgttacgttaaccaaacgtagttaacgtttacccgtaacccgttaccccgttacgggtaaccggtttaccggaacccggtaaagggtaacccgtaagggtacgaaaacgtaccgaaaacggttacgtacgggtacgtaccgtacggacctacctacgttaccgttacgttacttaccgttacccg

SEQ ID NO: 12791 - DNA, 640 bp, Homo sapiens
  misc_feature: GYAE6OF02JHD1S.2.72.G06.1.454.CMB.1.raw
  modified_base (97)..(97): a, c, t, g, unknown or other
  misc_feature (97)..(97): n is a, c, g, or t
  modified_base (192)..(192): a, c, t, g, unknown or other
  misc_feature (192)..(192): n is a, c, g, or t
  modified_base (232)..(232): a, c, t, g, unknown or other
  misc_feature (232)..(232): n is a, c, g, or t
  modified_base (286)..(286): a, c, t, g, unknown or other
  misc_feature (286)..(286): n is a, c, g, or t
tcagacgctcgacacacgaccggtgctcgatttagctacgactgcaagggaaaggggagtctcagtcaggacacagcatggacatgagggtccccgntcagctcctggggctcctgctactctggctccgaggtgccagatgtgacatcctgatcgacccagtctccatcctcctgtctgcatctgtagganacagagtcaccatcacttcgccgggacagtcagagcatanctagtacttaattaatgtatcagacaagaaacctagggaaactccctaaatccngtactactatcgtaactactctagttacgacgtaaggtcggtaccaagtcgaaggttcaaggtcggataggtcgatcggtagggaataagttcttaccacttcctacaactactacgtagacctagttccgataccttaaccgtaggtaaactttacgtttacgaaccctttaaacgttacctaacggttacgaaccttaaacgtacgttaaccgttaacccgtaaccgttaaccccgtgggtaacccgttaaccgggaaccggtaaacgaacgtaacgtacggtaaactaccgaaaaggtcgtaggtacgtacctaagaccctataccgttgtaccgtttataccgtaacccg

SEQ ID NO: 12792 - DNA, 713 bp, Homo sapiens
  misc_feature: GYAE6OF02JQRV9.2.72.G06.1.454.CMB.1.raw
  modified_base (124)..(124): a, c, t, g, unknown or other
  misc_feature (124)..(124): n is a, c, g, or t
  modified_base (136)..(136): a, c, t, g, unknown or other
  misc_feature (136)..(136): n is a, c, g, or t
  modified_base (154)..(154): a, c, t, g, unknown or other
  misc_feature (154)..(154): n is a, c, g, or t
  modified_base (158)..(158): a, c, t, g, unknown or other
  misc_feature (158)..(158): n is a, c, g, or t
  modified_base (189)..(189): a, c, t, g, unknown or other
  misc_feature (189)..(189): n is a, c, g, or t
tcagacgctcgacacacgaccggtgctcgatttagctacgactgcaagggaaaggggagtctcagtcaggacacagcatggacatgagggtccccgctcacgctccgtgggctcctgctactcnggctccgaggtncccgaggatggtgaaccntccngatcgacccagtcctccatcctccctgtccngcctattctagtaggacgactaggataccaccattccacgttcgaccggggactaaggtccaaggacgtactaacgttagccgtagtactttaagtttaagttaccggttaatccgaagacgaaccggaaaaccggtaacggggaaacctacccccgttaaacgttcccgtagtacttactacttacgttaacacgtccttaaggtttcgaacggttaacggtccggggtacccttaggtacttaacggttcctaagggtcgacggtaacggtgtaacgttcggtagggtaacctaggttcctactacctcgtaccaacgtctacgacgtcgtacgtcgacgtacgtaaccgtgtaacgttacttaagaccttaacccgttagtacctacgtaccgttaaagtacgttaacgttaaccgacccctttagggaccgttacggttacccgaaccggtacgtacgagggtactactaacgaccgtagtccgagcgttagacctcgtagtccttactcgttatcccgg

SEQ ID NO: 12793 - DNA, 713 bp, Homo sapiens
  misc_feature: GYAE6OF02HFKVB.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcacatcacttgccgggcaagtcagagcattagcagtctattaattggtatcagcagaaaccgaggaaacacccctaaactcctagatactatcgtacagtcctagtttgacgtaaacgtcggggttaccccagttaccgaaggtttacgaacggtggtaccgtaggtacggagttccgtagggaacctagtaactttcaacctttccgacacctactacgacgcctacgtctacggacctaaaccgtaggtaaacgttattttcggtaaaccttaaaccgtttaaccgttaaccgttacggtaacctaaacgttaacggttaaccgttaaaccgtaacccgttaaccccccggtttaagggtaccccggtttaccgggaaacccgtaaacggggtaacccgtaaacggggttacggtaaacgtttaaccggaaacccggtaaacgttccggttaggacccgtttaggaccctaacccttagtacccgtttacggttaccttaccgttaacccgg

SEQ ID NO: 12794 - DNA, 778 bp, Homo sapiens
  misc_feature: GYAE6OF02H8Y3J.2.72.G06.1.454.CMB.1.raw
  modified_base (199)..(199): a, c, t, g, unknown or other
  misc_feature (199)..(199): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccaggatgtgacatcctgatcgacccagtcctccatccctcctgtctgctattctaggtagganacgagacgtcaaccattcctacgttcggcccgggacaacggtcgagacgctagttagctagtactttaaagttttaaacgttggtaactacgaagacgaaacggaaaccgaacggggtaaaacccgtacccctaaaaccgtcctagtaacttactagttacgtactcgtaccgtagttacgacgtaacggtcggtaccagtacgtaagtcgtaggtagcgaggtgtaacgtggtacggactaagttactttacaccgttacgtaccacgtactcgacgtctacggtctagaccctaacgttagtaaacgttacgtttaactaaccttaaaccgttaccttaagtaccgttaaaccgtaaacgttaacggttaaaccgtttaaccggtaaccccgtttaccccgggttaccgggttacccgggtttaacccggggaacccgggtaaaagggttaaaccccggtaagggttaacgggtaaaccctttaaacgaaaccgggttaaacgttcgggtaccggttaacctaccggtaacccgttaccttacgtttaccgttacgttttacccgttaccttacccg

SEQ ID NO: 12795 - DNA, 848 bp, Homo sapiens
  misc_feature: GYAE6OF02GDOLE.2.72.G06.1.454.CMB.1.raw
  modified_base (481)..(481): a, c, t, g, unknown or other
  misc_feature (481)..(481): n is a, c, g, or t
tcagacgctcgacacacgaccggtgctcgatttagctacgactgcaagggaaaggggagtctcagtcaggacacagcatggacatgagggtccccgctcagctccgtgggctcctgctactctggctccgaggtgccagatgtgacatcctgatcgacccagtctccatccctccctgtctgcatcgtgtaggagaccagtacgtccaccattccacgttggccccggggactaaaggtccaggacgcctaagttacgccgagtacctttaatttaaacgttggttaacttcgaacgtacaaacggaaaaccggaagggtaaaacgaccccccgttaaaactcccgtaggtaacttacgttaacgttacgttaacctacgttacccgtagtttacggaaacctaacggggtttccgggtacctaagtacggtaacgttcgacggttgacgtaagtcggtacgtcgtagggacgttaacgtnttccgtactcctacgacctaagtccgagtaccgtacgtcgtacgaccttaaacgtagtaagtttacgtttacgaaccgttaaaccttttacccgtaacgttccggttaaacctaccgtaagggtttaaccctttaacccggtaacccggtttaaacccccggttacggggttaaacccgggtttaccccgtaaaccggttaaacccgggggtaaacccgggtaaaggtttacccggtaaaaacggttaccccccgaaaaaacgggggttaaccttaccggggttacccgttaccggttaaccgtaaccccggttaaccgttaagttttcccccggtaacggttttccgttaaccctttaacccccgg

SEQ ID NO: 12796 - DNA, 657 bp, Homo sapiens
  misc_feature: GYAE6OF02FJIG2.2.72.G06.1.454.CMB.1.raw
  modified_base (407)..(407): a, c, t, g, unknown or other
  misc_feature (407)..(407): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctcctgtcctgcatctgtaggagacagagtccacatcacttggccggcaagtcagacgacattagctagtcttaatttaagttggatcaggacaacgtaaaccgaggaaccacccctaaatccgagactctatacgttacactactaagtttcgaactaacgggtcggtaccctagtacgaacggtttcgaggtcgcgtagtggtaactcggaaggtacctagtactttacactaccncctaacctacgtaccgagtacgtacgttacgtccgaaacctaccggtcggtaaccgttaccgttttacggaacttttaaccggttacttcgttaacgttaaccaaaacgttaccggtttaccctaaccccgttaccgttaacttaaccggtttccggaacccggaagggtacccgtacggtagactacgtaacgaaacggtgtaccggtcgacgtacgacctacggtactcggtagttccctagtacccg

SEQ ID NO: 12797 - DNA, 778 bp, Homo sapiens
  misc_feature: GYAE6OF02IUM6F.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacgttcgccgggacaaggtcagagcagttacgcagtctaatttaaagttggtaatcagtcaagaaaccagggaaacgccctaaactcctagattactatacgttaacactacctagtttacgacgtaaacggtcggggtaccctaagtacggtaaacggtttcgtaggttacgggcgtagggttacgggtaacgttaccgggtacggggtaactaaggttacgtttaccacctttccgtaccaaccctacgtaccgtaacggtactaacgttcctacgacctaaacccgttaggaacgttacgttttacggacccttaaacttaaccgttaccttagtaacccgtaagtaacggttaaacgtttaaccgtaaccggttaacccccgttaggggtaacccggtttaccgggaaacccggtaaaccggggaaccggttaaacggggttaacggtaaaaccgttaacccggtaaaacccgggtaaacggttaaccgggttacgggtaacccgttaacgggtacccaacccgttaaccgttaccgttacggttttacccttaccgtttaaccccgg

SEQ ID NO: 12798 - DNA, 700 bp, Homo sapiens
  misc_feature: GYAE6OF02H5P1V.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtcctccatccctccctgtctgcatctgtaggagacagacgtccaccatccacgttggacccgggacaaggtcaggagctaattacgcagtcttaatttaaattggtaatcagacaagaaaccgagggaaacaccctaaactctgatctatgttacatcctagtttgacgtaaggtcggggtaccagtacgtaaggttcgaggtggtacgaggtgtaacgtcgtagggaactagtactttcaccgttacctaccaacctactacgaacggtctacggttacctacgtacctaacggttagtaaacgttacgttttaacgaaccttaaccgtttaaccgttacgttacgtaacctaaaccgtaaggttaaccgttaacccgtaacccggttacccccggtagggttaacccgggttaccgggaaaccggtaaaccgggaaccgtaaagggttaacggtaaaacgtaaccggaaacggtaaccgtgggtaacgaccgttacgaccctaccgtagttccgtttacggtcccttacgtacccc

SEQ ID NO: 12799 - DNA, 614 bp, Homo sapiens
  misc_feature: GYAE6OF02GHYT7.2.72.G06.1.454.CMB.1.raw
  modified_base (300)..(300): a, c, t, g, unknown or other
  misc_feature (300)..(300): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagagtcaccatcacttggccgggcaagtcagagcattagcagctatttaaattggtatcagcaagaaaccgaagggaacacccctaaactcctagtactactattnttacatacctagtttagacgtaaggtcggggtaccctagtaccgtaaggttccgaggtggactaggtaggtagttcggtagggactagtactttacaccttacctcaacctatacgagtcacgttcgtacgacctaacgtacgtaagttacgtttacgacttaacttacctatacgtaacaactacgtacgttacctaccgttaccccgtaggtaccgttccggaccgtaaacgggaccgtaagggtacgaaactaccgaaacggtacgttacggcggtacgtcgaccacgtactacgttgttaccttctaccg

SEQ ID NO: 12800 - DNA, 707 bp, Homo sapiens
  misc_feature: GYAE6OF02FH05C.2.72.G06.1.454.CMB.1.raw
  modified_base (218)..(218): a, c, t, g, unknown or other
  misc_feature (218)..(218): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctcctgtctgcatctgtaggagacagagtcaccatcacttcggccgggnaagtcagacgcattagcagcttaatttaaagttggtattcgagcaagaaaccgaagggaaacaccccgttaaaactcctagactctattcgttacatcctagtttgactaaaggtcgggtaccagtcgtaaggttcgtaagtggtcgacggtggtatacggtaggggaactagtactttcgaacctcctacgaaccctatacctagccgtagtcgtacgaccctaaacctaggtaaacgtttacttttacggaacctttaaaccgtttaaccttaacgttacggtaacctaaacgtaaggtaaccgttaaccgtaacccgttaacccccgttagggttaacccggttaccgaacccgggtaaacgggtaaccccgtaaagggttaccggaaaacgttaacccggtaaaacggttaaccgttacgggtacggtaacccgtcggaaccctacccgtaacgttaccgtcggttttaccctttcgtaaccccg

SEQ ID NO: 12801 - DNA, 774 bp, Homo sapiens
  misc_feature: GYAE6OF02JY37F.2.72.G06.1.454.CMB.1.raw
  modified_base (734)..(734): a, c, t, g, unknown or other
  misc_feature (734)..(734): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtctccatcctcctgtctgcatctggtaggagactaggatcaacctattaccgtactttcgggacccggggactaacgttccgaaggaggcctaagtttacgcctaggtacttaattttaaaagttggttaactacgaacggacaaaggaaaaccgaacggggtaaaccctaacccccgttaaaacttccgtacgtaacttacgttaacgttacgtttaacacgtttaccgttaaggttttacgaacggttaaacggttcggggtaccctagttaccgtaaaggttcgaaggttcggacgtaggtaggtacgttacggtagggaactagttacgtttacgaccttctaccgaactgtactaacgtctcgtactacggtaaccctacgtaacgtaagttcgttttaccgtaaacctttaaaccgttaaccgttagtacgttaaacgaacgttaaggttaaccgttaaccgtacccggttaccccgttagggttaccgttaaccggtacggaaaccgggttaacgtaacgggtaagtaaccgttaacgtaaaccgtaacggttagggtaccggtntaccgtactaccgtatcggtttactttaccgacttacccg

SEQ ID NO: 12802 - DNA, 696 bp, Homo sapiens
  misc_feature: GYAE6OF02I3QE4.2.72.G06.1.454.CMB.1.raw
  modified_base (166)..(166): a, c, t, g, unknown or other
  misc_feature (166)..(166): n is a, c, g, or t
  modified_base (438)..(438): a, c, t, g, unknown or other
  misc_feature (438)..(438): n is a, c, g, or t
  modified_base (464)..(464): a, c, t, g, unknown or other
  misc_feature (464)..(464): n is a, c, g, or t
  modified_base (688)..(688): a, c, t, g, unknown or other
  misc_feature (688)..(688): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagttccnccatccctccctgtctgactatcgtaggtaggagacagtcgtccaccatcctagttccggcccgggacaagtccaggagcctattacgctagtcttaatttaattgatcagcaagtaaaccgaagggaacctaccccgtaaactccgtagtattactagttacgtaacctattcccgttagttacgacgtaaacggtcgggtacccctagtaccgtaagttcgaggtcggacgtaacggttggtaacgttcggtaagggtacgtaacggttntttacccgaccgttcctacgtaaccngtaccgaacgccgtacgtacgttacgacctaaaccgttagtaaaccgtttacgtttacgtaccttaaaccttacgtacgttacctaacaacgttagtaaccgtaccctaccgttaccccggtaggttaaccgttaccgcggtaaaccggacgtaacggtacgtaactaacgaacggtaaccgtggtaaccgtctaccggactaccgtactacgtcgttaccgtntaacccgg

SEQ ID NO: 12803 - DNA, 625 bp, Homo sapiens
  misc_feature: GYAE6OF02H2MBF.2.72.G06.1.454.CMB.1.raw
  modified_base (275)..(275): a, c, t, g, unknown or other
  misc_feature (275)..(275): n is a, c, g, or t
  modified_base (606)..(606): a, c, t, g, unknown or other
  misc_feature (606)..(606): n is a, c, g, or t
tcagacgctcgacacacgaccggtgctcgatttagctacgactgcaagggaaaggggagtctcagtcaggacacagcatggacatgagggtccccgctcagctcctgggctcctgctactctggctccgaggtgccagatgtgacatcctgatgacccagtcctccatcctccctgtctgcatctgtaggagacagagtcaccatcacttgccgggcaaggtcagagcattagcagcttaatttaaatggtatcagacaagaaaccagggaaacncccctaaactcctagtactactatgttaacatacctagtttcgactaaacggtcgggtaccagtacaaggttcaagtgacagtgatcgtagggactaggtacttcacttcctacgtaccatcaagtcgaacgtctacgacctaaaccgtagtaaacttagttttcgaactaaacctttacgttactggaaccaagtacgtaacgttaccgtaacgtaccccgtaggtaccgttccggaacgaacgggtaaccgtaaggtacggtaaaacgttaccgaaaacggtaccgttacgggtacgtaccgtacgacctaaccgtacgtaccggtttnttacccgtacgttaacccg

SEQ ID NO: 12804 - DNA, 712 bp, Homo sapiens
  misc_feature: GYAE6OF02JO43U.2.72.G06.1.454.CMB.1.raw
  modified_base (181)..(181): a, c, t, g, unknown or other
  misc_feature (181)..(181): n is a, c, g, or t
  modified_base (199)..(199): a, c, t, g, unknown or other
  misc_feature (199)..(199): n is a, c, g, or t
  modified_base (202)..(202): a, c, t, g, unknown or other
  misc_feature (202)..(202): n is a, c, g, or t
  modified_base (212)..(212): a, c, t, g, unknown or other
  misc_feature (212)..(212): n is a, c, g, or t
  modified_base (277)..(277): a, c, t, g, unknown or other
  misc_feature (277)..(277): n is a, c, g, or t
tcagacgctcgacacacgaccggtgctcgatttagctacgactgcaagggaaaggggagtctcagtcaggacacagcatggacatgagggtccccgctcagctcctggggctccctgctactctggctccggaggtgccagatgtgacatcctgatcgacccagtcctccatcccttcccngtctgcatcgtgtagganacngtacgtcacngtccacttggccggacaagtcagacgtctaagttcgcgtagtacttaatttaaagttggttactnagacgaagtaaaccgacggaaaccgtaacccctaaactaccgctacgttactagtagtttaccacttcctaaggttcgtaagtaaacggtccggggttaccctaacggtacgtaaccggttcgtaacggtcggtacgaggtacgtacgtacgacgggtacctaagttaccttcgtaaccttccgtactaacgtctacgaacgttagactccgtacgactaaacgtacgtaacgttatttaaccgaccgttaacttaccttaggtacctaaaccgtaacgttaacgttaaccgtttaacggaccccgttaaccccggttaacggttacccggtaccgtaacggtaaccggaaccgttacgggaacttaaaccgggactaaacgtaccgtaaggcgtaaccgtgaccctaagtcctacggttactcgttaactcccg

SEQ ID NO: 12805 - DNA, 693 bp, Homo sapiens
  misc_feature: GYAE6OF02GJGTB.2.72.G06.1.454.CMB.1.raw
  modified_base (265)..(265): a, c, t, g, unknown or other
  misc_feature (265)..(265): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtaggagacagacgtcaccatcacttcggccggacaagtcgagtagcctattacgcagcttaatttaattggtatcaganaacgaaaccgaagggaaacgtcccctaaactcctagactactatgttaacacttcgtaagtttcgacgtaaaggttccggggtacctaagtacgtaacggttcaggtcggactaggtcggaattccgagggtaacagttaactttccgaacttaccgtacaacctactaccgacgctaacggttctacgaacctaacccgtagtaaacgttaagttttcgaaccttaactttaactacgtagtaactaaacgtacgtaaacgtttaaccgaccgttaaaccccggtggttaacccgggtttaacggaaaccggttaacggggtaaaccgtaagggtaacggtaaaaccgtaaccgtaaaacgtaacgttacggtccggtactacgtaccgtaacccgtagttacccttacgttcctttaacgtacccg

SEQ ID NO: 12806 - DNA, 563 bp, Homo sapiens
  misc_feature: GYAE6OF02G3D0Y.2.72.G06.1.454.CMB.1.raw
  modified_base (161)..(161): a, c, t, g, unknown or other
  misc_feature (161)..(161): n is a, c, g, or t
  modified_base (193)..(193): a, c, t, g, unknown or other
  misc_feature (193)..(193): n is a, c, g, or t
  modified_base (358)..(358): a, c, t, g, unknown or other
  misc_feature (358)..(358): n is a, c, g, or t
  modified_base (381)..(381): a, c, t, g, unknown or other
  misc_feature (381)..(381): n is a, c, g, or t
  modified_base (409)..(409): a, c, t, g, unknown or other
  misc_feature (409)..(409): n is a, c, g, or t
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctgatgacccngtctccatcctccctgtctgcatctgtagganacagagtcaccatccacgttgccgggacaacgtcagagctattagcagtactattaattggtatcagcagaacgaggaacaccctaaactccagactctatgttacatcctagtttcgacgtaacggtcggtccatcgtaaggttctaggtgcagtggtagtcgnggactagtacttcactctacacnctcacgctagtcacacacctagtaagtntttacgacttaacttctactactacaataggtacgttacctaccgtacccgtacggtaccgttaccggaccgtaaacggaccgtaagtacggtaactaaccgaaacggtatcgggtacgcgtacgaccacgtacgttcttgttaccttcgtacc

SEQ ID NO: 12807 - DNA, 545 bp, Homo sapiens
  misc_feature: GYAE6OF02FJFRE.2.72.G06.1.454.CMB.1.raw
  modified_base (235)..(235): a, c, t, g, unknown or other
  misc_feature (235)..(235): n is a, c, g, or t
  modified_base (271)..(271): a, c, t, g, unknown or other
  misc_feature (271)..(271): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatccctccctgtctgcatctgtaggagacagagtcaccatcacttggccgggcaaggtcagagcattgnagctattaattggtatcagcaagaaaccaggaaacncccctaaactcctagatctatgtacatcctagtttgactaaaggtcggggtacccagtacgtaaggttcagtggcgagtggtatcgtaggggactagtactttcctactctacgacctatacacgtcaacgttctacgacctaaccctagaacgttatttcgaacttaacttactactcgtacaactagtaactactacgtacccgtgtaccgtgaccgaggacgaagtacgaatcgaaacgtactgtacgctcgacacacttctgtcctatac

SEQ ID NO: 12808 - DNA, 810 bp, Homo sapiens
  misc_feature: GYAE6OF02FN5RF.2.72.G06.1.454.CMB.1.raw
  modified_base (770)..(770): a, c, t, g, unknown or other
  misc_feature (770)..(770): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgaccagtctccatcctccctgtctgctatctgtacggagacagacgtacaacctactacctacgttacggaccgggaccgtaaacggtacgaaggtacggaccgttaagttacgacgtaacggttaccttttaaaagtttttaaaggtttacggttaacttaccggaacgtaaccgtaaaaaccgggtaaaaacccgggtaacggggtaaaaaccccgttaccccccgtaaaaaccgtttcccccgttaggtaaccttaacctttaaggtttaaccgtttaaccgtaccgtttaccgttaggttttacggaaccggtaaacggggttccggtacctacgtaaccgtaggttacgtaggtcggacgtaggtacggtcttacggtacgggactagttaccttcgtacctcacctactacgtcgaagtcctagtcgtacaccgttaacgacgtaagtttacgtttacaaccttacttaaccgttacgtaactaccgaacgttaacgttacgtaccgttacccgtacccgttgggtaaccgtccgggaaacttaacggggaccgttaggggaactaacccggtaacgggtaacgtaggttaccggtacgtacccggtanaccggtacttaccgttcgtacgtttaccttacgttccccg

SEQ ID NO: 12809 - DNA, 711 bp, Homo sapiens
  misc_feature: GYAE6OF02IREQD.2.72.G06.1.454.CMB.1.raw
  modified_base (451)..(451): a, c, t, g, unknown or other
  misc_feature (451)..(451): n is a, c, g, or t
tcagacgctcgacacacgaccggtgctcgatttagctacgactgcaaggggaaaggggagtctcagtcaggacacagcatggacatgagggtccccgctcagctccgtggggcctcctgctactctggctccgaggtgccagatgtgacatcctgatcgacccagtcctccatccctccctgtctgctatcgtggtaggagacagatacaccatccacgttcggccgggactaagtcagagactattacgctagtactttaatttaaagtggtactcacgacaacgaaaccggaagggaacctaccctaaactcctagtactactagtcgttaacactacgtagtttcgaacgtaacggtcggtacctagtacgtaaggttcgaggtggacgtaggtcggagtcgaggtactagtacttacacttcctacgactagtacagtactagtacncaaccgtacgttagaagtttacctttacgaacttaacgtttacgttacgtactaacctaacggtaacgttacgttaacccgtacccgttacccgtacgggtaacccggttaccggaaacccggtaaacgggtaccgttaaagggtacccgttaaacgtaacccgtaaaacggtaaccggtacgggttaccgtacgttaaccgtacccgttaacggtttaccgtttaccggtttaccgtttaccctaccgtttacccccgg

SEQ ID NO: 12810 - DNA, 912 bp, Homo sapiens
  misc_feature: GYAE6OF02H8U2U.2.72.G06.1.454.CMB.1.raw
tcagacgctcgacacacgaccggtgctcgatttagctacgactgcaagggaaaggggagtctcagtcaggacacagcatggacatgagggtccccgctcagctcctgggctcctgctactctgctccgagtgccagatgtgacatcctgatcgacccagtcctccatccctccctgtctgcattctggtaggacgacagacgtccaacctactcctaccgttgggcccgggacaaacgttcaaggacgactaagtttaacgccgtaacggttaaccttaagttttttaaaaacgttggttaataccgtaacgaaccgaaaacggtaaaaacccggaaacggggtaaaaacccgtaaccccccgttaaaaacccgttcccgttacgtaacgtttaccttaagttaacggtttaacctaacgttacccgttaaggttttacggaaccgttaaaacgggtttccggggtaccccgtaagttaacgtaaacggttcggttaaggttcgggtacgtacgggttagggtacgttaaccggtgggggtaactaagttaccgttttaccgaccgttttaccgttaaccctaaccgtacgttacccgaaacggttcctaacggttaccgttacgtaaacccgttaaccgttaaggtaaacgtttaacgtttttaaccggtaaacccttaaaccgttttaaccttaacgttacccgtaaacgtaaacgtaaacggtttaacgttaacccgttaacccggttacccccgtttaagggtacccggtttaacccgggaaaccggaaacgggttaaaccgtaagggttaacgtaaaaccggtaaccgtaaaaccggtacgtacgggttaccggaaccttcggaaccctaccgtacgttaccgtcggtttacccttacgttaccccg

SEQ ID NO: 12811 - DNA, 811 bp, Homo sapiens
  misc_feature: GYAE6OF02IWRQZ.2.72.G06.1.454.CMB.1.raw
  modified_base (58)..(58): a, c, t, g, unknown or other
  misc_feature (58)..(58): n is a, c, g, or t
  modified_base (180)..(181): a, c, t, g, unknown or other
  misc_feature (180)..(181): n is a, c, g, or t
  modified_base (281)..(281): a, c, t, g, unknown or other
  misc_feature (281)..(281): n is a, c, g, or t
tcagacgctcgacacacgaccggtgctcgatttagctacgactgcaagggaaaggggntctcagtcaggacacagcatggacatgagggtccccgctcagctcctggggctcctgctactctggctccgaggtcgccagatgtgacatcctagatcgaccagtctccatcctcctgtacnnctactctaggtaggacacgagtactaccaactctactacgtcggacggtaactacgacgagactagttactagactacgttaactttaaagtttacggtntacacgacgaacgaaaccggtaaaccggaacggtaaacccctaaacccttaacgtccgttacgtaacgttactacggttaactaactacgttaccgtttaggttacgaacggtaacgggtccgtaactagtacgttaacgtacgtaggtgacgtaggtacgtcgtaggagtaactagtacttcacgttaccataccgtatacgatacggtactaccgtaactaaacgtccgttaaagttcgtttaacgtttacgaaaacccttttacgtaacgtttaaccgtacctaaagtaacggtaaacgtttaacccggtaacccctttacccgggtaaacccgggttcgggtttaaacccgggtacccgggtaaaagggtaaaacccgggttaaacgggttaaccggtaaaggttaaacccgttaaaaccggtaaacgtttaacccgggggtacttaacccgggttaccttaaccggaaccgttaacctttaacccggtttcgttaacccgttttaaccttcccggtttaaccccg

SEQ ID NO: 12812 - DNA, 603 bp, Homo sapiens
  misc_feature: GYAE6OF02F55WG.2.72.G06.1.454.CMB.1.raw
  modified_base (440)..(440): a, c, t, g, unknown or other
  misc_feature (440)..(440): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatgacccagtctccatcctccctgtctgcatctgtagagacagagtcacatcacttgccggcaagtcagagcattagcagctatttaaattggtatcagtacaagaaaccgagggaaacgacccctaaaactcctagactactatcgttacatacctagtttgactaaaggttcggggtaccctaatcgtaaacggttcgaggtaggcgtaggtacggattcgtagggactagtactttcgactctaccacgtatcgagctacgtctcggactaaccgtgaaacgttntttacgacttaaaccttactactcgtaacaacgtagtaacgttacgtaccgttaccccggttgtaaccggttccgaccggtaacggaaccggtaaggtacgaaactacggaaacgtacggtacgtacggtctacgacctaccgattcgtacgttcctctaacc

SEQ ID NO: 12813 - DNA, 600 bp, Homo sapiens
  misc_feature: GYAE6OF02JD9JJ.2.72.G06.1.454.CMB.1.raw
  modified_base (235)..(235): a, c, t, g, unknown or other
  misc_feature (235)..(235): n is a, c, g, or t
  modified_base (262)..(262): a, c, t, g, unknown or other
  misc_feature (262)..(262): n is a, c, g, or t
  modified_base (266)..(266): a, c, t, g, unknown or other
  misc_feature (266)..(266): n is a, c, g, or t
  modified_base (495)..(495): a, c, t, g, unknown or other
  misc_feature (495)..(495): n is a, c, g, or t
  modified_base (522)..(522): a, c, t, g, unknown or other
  misc_feature (522)..(522): n is a, c, g, or t
  modified_base (562)..(562): a, c, t, g, unknown or other
  misc_feature (562)..(562): n is a, c, g, or t
  modified_base (570)..(570): a, c, t, g, unknown or other
  misc_feature (570)..(570): n is a, c, g, or t
tcagacgctcgacacacgaccggtgctcgatttagctacgactgcaagggaaagggggagtctcagtcaggacacagcatggacatgagggtccccgctcagctcctggggctcctgctactctggctccgaggtgccagatgtgacatcctgatcgacccagtctccactcctccctgtctgcatctgtaggagacagacgtccaccatcacttaggccgggacaggtacagancattagacagtcttaagttaatgtatnacgnaaacgaacgaggaaccaccctaactctagactctatcgtacacttcgtagttgaacgtaacgggtcgggtaccctagttacgtaacggtcgacggtagtaccgtaggtacggtactacggtagggtactaagttaccgttacacccgtacttaccaacgactttaccggagttccgaatcccgttagacccgtaccgtaagttagtactttcgaacttactacgttacncgtacagtcgttactcgacctaccggngtaccgtcgaacggtaacgagtaagatataacgaacgttnaggttcgngtaccacggtactatacgtgttcattcccg

SEQ ID NO: 12814 - DNA, 740 bp, Homo sapiens
  misc_feature: GYAE6OF02FLI7L.2.72.G06.1.454.CMB.1.raw
  modified_base (161)..(161): a, c, t, g, unknown or other
  misc_feature (161)..(161): n is a, c, g, or t
  modified_base (231)..(231): a, c, t, g, unknown or other
  misc_feature (231)..(231): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccngtcctccatccctccctgtctgcatctggtagacgacgagacgtaccaccatcctacgttcggaccgganaacgtacgagacgtactacttacgactagtacttaagtttaaagtttggtaacttacgacgacgaaacggaaaccggacgggaaaccgtaccccttaaactccgtacgacttaccgttattacgtactacttccgtaggttacgaacgtaacgggttcggtacctacgtacgttaacggttacgtacggtacggtacgtaggtaggtacgtcggtaacgggtactacgtttacgttcctaccgttacctccgtaacccgtcgtacgtacgtccgtacgttaccgtagaacccgttaacgtagttaagtttacgtttacgaactttaaccttaacttacgtacgttaacgtaacgtaccgttacgttaccctaaccggtttaccccgtacgggttaccgtaacccgggaacggtaaccgggacgtaaggtacggaacctaacggtaaacgtaccgtagggacctacgtaccgaactacccgtacgttacctacgttacctaccgttaccc

SEQ ID NO: 12815 - DNA, 821 bp, Homo sapiens
  misc_feature: GYAE6OF02FWKMZ.2.72.G06.1.454.CMB.1.raw
  modified_base (210)..(210): a, c, t, g, unknown or other
  misc_feature (210)..(210): n is a, c, g, or t
  modified_base (223)..(223): a, c, t, g, unknown or other
  misc_feature (223)..(223): n is a, c, g, or t
  modified_base (240)..(240): a, c, t, g, unknown or other
  misc_feature (240)..(240): n is a, c, g, or t
  modified_base (304)..(304): a, c, t, g, unknown or other
  misc_feature (304)..(304): n is a, c, g, or t
tcagacgctcgacacacgaccggtgctcgatttagctacgactgcaagggaaagggagtctcagtcaggacacagcatggacatgagggtccccgctcagctccgtggggctcctgctactctggctccgaggtgccagatgtgacatcctgatgacccagtctaccattccctccctgtctgactatctggtagagacagacgtccacntcacgttgccggntaagtcagagctagtancagatatttaagtgtatcagtacaagaaaccgtacgggaaacctacccctaaagttccgtagtntaccgttaactcgttaactacttaccgtaagttttcgaaggtaaaccggttcggggtaaccctaagttaaccgtaacgggtttaccgaaggttccgggtacgtaagggttcgggaacttccgggtaagggtaaccgtaacgttacgtttcctaaccgtacctttaccgaaaccgtagttacctaccggaccttacggtacttaaccgaccgttaaacgttacggtaaacggttttctttaacccgggtaacctttaaccgtttaaacctttacggtaacctttaacccgaaaacggttttaccggtaaacgttacccccgtttaaacccggtttaaccccgggttacgggttaaccccgggtaacgggtaaaccccggttaaaggggtaacccgaaaggttttacccgggaaaaaccgtaccgaaaaccccggttttagacccgggtttaaggccctttaacggggtaccccttaacggttccgttaacgtttaccgtcgttttaacccctacccgg

SEQ ID NO: 12816 - DNA, 883 bp, Homo sapiens
  misc_feature: GYAE6OF02F3LPM.2.72.G06.1.454.CMB.1.raw
tcagacgctcgacacacgaccggtgctcgatttagctacgactgcaagggaaaggggagtctcagtcaggacacagcatggacatgagggtccccgctcagctccgtggggctcctgctactctggctccgaggtcgccagatgtgacatcctgatcgaccctagtctccactccctcccgtgtcctgctattcgtaggtaggaacgacgagtacgtaccaacctatccgtaccgttcggacccgggtactaaacggtcaaggacgtactaggttacgacgtacgtacttttaagttttaaacgttggtaacttcgaagtaccgaaacggaaaacccggtaacgggaaacccgtaccccttaaaaccgtccgttagtaaccgtttacttaacgttacggttacctaacgtttcccgttaaggttttacggaaacggttaaacgggttccggggttaccctaaggttaccggtaacggtttacgtacgggtacggtaccggtaaggtacggtacggttcggtaacggggtaacctttaagggttaccctttaccggtaacccgtttcccgtaaccgttaacccgccgtttaaccgaaccggtaccgttaaccgtaccgttaccggtaaccgtaacgttaacgtaaacgtttacgttttaacgaacccgtttaaaccttacgttaacgttaccgttaaccgtaaagttaaccggttaaccgttacccgtaacccggttacccggttaaccgggtaccggttaccgggaaacgtaaaccggggtaaccgtaacgggttaacgaacgtaacccggaaaggttaccgtaggtccggttacgtaaccgttctaacccgttagtcctttacggttacttccgttaacccg

SEQ ID NO: 12817 - DNA, 751 bp, Homo sapiens
  misc_feature: GYAE6OF02GEUPG.2.72.G06.1.454.CMB.1.raw
  modified_base (725)..(725): a, c, t, g, unknown or other
  misc_feature (725)..(725): n is a, c, g, or t
tcagacgctcgacacacgaccggtgctcgatttagctacgactgcaagggaaaggggagtctcagtcaggacacagcatggacatgagggtccccgctcagctccgtggggctcctgctactctgctccgaggtgccagatgtgacatcctgatcgacccagtcctccactccctccctgtctgcattcgtaggtaaggacacgagtacgtaccaacctatacctacgttcgggacccgggactaacggtacgaaggacgtaccgtaattacgacagtactttaaattttaaagttggtaattacgagacaacgaaaccggaacgggaaaacctacccccgttaaactaccgtagtaacttacgtaagttacgttaacctaccgttaccgttagtttaccgaacggtaacggtaccgggttaccctagttacgtaaggttacgaggtacgcgtaggtagtagtacggtacggtactacgttacttccaccttacgtaccaaccgtagtacaggtacctgtacctacgactaacggtagtaacgtttcgtttacgaaccttaccgtttacttaccgtaacggttaaccaacggttaacgttaccgttacccgttaaccccggttacccggttacggtacccgggttacggaaccggtaaccgggtacgtaaacgggtacgtaaccgtaacggtaaacgtacggttaggtacgtaccgacgtacctnttaccgtcgtacgttatcccgttacc

SEQ ID NO: 12818 - DNA, 1004 bp, Homo sapiens
  misc_feature: GYAE6OF02FTME9.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtctccatcctccctgtctgcatctgtaggacacagagtaccactatcctacgttcggccgggactaacgtcaagagcctaagttacgcagtacttaagtttaaagttggtactacgagtaccaaaggtaaaccgaacgggaaaaccgtacccccgttaaaactccgttaacggtacttaccgttaacgttacggtttaaaccacgttacccgttaagttttacggaaccgtaaacgggttaccgggggttacccctaaggttaccggtaacgggtttaccgaacgggtttcgggaccgttacgggttacggtacgttacgggtaacggggtaaccttaacggtttactttacccgtaaccttacccgttacccgaaccgttaacgtaccgtaacgaccggttaacggtttacccgtaaccgggtaacccttaaaccggttaaccggtaaacgttttaaccgttttaacggaacccgttttaaacccgtttaccgttaacccgttacgttaaaccccgtaaaccggttaaacggtttaacccgggtttaaccccgtttaaccccgggttaaacccccggtttacgggggttaaacccccgtttaaaccggggtaaacccccgggttaaaacgggggtaaaccccggtttaaacggggttaaaccggtaaaaacccggtttaaaaccccgggttaaaaacccgggtttaacccgggtttaaacgggggttaccccggttttaaacccgtaacccggggttaaacccccgttaaacccggttttaacccggtttacccggtttttaaccggtttacccccggtttaaaccgtttacccccccggg

SEQ ID NO: 12819 - DNA, 739 bp, Homo sapiens
  misc_feature: GYAE6OF02GRTEW.2.72.G06.1.454.CMB.1.raw
  modified_base (140)..(140): a, c, t, g, unknown or other
  misc_feature (140)..(140): n is a, c, g, or t
  modified_base (215)..(215): a, c, t, g, unknown or other
  misc_feature (215)..(215): n is a, c, g, or t
tcagacgctcgacacacgaccggtgctcgatttagctacgactgcaagggaaaggggagtctcagtcaggacacagcatggacatgagggtccccgctcagctcctgggctcctgctactctggctccgaggtgccagtntgtgacatcctgatacgacccagtctcctactcccgtccctgtctgtcatctggtaggacgacaggataccacgnttactaccgttacgggcccgggataacggttactaggaacgctaagtttacggactaggtactttaaagttttaaattaggttacttacgtacgacgtaacgaaaaccggtacggaaaaccgtaccccttaaactccgtactacgtacttatacggttacctaacgttaccttagttacgaacgtaacggttaccggggtacctaagtaccgtaacggttactacggtacggtacgtacgggtgaacgttacggtacggaacgttaacgttaacggttacctaaccgttcctaccgtaactacgttacgaacgtacgttaacgtcgtacgtaaccgttaaccgacggttaaggtacttacgtacgttaacttaaccgttataccgtacaacgttataccgtttaccgacccgttcccgaacggttcctaccggtaaccggtacggtaacgtaaccgtagggtaacctaccggtaacggtacgttacgaggtctaccgcttaacgtctcggtactcgttatcccg

SEQ ID NO: 12820 - DNA, 720 bp, Homo sapiens
  misc_feature: GYAE6OF02I37J9.2.72.G06.1.454.CMB.1.raw
  modified_base (97)..(97): a, c, t, g, unknown or other
  misc_feature (97)..(97): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (508)..(508): a, c, t, g, unknown or other
  misc_feature (508)..(508): n is a, c, g, or t
  modified_base (559)..(559): a, c, t, g, unknown or other
  misc_feature (559)..(559): n is a, c, g, or t
tcagacgctcgacacacgaccggtgctcgatttagctacgactgcaagggaaaggggagtctcagtcaggacacagcatggacatgagggtccccgntcagctccgtgggcctcctgctactcgtggctccggaggtgccagatgtgacatcctgatcgaccagttcaccatccctccgtgtctgctatcgtgagananagtactccgacatctagttcggaccgggactaaacggtcgaaggtaacgacgttaactacggtacgaggtactttaaagttttaacgttaggtaattacccgagtaaccgtaacggtaaaaccgaacgggtaaaccctaacccccgtttaactcccggtaaggttaaccttacgttaagttccggttaactacttacgttacggttacgaagtaacggttccgtaccgtaactggtaacggttcgaggtgtatacggtaggttctacggaggtataccggttcgttaaccactcaaccgaccgttaacncgtaagtccgtagtcgtaccgaacttacctaaggtactttaccgtttaaanccctttaaacgtcgtaacgtacgttaacaacgttagacgtttaacccgcccgttacgtaccggacgttaacggaccggaaacgtacgtagtaccgtaatacggacgaaccgttaggtcggtacctaccgctaaccttatcggttaacgttactcctaaccg

SEQ ID NO: 12821 - DNA, 808 bp, Homo sapiens
  misc_feature: GYAE6OF02F9PJX.2.72.G06.1.454.CMB.1.raw
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgaccctagtcctccactcctccctgtctgctatctagtaggagacagacgtcaacctatccgtacgttcggacccggggtacaaacgtcgaacggtaacggtactaagttaacgaccgtacgtaacttttaaacgttttaaaagtttagggtaacttacgtaacggtaaccaaaaccgggaaaaacccggtaaaccgggggtaaaacccctaacccccgttaaaaccctcccgttaggtaaccttaccttaacgttaccgtttaactaaccgttccgttaagtttaccgaacggttaaacgggttccggggtaccctaacggtaccgttaaggttacgacgggtaggtacgtaggttacggtacgttcgggtacggtacgtacgttaacttacctacgtcctacctaaccgtatccgaacgtcgtaacgttccgtaacgtaaccgtaacttaacggtaacgtttacggtttacaaccgttaaaccttactacgtaactaactaacgtaagtacccgttaaccgtaccccgtaaccggttacggtaccgtacggaaccggtaaacgaaccgtaaggaacgtaacgtaacggtaaacgtaacggtacgtacgtacgtactaccctacgttacctcgtacttacttaccttacccg

SEQ ID NO: 12822 - DNA, 760 bp, Homo sapiens
  misc_feature: GYAE6OF02IC3SG.2.72.G06.1.454.CMB.1.raw
  modified_base (152)..(152): a, c, t, g, unknown or other
  misc_feature (152)..(152): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (624)..(624): a, c, t, g, unknown or other
  misc_feature (624)..(624): n is a, c, g, or t
  modified_base (716)..(716): a, c, t, g, unknown or other
  misc_feature (716)..(716): n is a, c, g, or t
tcagacgctcgacacacgaccggtgctcgatttagctacgactgcaagggaaaggggagtctcagtcaggacacagcagtggacatggacgggtccccgctacagcctcccgtggggccttccctgtacctactcgtggctaccggaggtcncccaggtatggtacgacacttcctgactcgacccagttcctaccacttccctcccgttagtctcggactacttcgttaggacggacgacaggtactaccgacccgtagttacctcgttaccgggacccgggtaataacggtacgtaacgacggtacctaagttacggccgtaaacggttacttttaaaaggtttaacgttacggtacctaacgtaaccgacggtaaaacggaaaccggtaaaccggggaaaccgttaacccctaacccgttaaaccgtgttaacgtactacgtttataaccgtactaggtttaccttaacggtagaaaccgggtgttacccgactagtaaccgtgtagcgtaggctttggctacgagattatcttcgacacttaccgactntaccgntacgtactagtaccgtacgtaacctagttagttaccttagtaccgtacttacgtactaacgtaanaaccggtaataaccggttaaccaccggttacgtacgtaaccggaccgtaacggaacggtaagtaccgtaacgtaaccgtacgtacggttacncggtactacgtactcgtacttcgttactacgtacgtctacccgg

SEQ ID NO: 12823 - DNA, 657 bp, Homo sapiens
  misc_feature: GYAE6OF02F8J5N.2.72.G06.1.454.CMB.1.raw
  modified_base (209)..(209): a, c, t, g, unknown or other
  misc_feature (209)..(209): n is a, c, g, or t
  modified_base (503)..(503): a, c, t, g, unknown or other
  misc_feature (503)..(503): n is a, c, g, or t
tcagacgctcgacacacgaccggtgctcgatttagctacgactgcaagggaaaggggagtctcagtcaggacacagcatggacatgagggtccccgctcagctcctggggctcctgctactctggctccgaggtgccagatgtgacatcctgatcgacccagtctccatcctccctgtctgcatctgtaggagacagagtcaccatacncttaaaaaacgccgggacaagtacagagctattagctagacttaatttaaattggtaatacagcaacgtaaaccgagggaaacgtacccctaactcctgatctatgttacatcctagttgacgtaaggtcgggtccctactcgtaacggttacgtaggtaggtcgtaaggtggtacgtcgtacggggtaactagtactttactacctcgtacaccgtactacgacgtcagttccgtacgtaaccgtaacgttagaaacgtttacgtttagaacccttaaccgtttataccgttntaaccgtaacgtaaggtacgttaaccgtaccgttaaccccgtacggtaccgttaccgggaccgtaaacgggtaccgaaggttaccgaaagtaccgtaaaacggtacgtggtacgtacgtcgacgtacctacgtcttacggttactccttaaccg

SEQ ID NO: 12824 - DNA, 214 bp, Homo sapiens
  misc_feature: GYAE6OF01B1FD3.43.35.D02.1.454.CMB.1.raw
  modified_base (213)..(214): a, c, t, g, unknown or other
  misc_feature (213)..(214): n is a, c, g, or t
tcagtgtgagtagtcacgaccggtgctcgatttagcacacgatagttgggtttggggaactgctcagttaggacccagagggaaccatggaagcccagctcagcttctcttcctcctgctactctggctcccaggaactgtggctgcaccatctgtcttcatcttcccgccatctgaactactcacactgagcgggctggcaaggcgcatagnn

SEQ ID NO: 12825 - DNA, 131 bp, Homo sapiens
  misc_feature: GYAE6OF01ENK8Z.43.35.D02.1.454.CMB.1.raw
  modified_base (130)..(131): a, c, t, g, unknown or other
  misc_feature (130)..(131): n is a, c, g, or t
tcagtgtgagtagtcacgaccggtgctcgatttagcacacgatagttggttggcatggtgcaattcccacacaggtcaatgttcccgcctcctcactactcacactgagcgggctggcaaggcgcatagnn

SEQ ID NO: 12826 - DNA, 220 bp, Homo sapiens
  misc_feature: GYAE6OF01DF3D0.43.35.D02.1.454.CMB.1.raw
  modified_base (217)..(220): a, c, t, g, unknown or other
  misc_feature (217)..(220): n is a, c, g, or t
tcagtgtgagtagtcacgaccggtgctcgatttagcacacgatagttgggtttgggggaactgctcagttaggacccagagggaaccatggaagccccagctcagcttctcttcctcctgctactctggctcccaggaactgtggctgcaccatctgtcttcatcttcccgccatctgaactactcacactgagcggggctgggcaaggcgcatagnnnn

SEQ ID NO: 12827 - DNA, 529 bp, Homo sapiens
  misc_feature: GYAE6OF01CB7S1.43.35.D02.1.454.CMB.1.raw
  modified_base (382)..(382): a, c, t, g, unknown or other
  misc_feature (382)..(382): n is a, c, g, or t
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcaggactgcacacagagaactcaccatggaatttgggctgggctgggtttcctcgttgctgtttaaaaggtgccagtgtgaggtgcagctggtggagtccgggggagcttaggtcagcctgggggtccctgagactctcctgtgcagcctctggattcaccttcagtacctactggatgcactgggtccgcaagttccgtagggaaggctggtgtgggtctcgcgtgtgaagtgttgacggnactaatagttggactagtgcggagtcgtgtagaagggccgaattccaccgatctcaganacaacgccaagaacacactgtacttgacaaatcgaaacngtactgagtacgacgacggacacggctagtgtattctagtagtaagtag

SEQ ID NO: 12828 - DNA, 522 bp, Homo sapiens
  misc_feature: GYAE6OF01CF15B.43.35.D02.1.454.CMB.1.raw
  modified_base (432)..(432): a, c, t, g, unknown or other
  misc_feature (432)..(432): n is a, c, g, or t
  modified_base (475)..(475): a, c, t, g, unknown or other
  misc_feature (475)..(475): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaagaggtgcccagtgtgaggtgcagctggtggagtccgggggagcttagtcagccgtggggggtccctgagactctcctgtgcagcctctggattcaccttcagtacctactggatgcactgggtccgccaagttcctgggaaagggctggtgtgggtctcgcgtgtgaatgttgacggcactaatatggactatgcggagtctgtgagggccgattcaccatcnccagagacaacgccaagacacactgtacttagcaaatgaaacngtactgacgagaccggaggaccacggctgtgtatttctgtgtaaagg

SEQ ID NO: 12829 - DNA, 528 bp, Homo sapiens
  misc_feature: GYAE6OF01CVQT5.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcaggccgtgggggtccctgagactctcctgtgcagcctctggattcacctttcagtacctactggatgcactgggtccgccaagttccgtgggaaaggctggtgtgggtctcgcgtgtgatgttgacggcactaatatggactagtgcggtagtctgtgaagggccgattcaccatctcagagacaacgcaagaacacactgtacttgacaatgaacagtctgagacgccggaaggaccaggtctgtcgttatttcgtagtgtaagtag

SEQ ID NO: 12830 - DNA, 551 bp, Homo sapiens
  misc_feature: GYAE6OF01CRA3S.43.35.D02.1.454.CMB.1.raw
  modified_base (267)..(267): a, c, t, g, unknown or other
  misc_feature (267)..(267): n is a, c, g, or t
  modified_base (380)..(380): a, c, t, g, unknown or other
  misc_feature (380)..(380): n is a, c, g, or t
  modified_base (521)..(521): a, c, t, g, unknown or other
  misc_feature (521)..(521): n is a, c, g, or t
  modified_base (543)..(543): a, c, t, g, unknown or other
  misc_feature (543)..(543): n is a, c, g, or t
tcagtgtgagtagtcacgaccggtgctcgatttagcacacgatagttgggtttggggaagctctgcttcagctgtgagcgcagaaggcaggactcgggacaatcttcatcatgacctgctccctctcctcctcacccttctcattcactgcacagggtcctgggcccagtctgtcttgacgcagccgccctcagtgtctgccggcccaggacagaaggtcaccatctcctgcacgtggaagtacgtaccaacattgggaatttttangtatccctggtaaccaacaagtccccaaggaaaccacgacccccaaaactccctacgtttaatccaacaatagtcagacgaccgtcgagggacttcctgacccgtattttcgnggcctaccaagtctcggcacgtcacgccaccgtgtccatcacggactccagacgtgggacgtaggcattatactgacgaacagtaggataccgaggtccgtagggtggtgttcggcggaggaccaagtgaccgtcgtagcngtcccaaggctcgcccctgccntcgtcccg

SEQ ID NO: 12831 - DNA, 236 bp, Homo sapiens
  misc_feature: GYAE6OF01ADLVC.43.35.D02.1.454.CMB.1.raw
  modified_base (219)..(236): a, c, t, g, unknown or other
  misc_feature (219)..(236): n is a, c, g, or t
tcagtgtgagtagtcacgaccggtgctcgatttagcacacgataggttgggtttgggggaactgctcagttaggacccagagggaaccatggaagccccagctcagcttctcttcctcctgctactctggctcccaggaactggtggctgctaccatctgtcttcatcttcccgcatctgaactactcacacgtggagcgggctggcaaggcgcatagnnnnnnnnnnnnnnnnnn

SEQ ID NO: 12832 - DNA, 572 bp, Homo sapiens
  misc_feature: GYAE6OF01DAQR7.43.35.D02.1.454.CMB.1.raw
  modified_base (302)..(302): a, c, t, g, unknown or other
  misc_feature (302)..(302): n is a, c, g, or t
tcagtgtgagtagtcacgaccggtgctcgatttagcacacgatagttgggtttgggcacgaccggtgctcgatttagcacacgatagttgggtttgggggagcccccagccctgggattcccagctgtttctgcctgctgatcaggactgcacacagagaactcaccatggaatttgggctgggctgggtttcctcgttgctgttttaaaaggtgcccagtgtgaggtgcagctggtggaggtccgggggagcttagttcaggccgtgggggtccctgagactctcctgtgcagcctctggnttcaccttcagtacctactggatgcacgtcgggtccgccaagttccgtaggggaaaggctggtggtgggtctcggcgtgtgaagtggtgacggcactaatagtggactatggcggagtctggttagaagggccgattcaccatctccagacacaacgccaaagaaccacactgtacttgacaagtacgaacgtagtactaggacgtaacggccgtaacgggcgaccgggtctggttacgttacgttttcttaggttgtaaaggttaacgg

SEQ ID NO: 12833 - DNA, 526 bp, Homo sapiens
  misc_feature: GYAE6OF01A98JP.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggtttcctcgttgctgtttaaaaggtgcccagtgtgaggtgcagctggtggagtccgggggagcttagttcagcctgggggtccctgagactctcctgtgcagcctctggattcaccttcagttacctacgtggatgcactgggtccgccaagttcctgggaaaggctggtgtgggtctcgcgtgtgaatgtgacggtcactaatatggactagtgcggagtctgtagaagggccgattccactatctccagacgacaacgcaagacacactgtacttgactaatcgaactagtctagagacggccgaggacgacggctgtcgtattcgtgtgtaagtag

SEQ ID NO: 12834 - DNA, 549 bp, Homo sapiens
  misc_feature: GYAE6OF01C7CW5.43.35.D02.1.454.CMB.1.raw
  modified_base (214)..(214): a, c, t, g, unknown or other
  misc_feature (214)..(214): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggngcccagtgtgaggtgcagctggtggagtccgggggagcttagtcagccgtgggggtccctgagactctcctgtgcagcctctggacttccacctttcagtacctacgtggatcgcacgtcgggtccgacctaagttccgtagggaaaggctggtgtggtctcgcgtgtgatgtgacgcactaantgactagngcggtagtcgtgtggaagggcctattccacctattcctaccgaagacgaacaaccgaccaaacgaacacacgttgtacttgacaatgaactgtactgagacggccgaggaccacggtctgttgttacttgtagtagtaagtag

SEQ ID NO: 12835 - DNA, 576 bp, Homo sapiens
  misc_feature: GYAE6OF01BBDWA.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccggggagcttagttcagcctgggggtccctgagactctcctgtgcagcctctggattcaccttcagtacctactggatgcacgtgggtccgccaagttccgtagggaaacggcgtggtgtggtcgtcgcgtgtgtagtgttgacggacgactaatagtggtacgtagtgtcggtagtcgtgtaggtaagggaccggtattactacctactacgtccacgacgaacaacgaccgaagaacaacgactagtacttagaccaatacgaagtacgtgtacgaggacgaccggacggactacggacgttcgtcggttactttagtgttgtaagtaagg

SEQ ID NO: 12836 - DNA, 687 bp, Homo sapiens
  misc_feature: GYAE6OF01CDPNM.43.35.D02.1.454.CMB.1.raw
tcagtgtgagtagtcacgaccggtgctcgatttagcacacgatagttgggtttgggcacgaccggtgctcgatttagcacacgatagttgggtttggggagccccagccctggattcccagctgtttctgcctgctgatcaggactgcacacagagaactcaccatggaagtttggctggcgttgggttttcctcgttgtcgttagttttaaaaggtcgccgagtgtgaggtgcgagcgtggtggaggtccggggagtcgttagttcgaggtccggtgggggtccctggacgtacgtctccgtgtcgcgacgccgttcgtggtacttcctacctttcacgttacctacgtggatcgcgtacgtcggtccgacgtacgttccggagggaaggtcgtggtggtcggtcgtcggtcgttgtagtaacgttggttacggacgtactaacgttaaagtacgtacggtacttagtcggtacgggtagttcgtaggtacggaacgggtaccgttagttacccgaccgtacgttaccgtaccgaaggtaaccgaaccgaaaccgaccgaaacgaaccaccgtaacgttacgttaacgtacgtaacctaaagtacgaaacgtacgtcgtagtaacggaccggacggaacggaccgtacggtcttagttacgtttaagttcgtagtagtaagtaagg

SEQ ID NO: 12837 - DNA, 740 bp, Homo sapiens
  misc_feature: GYAE6OF01A5Q6Y.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgtttaaaaggtgcccagtgtgaggtgcagctggtggaggtccgggggaggcttagtcagccgtgggggtccctggagactctcctgtcgcacgcctcgtgggacttccacctttcacgttacctactggatcggctacgtcgggtcccgccgtaacggttccgtaggggaaacgggtcgtagggttggtcggggttctcggtcggttggttcggtaagttgggtttacggaaccgggtactaaacgttaaagttacggttacgggtaacgttagtcgggtacgggtacggttccgttagggttacgggaaacgggggtcccggttaattacccgtaaccctacgtcccgttaccgaacggaacgaacccgaaacccggtacccgaaaacggtaaacctaaccgtaaccgttacggttaacctttacggaactaaaacgtcggaaaactagtaccgtagggaacggacgggtacccgggacggtaaccgaccgggtcttacggttacgttacgttttcgtaggttgggtaaaggtaagg

SEQ ID NO: 12838 - DNA, 575 bp, Homo sapiens
  misc_feature: GYAE6OF01B561W.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccggggagcttagttcagccgtgggggtccctgagactctcctgtgcagcctctggattcaccttcacgtacctactggatcgctacgtcgggtccgcctaagttccgtagggaaaggtcgtggtgtgggtctcggcgtgtagagtgtgacgctactaatagtaggactagtggcggagtcgtgtaggaacgggtccgtattcgaccgtatcctaccagaacgacaacgaccaaagaacacacgttacgtacttagactaatacgaacgagtcctaggaagacgacggaaggaccgacggtcttaggtagttatttgtaggttagtaagtacg

SEQ ID NO: 12839 - DNA, 785 bp, Homo sapiens
  misc_feature: GYAE6OF01AJ5Z2.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggaggtccgggggagcttagtcagccgtgggggtcctgagctctcctgtgcagcctctggattccacctttcagtaccctactggatgctacgtcgggtcccgccaacggttccgtaggggaaaggtccgtggttggtcggggtctcggtcggtgtggtaacgttggttgaccgggtactaaccgttaaagttagtacgggtaacttagtcgggtaccgggtagtccgttgggtacgggtaacggggtcccgtaagtttacccaacccgtacttccgttacccgaaggtaaacccggtaaccaaaccccgggtaaccccgaaaacggtaaaaccccaccgttaaaccgttacggtttaaaccgttacgggtaaacctaaaacgttacggaaaaccgtaaggtttacccgtaacgggtaaacgggttaaccgggaaccccggggaacgggtaaacccggaacccgggggttacgtttacgggtttaaccggttttaaaccggtttttacccggtaaggggttttaagggttaaaacgggttaaaagggg

SEQ ID NO: 12840 - DNA, 542 bp, Homo sapiens
  misc_feature: GYAE6OF01B7RUD.43.35.D02.1.454.CMB.1.raw
  modified_base (473)..(473): a, c, t, g, unknown or other
  misc_feature (473)..(473): n is a, c, g, or t
  modified_base (526)..(526): a, c, t, g, unknown or other
  misc_feature (526)..(526): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggagcttagttcagcctgggggtccctgagactctcctgtgcagcctctggattcaccttcagtacctactggatgcacgtgggtcccgccaagttccgtagggaaagggctggtgtgggtctcgcgtgtgatggttgacggcactaatatggactatgcggagtctgtggaggccatcacatcctcagacacaacgcaagacacactgtacttgacaatcgaacngtctaggacgacgaccggaggtaccacgggtccttggttacgttattttccgnggttaggtaagtacgg

SEQ ID NO: 12841 - DNA, 547 bp, Homo sapiens
  misc_feature: GYAE6OF01CRGPG.43.35.D02.1.454.CMB.1.raw
  modified_base (382)..(382): a, c, t, g, unknown or other
  misc_feature (382)..(382): n is a, c, g, or t
  modified_base (447)..(447): a, c, t, g, unknown or other
  misc_feature (447)..(447): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcagccgtgggggtccctgagactctcctgtgcagcctctggattcaccttcagtacctactgatgcactggtccgccaagttcctagggaaggctggtgtgggtctcgcgtgtgatgtgacgnactatagtgactatgcgagtcgtgtgagggccgtattcacctatctcagaagacaaccgcgaaanaacacactagtacttagaacaagtgaaactgtactagagtacgaccgaagggaccacgggtcttacggttacgttacgtttcgtaggttagtaaggtaag

SEQ ID NO: 12842 - DNA, 654 bp, Homo sapiens
  misc_feature: GYAE6OF01DAMSC.43.35.D02.1.454.CMB.1.raw
  modified_base (538)..(538): a, c, t, g, unknown or other
  misc_feature (538)..(538): n is a, c, g, or t
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcaggactgcacacagagaactcaccatggaatttgggctgggcttgggttttcctcgttgcttagttttaaaaggtgccagtgtgaggtgcagtcgtgggtggaggtccgggggagtcgttagttcgaggtccgtcgggggtccctggagctcgtcctgtcgcacgtcctcgtggtattcctaccgttcacgttacctacgtggatgcctacgtcgggtccctaccgtaacggttccggtaggggaaaggtcgttagggtggttcgggtcgtcggtcggtggtagtaagttggttacggacggtactaacgtaagtagtacggtactagtcggcgtagttcgtaggtaggaacggtcgtataccactactccgtacaagacgaacaaccgaccgaaanaccacgtacttacgtactacgaactaagtacgaagtagtaccgtaggacgacggtaccggaacggtaccgacggtcgtttaggtacgttagttacgtaggtaaggtaaggtaacgg

SEQ ID NO: 12843 - DNA, 763 bp, Homo sapiens
  misc_feature: GYAE6OF01CQMZI.43.35.D02.1.454.CMB.1.raw
tcagtgtgagtagtcacgaccggtgctcgatttagcacacgatagttgggtttggggaagctctgcttcagctgtgagcgcagaaggcaggactcgggacaatcttcatcatgacctgcctcccctctcctcctcacccttctcattccactgcacgagggtcctgggcccagtctgtctgacgcacgcccgtccctcgagtcgtcctcggcccggaccccaagggtaccaaggtaacggtccaacctactcctccctggccacgtacgggaagttaccggtacccaaacgtagtttaggggttaaattttttagtagttactccgttagggtaaaccctaacgtaacggtcccaaagggaaaccaacccggtcccccctaaaaacgtttccccttacggttttaaccactaaacctaagttaacgtacgtacgaccggtaaccgtcgaagggtacttccgtagtacccgttattttcgcggtacctacgaacgtcgtcggcaccgttcgacgtccctacccgtcggtctaacgtccgaacccggtacctaccgaacggtacggttacggggacggtaccgtacgtacttacgttacgtcggaacggtaaccgtaggtcgaacgtaccggtacgggtaccggggtagggttgggttcggtcgggacgggtacgggtacgtacgggtcgtaccgtcggtaggaccgtacggtacccgaacgggtcctaccggtccccgtggttaacctccgttccgtaccccgg

SEQ ID NO: 12844 - DNA, 615 bp, Homo sapiens
  misc_feature: GYAE6OF01BDPL5.43.35.D02.1.454.CMB.1.raw
  modified_base (579)..(579): a, c, t, g, unknown or other
  misc_feature (579)..(579): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggtttcctcgttgctgttttaaaaggtgcccagtgtgaggtgcagctggtggagtccgggggaggcttagttcagccgtgggggtccctgagactctcctgtgcagcctctggatttcacctttcacgttacctactggatggcacgttcgggtccgaccgtaaggttcccgtaggggaaacgggtccgtagggttggtcggggtctcggtcgtggtgaagttggttaggacggtcaacgttaagtagtagggtactagtggacgggtagtcgttggtaggaacgggtccagttccacctatcctaccgagacgaacaaccgaccaaagaaccacaaccgttgtacttcggactaaatcgaacagtctagagacggtccgaggaccacgggtntcggttagttactttacgtagttaggtaagtaacgg

SEQ ID NO: 12845 - DNA, 750 bp, Homo sapiens
  misc_feature: GYAE6OF01ANBQD.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggtttcctcgttgctgtttaaagtgccagtgtgaggtgcagcgtggtggaggtccgggggaggcttagttcagccgtgggggtccctgagactctcctgtcgcagtcctgtggacttctaccttcacgtacctacctggatcgctacgtcgggtacccgtcctaacggttccgtaggggaacgggtcgtgggtcggtcgggttcgtcggtcggtcggtaggtaagttcggttacggacggtactaacgttaaagttacggtacggtacgttaaggtcggtacggggtaagtttccgttagggtaacggggtaaacggggtacccgtaacgtttacccgaacccgttaagttccccgtaccgggaaagggtaaaccgaaccccgtaaaccgggaaccccgtaaaaacggaaaccctaaccgttaaaccgttacggttaaccgttacgtaaccgtaaaagtacgaaaccgtagttaccgtagggaacggacggtacccggaaagggacccgtacgggtaccttagggttacggtttaactttcgggtaagttggtaaaggtacggg

SEQ ID NO: 12846 - DNA, 689 bp, Homo sapiens
  misc_feature: GYAE6OF01C5920.43.35.D02.1.454.CMB.1.raw
tcagtgtgagtagtcacgaccggtgctcgatttagcacacgatagttgggtttgggcacgaccggtgctcgatttagcacacgatagttgggtttgggggagcccccagccctgggattcccagctgtttctgcctgctgatcaggactgcacacagagaactcaccatggaatttgggctgggctgggtttctcgttgctgtttaaaaggtgcccagtgtgaggtgcagctggtggagtccgggggagcttagtcagccgtgggggtccctgagtactctcctgtgcagcctctggattcaccttcagtacctactggatgcacgtcggtccgacctaagttccgtagggaaggtctggtgtgggtctcggcgtgtgaagttgttgacggcaacttaatagtggaactagtggacgggtagttcgtggtacggaaacggggtccgtaagtttccaacctagttacccgtaccaagggtaacgaaacccaaaccgggacccaaaaggaaaccctaacgtaaccgttacgtaaccgtttaggaaaccctaaagtacggtaaaaccgtaacggttcccttaagggaaaccgggaacgggtaacccgggaacgggtaaacccgtaaccggggttccttaggggtttacgtttaaacgtttttcggtaagggtaacggtttaaaaggaacggg

SEQ ID NO: 12847 - DNA, 589 bp, Homo sapiens
  misc_feature: GYAE6OF01BJG4U.43.35.D02.1.454.CMB.1.raw
  modified_base (341)..(341): a, c, t, g, unknown or other
  misc_feature (341)..(341): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaagtgcccagtgtgaggtgcagctggtggagtccgggggagcttagtcagccgtgggggtccctgagactctcctgtgcagcctcgtggacttcacctttcagttaccctactggatgctacgtgggtcccnccgtaagttccgtagggaacggtctggtgtgggtctcgcgtgtgtatgtgacgcactaatagtggtactagtggcggtagtcgtggtaggaacgggtccgtacttccacctatcctaccgaggacgacctaaccgaccaacgaaccacgactagtaacttgactaatcgaacgtagttcgtagacgcggaccgtaacggaccgtacgggtcttggttacgtttactttgtaggttagtaaggtaacgg

SEQ ID NO: 12848 - DNA, 595 bp, Homo sapiens
  misc_feature: GYAE6OF01AP12D.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcagccgtgggggtccctgagactctcctgtgcagcctctggattcaccttcagttacctactggatgcacgtgggtcccgcctaacggttccgtaggggaaagggcgtggtggtcggggtctcggcgtgtgtaatggttggacggcaacgtaatagtggactagtcggcggtagtcgtggtaggaacggggtccgtaattaccgacctatacctaccgaagacgaaccaacgaccaaaggaaccacgaactgttacttagacaatagaacagtacgtagagacggtaccggaaggaccacggctaggttgttactttcgtggttgtaaggtaacgg

SEQ ID NO: 12849 - DNA, 851 bp, Homo sapiens
  misc_feature: GYAE6OF01BHFTE.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggtttcctcgttgctgttttaaaaggtgcccagtgtgaggtgcagctggtggaggtccgggggaggcgttagttcaggccgtgggggtccctggagactctcctgtgcagcctctggattcaccttcagtacctactggatcgctacgtcgggtcccgaccgtaacggtttcccgtaggggtaaacgggtccgttggggttgggttggggttcccgtcggtccgggttggttacggtaaagttgggtttacgggaccggtaccgtaaacgttaaacgttacgtacggggtaaccgtttaacggtgggtaccggggttaacggttccgtttagggttacgggaaacgggggtacccggtaacgtttaccccgaaacccgttaacgttcccgttaacccggaaaggtaacccggtaaaaccccgaaaccgggtaaccccgaaaacgggtaaaaccctaaacccgtaaccgtttaaccggtttaaaccgtttacggaaaccgttaaaacgttaacggtaaaacccgaaccggtttaccggtaaacgggtaacgggtaaccggaaccccggggaaacgggtaacccggtaacccgggttacgttacgggttttacggtttaacgtttttaacccgggtttgggttaaacggggttaaacgggtaaaggg

SEQ ID NO: 12850 - DNA, 743 bp, Homo sapiens
  misc_feature: GYAE6OF01D7AXN.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggacttcccagcttgtttctgcctgctgatcaggactgcacacagagaactcaccatggtaatttgggctgggtcttcgggtttttcctcgttgtacgttaggttttaaaacggtcgcccgtaggtgtgaggtgcgtagtcggtgggtgggtacgggtccgggggtaggtctttaggttcgacggtccggtcggggggtcctggacgtaccttcgtcgtgtcgcgtcgtctcgtgtacttcctaccgttacgtacgttacctcgtggtactcgtccgtacggtccggtaccgtacgtacggttccggtagggaggtcggtggtcggtcggtcgtggtacgtcgtagtagttgtacggcggtactaagtaagtaggtagtacgttagtcggacggttacgtcgtagggtaacgggtaacggtcgttaacttaccgaacctcgttaccgacgacggaaccgaaccgaaccgaaccgtaaacgtaacgtaccctaggttacgtaccgttaacgaaccgttaagtacgtaacgttacggtacgtaacgggacgtacgggacccgtaaacggccggttaaccggtcggttaggttacgttttacgttacggttacggtttaagggtaagtacggg

SEQ ID NO: 12851 - DNA, 702 bp, Homo sapiens
  misc_feature: GYAE6OF01BWECV.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaattgggctgggcttgggttttcctcgttgcttgtttaaaaggtcgcccagtgtgaggtgcagcgtgggtgggaggtccgggggaggtcttagttcgaggtccggtcggggggtccctggacgtacctcctccgtggtgccacgtcctcgtggtacttcctacctttcgacgttacctacgtcggtattcgccgtacgttcgggtacccgtacctaacggtttccggtaggggtaaacgggtcgttagggttcggtcgggtcgttcggcggttcggttaggtaagtttcggtcggaccggtactaactaagtagtacgggtactagtcggacggtagtacgtggtacgggaacggtccgtacgttccaccctcgtacctccgaagtaccgaaccgaaccgaccgaaacgaaccacgtacgttacgttactacgaactaaacgtacgaacacgtctaaggacggacggaccggaacgggacgaccgggttcgttacggttacgtttactttacgtaggttaggtaaaggtagg

SEQ ID NO: 12852 - DNA, 750 bp, Homo sapiens
  misc_feature: GYAE6OF01ASBS9.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggtttcctcgttgctgttttaaaaggtgcccagtgtgaggtgcagctgggtggaggtccgggggaggtcttaggttcaggccggttcggggggtccctggagactcctcctgtgcagcctcgtggacttccacctttcacgttacctacgtggtactcgcgtacgttcgggtcccgtaccgtaacggttccgtaggggaaacgggtcgtgggtggtcggggttctcggcggtggtacggtaagttgggttacggaccgggtactaacgttaaagttacgtacgggtacttagtcgggtacgggtaacgttccgttagggtacgggaacggggtacccgtaacgttaccgaaccccgtactcccgtaccgaaacggaacggtaaacccgaaacccggaacccgaaaacgaaccgtaccgtaacgttacggttaaccttacggaaacctaaacgtacggtaaacgtacgtaccgtaaggaaccgggtaccgtaaccgggacggaacccggtaccgggtcgttaacggttacgtttacgtttagtacggttaggtaaaaggtacggg

SEQ ID NO: 12853 - DNA, 528 bp, Homo sapiens
  misc_feature: GYAE6OF01DIW9Y.43.35.D02.1.454.CMB.1.raw
  modified_base (414)..(414): a, c, t, g, unknown or other
  misc_feature (414)..(414): n is a, c, g, or t
  modified_base (472)..(472): a, c, t, g, unknown or other
  misc_feature (472)..(472): n is a, c, g, or t
  modified_base (482)..(482): a, c, t, g, unknown or other
  misc_feature (482)..(482): n is a, c, g, or t
  modified_base (486)..(486): a, c, t, g, unknown or other
  misc_feature (486)..(486): n is a, c, g, or t
  modified_base (504)..(504): a, c, t, g, unknown or other
  misc_feature (504)..(504): n is a, c, g, or t
  modified_base (510)..(510): a, c, t, g, unknown or other
  misc_feature (510)..(510): n is a, c, g, or t
  modified_base (516)..(516): a, c, t, g, unknown or other
  misc_feature (516)..(516): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcagccgtgggggtccctgagactctcctgtgcagcctctggattcaccttcagtacctactggatgcgacgtgggtccgccaagttccgtaggggaacggcgtggtggtgggtctcgcgtgtgatgtgacggcactatagtggacttagtgcggntcgtgtggaagggccgtattcacactctccagacgacacgcaaagacacactgtactnacaatgaacngtcngagacgcgaggacacggntagttnttattntgtgtaagtagg

SEQ ID NO: 12854 - DNA, 605 bp, Homo sapiens
  misc_feature: GYAE6OF01EWSTJ.43.35.D02.1.454.CMB.1.raw
  modified_base (460)..(460): a, c, t, g, unknown or other
  misc_feature (460)..(460): n is a, c, g, or t
  modified_base (498)..(498): a, c, t, g, unknown or other
  misc_feature (498)..(498): n is a, c, g, or t
  modified_base (596)..(596): a, c, t, g, unknown or other
  misc_feature (596)..(596): n is a, c, g, or t
tcagtgtgagtagtcacgaccggtgctcgatttagcacacgatagttgggtttggggaagctctgcttcagctgtgagcgcagaaggcaggactcgggacaatcttcatcatgacctgctcccctctcctcctcacccttctcattcactgcacagggtcctgggcccagtctgtcttgacgcagcccgccctcagtgtctgcggccccaggacagaaggtcaccatctcctgcactggaagtacgtccaaactagttagggtaaattttttatgttactcccttacgggttaacccaaacaaacgttcccaaggaaaccaccggacccccctaaaactcccttacgttttaactccaactaatagtacagccgaccgtcagggtacttccgtgtacccgtattttcgtggcctccaagtctggctacgtcacgccctaccgtggtccatccaccggtcnccgaggaccgtggggaccgaggccgtaattacgtacgnggacggaactagtgggactaccgaggtccggtagggttggtcggtcggcggaggacctaggtcgaccgtcgtagcacgccgagctccgccctggtccngtcgtcccg

SEQ ID NO: 12855 - DNA, 696 bp, Homo sapiens
  misc_feature: GYAE6OF01ECXW4.43.35.D02.1.454.CMB.1.raw
  modified_base (144)..(144): a, c, t, g, unknown or other
  misc_feature (144)..(144): n is a, c, g, or t
  modified_base (212)..(212): a, c, t, g, unknown or other
  misc_feature (212)..(212): n is a, c, g, or t
  modified_base (249)..(249): a, c, t, g, unknown or other
  misc_feature (249)..(249): n is a, c, g, or t
  modified_base (264)..(264): a, c, t, g, unknown or other
  misc_feature (264)..(264): n is a, c, g, or t
  modified_base (288)..(288): a, c, t, g, unknown or other
  misc_feature (288)..(288): n is a, c, g, or t
tcagtgtgagtagtcacgaccggtgctcgatttagcacacgatagttgggtttgggggaggcttgatacagccggggggtccctgagactctcctgtgtagcctctggattcacctttaacaactatgccatgacctgggtccnccaggctccgagggaagggctggagtgggtctcaagtaataagtggaagtgctggtaccatactttangcagactccgtgagtcgggccgttcacgatctcaganactaatccaaagacncgctgtgtctgacaaagtcgaacngcctgacgacgaccgaagaccgacggtctaattacgtacgtgtagcggaagcggcgtaggaatagtacgtattgtttgacgttggtttacttcgctactaactacgtactacgtcgtttggacgtcggtacgggaccgaacggaccgtacggtcctaccgtctcccgtacgaccgtacccgtacccgaaccgaaccggtcccctacgttcccggttacccgttccccgtacggtcccgtcccgtacgtcccgtaccggaccgggtaccgacccgtacccgtacggaacgtaccgaccgtaaccggccggtccggtcccggtcgggtccgttacccggtccggttaccgggtaaccgtaacccggttaccttaaccccgttaacctaacccgtaccgtaccgtaaaccg

SEQ ID NO: 12856 - DNA, 687 bp, Homo sapiens
  misc_feature: GYAE6OF01DOB7D.43.35.D02.1.454.CMB.1.raw
  modified_base (667)..(667): a, c, t, g, unknown or other
  misc_feature (667)..(667): n is a, c, g, or t
tcagtgtgagtagtcacgaccggtgctcgatttagcacacgatagttgggtttgggcacgaccggtgctcgatttagcacacgatagttgggtttggggagccccagccctggattcccagctgttctgcctgctgatcaggactgcacacagagaactcaccatggaatttgggctgggcttggtttcctcgttgtcttagtttaaaaggtgccagtgtgaggtgcagtcgtggtggacgggtccggggaggtcgttagtcgaggtccggttgggggtccctggacgtacctcttccgtgtcgctacgtcctcgtggtacttccgtaccttacgacgttacctacgtcggtactcgacgtacgtcggtacccgtaccgtaacggttccggtagggtaacggtcggttggtcggtcggttcgtcggtcgtgtacgtagtggtcgacgtactacgtatagtgactagtcggcggtagtcgttaggcggaacggtccgtacttaccaacctcgtacctaccgaagtaacgaaccgtaaaccgaaccgtaaacgaacctacctaaccgttcgtaacgttacgaaactaagtacgaacttagtacctaaggaacggtaccggacggtaaacggcccgttaacggcgttttaaggttcgttaacttttacgnggttaaaggtaacggtaagg

SEQ ID NO: 12857 - DNA, 678 bp, Homo sapiens
  misc_feature: GYAE6OF01BCFVR.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctggggctgggtttttcctcgttgcttagtttttaaaaggtcgcccagtgtgaggtgcagcgtgggtggaggtccggggggaggtcttagttcgaggccgtgggggtccctgacgactctcctgtgcacgcctctggactttccacctttcctagtaccttacgtggtactcgcgacgtcgggtcccgtaccgtaacggttccggtaggggaacgggtcggttagggtggttgggtcgtcggtcggttggtagtaagtggttacggacggtactaactaagtagtcgggtacgtagtacggcggtacggttcgtaggtacgggaacgggtaccgtacgtcctactacgtccgtaccgaggtaacgaaccgaaccgaaccgaaacgaaccgaacctacgtacggttaactacgaactaaatacgaacgtagtacgaggacgacggacccggaggacggacgtgttacggttagttactttagtaggttaagtaaggtaagg

SEQ ID NO: 12858 - DNA, 886 bp, Homo sapiens
  misc_feature: GYAE6OF01CHBFI.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccagtggtaatttgggcgtgggtcttgggttttcctcggtttgcgtttagttttaaaacggtcgtcccgaggtgtggaggtgcctaggcgtgggtagggtacgggtcccggggggtaggtcgtttaggttcgacgggtccgggttcggggggttcccctaggtaacgtccgttccgttccgtggttcgaccgtacgtccgttcgtcggtacttaccctaccgtttaccgtaacgttacccgtacgtcggtacgtcgtccgtaaccggttccgggtaccccgtaccgttaaccggtttacccgggtaaggggtaaaccgggtccggtttgggttcgggttcgggttccgtccggttcggttaggttaaggtaacggtttcgggttacggaaccgggtactaaccgttaaagtcggttagggtaaccgttggtacgggtaccgggttaagtttcccggtaagggggttaaccggaacggggttacccgttaacgtttacccgaaccgttacgttacccgtacgggaaacgaacccggaaacgtaaaccccggaacgtaaaaccgtaaacccgtacgtaacggttaccgttaacgttacgaaacttaaacggtacgtaaacctaggtacgtaacgggtaacggaacggacccgggtaaagggtccctaacgggttgtttaacggtgttttaaacgtcggtttaaggtaacggaaacggtttaggg

SEQ ID NO: 12859 - DNA, 690 bp, Homo sapiens
  misc_feature: GYAE6OF01BAT4V.43.35.D02.1.454.CMB.1.raw
tcagtgtgagtagtcacgaccggtgctcgatttagcacacgatagttgggtttgggcacgaccggtgctcgatttagcacacgatagttgggtttgggggagcccccagccctgggattcccagctgtttctgcctgctgatcaggactgcacacagagaactcaccatggatttgggctgggtcttgggttttcctcgtttgcttaggttttaaaaggtcgccaggtgtgaggtgcagcgtggtgggacggtccgggggagtcttagttcgacggccggtcggggtccctgacgtaccttcgtccgtgtgcgacgtccgttcgtggtactttcctaccctttcgtaccgttacctaccgtggatcgccgtacggtccgggtccgtaccgtaacgttccggtagggaagggtcgttggtggtcggtcgtcgtcgtgtagtagtgtacgcgtactaatagtagtgtactagtggtacggtagttcgtaggtaggaacgggtaccgtacttaccgaccgtactaccgaccgaaggaacgaaccgaacgacccgtaaacgaacccgacgtaaccgtacgttaacttacgaacctaagtacgtaacgtacgtacctagggaaccgtacggaccgggaacgaccggtacggtcgtttagttacgtttattaccggtagttaagggtaagtaaggg

SEQ ID NO: 12860 - DNA, 879 bp, Homo sapiens
  misc_feature: GYAE6OF01C1BRV.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggacctgcacacagagaactcaccagtaggtaagtttgggcgtggggtcttcggggtttttccttcggttgtacgtttaaggttttaaaacggcgtacccgaggttggtgaggtgcgagtcgtgggtagggacgggtccgggggtagtcgtttacggtccgtacgggtccgggttcggggggtccctggtaacgtaccgttccgtccgttggtcgaccgtacgtccgtcgttcggtactttccgtaaccctttacgtaacgttcccttaacgtcggtaacgtcgtaccgtaccggttcgggtacccgtaccggttaaccggttaccgggtaacggggtaacggggttcgttacggggttcgggttcggggttcctaccggggttcgtaggttaaggtagttcggttaacggacggtactaaacgttagtagtacggtacgttggtacggtacgggtacggtttacgtagggtaccgggaacgggttaccggtaacttacccgtaaccgtcgttaccctaaccgggaacgtaaaccggaaccgtaaacccggaacgtaaaaccggaacctaacccggtaacgttaacgtttaaccgacgggtaaaccctaaaggttaaccggaacgtaaccggttaccgtaaaggggtaaccgaacccgggtaccggaaacgggtcccggtacgggtcggttacggttacgttttacggttaggtaaggttaacgtaaggtaacggg

SEQ ID NO: 12861 - DNA, 748 bp, Homo sapiens
  misc_feature: GYAE6OF01BU4UQ.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggcttgggttttcctcgttgtcttagttttaaaaggtgcccagtgtgaggtgcagcgtgggtgggaggtccgggggaggtcgttaggttcacggtccggtcggggggtccctggacgtaccgtccttcctgtcggcacgtccttcgtcggtacttccctacctttacgtacgtaccctacgttaggtagtcgtccgtaccggttcgggtacccgtaccgtaacggtttccggtaggggaaacgggtcgtgggttggtcgggtcgtcggtggttagtacgtaagttcggttaggaccggactaacgttaagtacgttacggtaacgttaggtcggtacgggtacggttcgttagggttacgggaaccggggtaccgtacgttacctaaccgtacttacccgtacgaacggaacgtaaccgaacccggaaccaaacgaacctaacctaccgttacgttacgttacgtaactaaacgtaacgtaacgtacgtacggtagacgaccgggacgaacgggtaccggtacgtacgttggtttacttacgtttacgtaggttaagtaaggtacgg

SEQ ID NO: 12862 - DNA, 783 bp, Homo sapiens
  misc_feature: GYAE6OF01AQVH2.43.35.D02.1.454.CMB.1.raw
  modified_base (223)..(223): a, c, t, g, unknown or other
  misc_feature (223)..(223): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagactcacatgtattggcgtggtcttcggtttcctgttgtcgttagtttaaagcgacctagtgtggngtgcgtagtcgtggtgggtacgggtaccggggtaggttctttacggtccgacggtccgggttccgggggtacccctaggacgtaccttccgttccgttggtcgtaccgtacgtccgttcgttacggtacttacccgttaccgtttacgtacgtaccgttacgtaggactacggtaccgtacggttcgggtacccgtaaccggttaacggtttccgggtaaggggaacggttcggttagggttcggttcgggtcgtcggtcgttaggtacgtagttcggtacggtacgtactaacgttaagtacggttacgtacgtagtcgggtacggtcgttcggtaggtacgggaaccgggtaccttacgtacccgacctacgtacccgtacgaacgtaaccgaaaccgtaaccgaaccgaaacgtaacccgacgttaacgttacgttaacgtacgtaaactaacgaacgtacgtagtacggtaacggacggtaccggaccggaaggtccgtaacgggttattacggtttacgtttacgtttacggaaggttaacggtaaaggttacgg

SEQ ID NO: 12863 - DNA, 826 bp, Homo sapiens
  misc_feature: GYAE6OF01DJQ59.43.35.D02.1.454.CMB.1.raw
tcagtgtgagtagtcacgaccggtgctcgatttagcacacgatagttgggtttgggcacgaccggtgctcgatttagcacacgatagttgggtttggggagccccagccctgggacttcccagctgtttctgcctgctgatcaggactgcacacagagaactcaccatggtaatttgggctgggtcttcgggttttcctcgttgtacgttaggttttaaaacggtcgaccgtagtgtggtaggtgcaggtcgtgggtagggacgggtcgggggagtcgttagtcgacggtccgggtcgggggtccctaggacgtaccgttccgttccgtggtcggcctacggtccgttccgtacggttacctttacccgtaccccgtttacgtaccgttaacccgttacggtaggtacgtcggtacccgtacggttccgggtaccccgtaccggttaaaccggtttaccgggtaaggggtaacgggttggttaacgggtcggttacgggttcgtcccggtaggttagtaacggtaagttcgggttaccggtaacggacctaagttaaacgttacgtacggtacgtaaggtccggacgggttacgttccggttaaggaccggtaaacgggtcccttaagtaacccgaccgttacgtaccccgacgaacggtaaccgaacaacccgaaaccgtaaactaaccgaaccgtaacgttaacgttacgtaacgaagtaaaacgcgtaacgtagtccgtaaagtaaccggaacgggtacccgaagggtaaccgttaccgggtactttaggtacttacgtttaggtaggtaacggtaaagtggg

SEQ ID NO: 12864 - DNA, 621 bp, Homo sapiens
  misc_feature: GYAE6OF01ESIFI.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaattttgggctgggctgggttttcctcgttgctgttttaaaaggtgcccagtgtgaggtgcagctggtggagtccgggggagcttagtcagccgtgggggtccctgagactctcctgtgcagcctctggattcacctttcagtacctacgtggatgcacgtgggtccgccaagttccgtgggaaaggcgtggtgtggtctcgcgtgtgatgttgacggcactaatagtggactagtgcggagtcgtggtaggaagggccgtagttcaccgatccgtccagacgaacccaacgacaacgaaacgtaccaacgttacgtaacttacgactaaacgtacgtaaacgtaacgtaccgtagggaacgtaacgggtacccgggaacggtaacccggaaccgggtcgttaccggttaggttaacgttttaccgttagggttaacggttaagtaaacgg

SEQ ID NO: 12865 - DNA, 672 bp, Homo sapiens
  misc_feature: GYAE6OF01D3M5D.43.35.D02.1.454.CMB.1.raw
  modified_base (216)..(216): a, c, t, g, unknown or other
  misc_feature (216)..(216): n is a, c, g, or t
  modified_base (586)..(586): a, c, t, g, unknown or other
  misc_feature (586)..(586): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcacataggatttggctgggcttgggttttcctcgttgacgttagtttaaaaggngccagtgtgaggtgcagcgtggtgggacggtccgggggagtcgtttacgtcgacggtccggtcgggggtccctggacgtacctccgtccgttgtcgcgtacgtccttcgtacggtacctttcccgtaccgtttactaacggttacccttacgtcggtatcgaccgtacggtccggggtacccgtaccgttacggttacggagggaagggtccgtggtaggtcggtcgtcgtcggtagtagtagtcggtacgtacggtaactacgtaataggtacgtacgttagacggtacggtcgtcgtaggtggaaccgggtctaactcgaacctgtccacgagaacgacaaccgacgaactacactacgttctacgtnaactagtacgactacgtgaggaccgaaggaccgaggaccgtcgggtacttacgggttattacgttagttaggaacgttagtaacgg

SEQ ID NO: 12866 - DNA, 697 bp, Homo sapiens
  misc_feature: GYAE6OF01CFBDF.43.35.D02.1.454.CMB.1.raw
tcagtgtgagtagtcacgaccggtgctcgatttagcacacgatagttgggtttgggcacgaccggtgctcgatttagcacacgatagttgggtttggggagccccagccctggattcccagctgttctgcctgctgatcaggactgcacacagagaactcacagtggaatttggcgtggcttgggttttcctcgtttgtcgttagttttaaaaggtcgtccctagtgtgaggtgcagtcgtggtggtacggtccgggggtagtcgttaggtcgaggtccggtcggggtccctggacgtactccgtcgtgtacgctacgcctcgtggtcttccgtacctcgacgttactacgtggactcgacctcgtccggtaccgtaccgttaacggttccggtaagggaacggtggttcggttaggtcggttcgtcgtacggttgtagtaagttggtcgaacggtactaacgttaatcggtagtacttagtcggcggttgtacgttggtacgggacgtccgtacttaccaccgtagttccccacgtaggaaaccgaccgtaaccgaaacctaacgaacctactaagttcgtaacctttacgaacgtagtaaacctagtacgtacggtagggacgtaacggccggtaaacggccgttacggtattttagccggtttttaaattcgttaaggtaaggtaacgtaaggg

SEQ ID NO: 12867 - DNA, 728 bp, Homo sapiens
  misc_feature: GYAE6OF01D86PC.43.35.D02.1.454.CMB.1.raw
  modified_base (101)..(101): a, c, t, g, unknown or other
  misc_feature (101)..(101): n is a, c, g, or t
  modified_base (208)..(208): a, c, t, g, unknown or other
  misc_feature (208)..(208): n is a, c, g, or t
  modified_base (227)..(227): a, c, t, g, unknown or other
  misc_feature (227)..(227): n is a, c, g, or t
  modified_base (232)..(232): a, c, t, g, unknown or other
  misc_feature (232)..(232): n is a, c, g, or t
tcagtgtgagtagtcacgaccggtgctcgatttagcacacgatagttgggtttggcacgaccggtgctcgatttagcacacgatacgttgggtttgggganccccagccctggattcccagctgtttctgcctgctgatcaggactgcacacagagaactcaccataggaatttggctggtctgggtttcctgttgctgtttaaaagngccagtgtgaggtgctagntaggngtagtccgggagtctagttcagtccgtgggggttaccctgtacgtactcgtccttgtcgcacggtccttacgtcggtaactttcgtacctttaccgacgtttaccgtaacgttcggagtttcgccgtaacgtccgggttaccgacctaaggttccgtacggtaaacgggcgtttacggtcgggttcgggttccgtaacggtcgtacggttaggaacccgtttggttaccgaacgggttaccaaagttaacgttacgtacggttaacgtaacggtttacggaccggtacgttacgttacgttacgggaacgggtccttaccgtttaccgaactaccgtccgttaccgaaggtaccgacccgaaacggttacccgaaagaaccggtaacctaagtcccgttaaacgttggaacctacttaggaaacccgtgtactacggacggtacacggacgcggtaacctggtccgtttagtacttaggttctaaggtagttacgg

SEQ ID NO: 12868 - DNA, 799 bp, Homo sapiens
  misc_feature: GYAE6OF01EYCE8.43.35.D02.1.454.CMB.1.raw
  modified_base (239)..(239): a, c, t, g, unknown or other
  misc_feature (239)..(239): n is a, c, g, or t
  modified_base (594)..(594): a, c, t, g, unknown or other
  misc_feature (594)..(594): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatctaggactgcacacagtagactcacataggatttggctgggcttgggttttcctcgttgtcgttagttttaaaacggtcgaccgtgtcgtagaggttncaggtcgtgggtgggtacggtccggggggtagtacgtttacgttacggtacggtccgggttcggggggtccctggtaaccggtaccttccgtaccgtggtcgccgtacgtccgttacgtcgtactttaccgcctttacggaccgttaacccgtacgtcggtactcggaccgtacggtccgggtacccgtacgttaaccggttccggaaggggtaacgggtcttcgggtaggttcgggttctaccgggtgtacggtttaaggtaggtttcgggttaacgacgggtaaccttaacgttaaataggttaccgtaagtacgttcggacggttagtcgttaggtacgggacgtaccgttnttaaccgacctagtcctacgaacgacggaaccaacgtaaccgaaagacctaaccgtagttacggtacttaacgtaaccgaagtaaagtaccttaaagggtactaacgggaagtacccggggttaaggaacgggttacccgaggggtaccctttaaggttaaccgtttacggttttacggtaaacgttaagggacggtttaaaggg

SEQ ID NO: 12869 - DNA, 762 bp, Homo sapiens
  misc_feature: GYAE6OF01BHW23.43.35.D02.1.454.CMB.1.raw
  modified_base (159)..(159): a, c, t, g, unknown or other
  misc_feature (159)..(159): n is a, c, g, or t
tcagtgtgagtagtcacgaccggtgctcgatttagcacacgatagttgggtttgggcacgaccggtgctcgatttagcacacgataggttgggtttgggggagccccagccctgggattcccagctgtttctgcctgctgatcaggactgcacacaganaactcaccatggatttggctgggctggtttctgttgcttaggtttaaaggtcgccgagtgtgaggtgcgagcgttgggtgggacggtccggggggaggtcgttaggttccgaggtcccgggtcggggggttcccctaggacgtccttccgtccgtggtcgactcggtcctcggtacggtcttccgtacctttacgacgttaccgttacgtggtatcggacctacggtcgggtcccgtacgtaacggttccggaagggaagggtcgttgggtcgtcggggtcctcggtcggttggtaggtaagttcggttacggacggtacctaagtacgtagtacgggtcgtaaggtcggtagggtaccgttggtagggttacgggaacgggtaccgtacgtttaccgaaccgtacgttaccgtaccggaagtaaccgtaaaccgaacccgaacgtaaacggaaccaccgttaacgttacgttaaccgtagaaaccttaaacgtaacgtaaaccgtagttacggaacggaaccggtaccggaacggaccggtacgggtaccggtcgttacggtttaggttaccttttagggaggttaaacggtaaggtaacgg

SEQ ID NO: 12870 - DNA, 775 bp, Homo sapiens
  misc_feature: GYAE6OF01A5SNX.43.35.D02.1.454.CMB.1.raw
  modified_base (215)..(215): a, c, t, g, unknown or other
  misc_feature (215)..(215): n is a, c, g, or t
  modified_base (318)..(318): a, c, t, g, unknown or other
  misc_feature (318)..(318): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgcgtgttttaaaaggngccagtgtgagtgcagctgggtggaggtccgggggagtcttaggttcagccgtgggggtccctgacgactctccgtgtcgcagcctcgtggacttcaccgttnacgtaccgtactggattggctacggtcgggtcccgaccgtaacgttccgtaggggaaagggtccgttagggttggtacggggttcctcggtaccggtttaggtaggtaaacgtttgggtttacggaacgggtacccgtaaagtttaaaacgttaagttacggggtaacgttaagttaggggaccggggttaacggtttacgtacgggtttaacgggtaaaccggggggtacccgttaacgtttacccgtaacccgtaacgtttacccgttaacccgaacggaaacggtaacccaaaaccgggaaccctaaaacggaaacccctaaccgtaaccgttacggttaaccctttaacggaaccgtaaaagtcgtaaaacgtacgttaccgtaggaacgacgtacccgggtaaggacccgtacgggtactcgttagttactttacgtgtacggtaagtaacg

SEQ ID NO: 12871 - DNA, 726 bp, Homo sapiens
  misc_feature: GYAE6OF01EZE4V.43.35.D02.1.454.CMB.1.raw
  modified_base (552)..(552): a, c, t, g, unknown or other
  misc_feature (552)..(552): n is a, c, g, or t
  modified_base (677)..(677): a, c, t, g, unknown or other
  misc_feature (677)..(677): n is a, c, g, or t
tcagtgtgagtagtcacgaccggtgctcgatttagcacacgatagttgggtttgggcacgaccggtgctcgatttagcacacgatagttgggttggggagcccagccctgggattcccagctgttctgcctgctgatcaggactgcacacagtagaactcaccagtggaatttgggctgggtcttcgggttttcctgttgtcgttaggttttaaaaggcgcccgtaggtcgtggacggtgcgagtcgtgggtcgggacgggtccgggggagtccgttgttcgacggtccggtcgggggtcctgacgtacttctcgtcggtcgcgtacgtcctacgtggtaacttcctacgtctaacgttaccgtacgtggtactggccgtacggtcggtccggtactacggttaccgggagggtaacggtcggtggtcgggttcgggtacccgtggtcggttaggtacgtagtacgggttacgtacggactaagtagttagtcgtacgtagtacggtcggtgtacgtggttaacgggacgtacgtacgttaccacggttacnccgtaacgacgacggaaccgacgacgaacgaacctacgtaacgtgttaaccttaacggactaaacggttacgtaacgtacgttacgagaccgggtacggaaccgtaaccgggacggtacccggtnttaacggttctttaacggtttacgttcgggttaagtaaccggttaaggg

SEQ ID NO: 12872 - DNA, 770 bp, Homo sapiens
  misc_feature: GYAE6OF01COKI9.43.35.D02.1.454.CMB.1.raw
  modified_base (103)..(103): a, c, t, g, unknown or other
  misc_feature (103)..(103): n is a, c, g, or t
  modified_base (643)..(643): a, c, t, g, unknown or other
  misc_feature (643)..(643): n is a, c, g, or t
tcagtgtgagtagtcacgaccggtgctcgatttagcacacgatagttgggtttgggcacgaccggtgctcgatttagcacacgatagttggggtttggggganccccagccctgggattcccagcttgtttctgcctgctgatcgaggactgcaacacgagagtaacctcacaagtggtaagtttgggcgtgggtcttcgggttttcctcggttgtacgtttaggtttaaaacggctccgtagtgtggacggtagctaggtcggtgggtgggtaccgggtccgggggtaagttcttacggttccgcgggttccgggttcggggtcctaggtacgtcctcgtacgtgtcgacgcgtcctcgtagtacctaccttacctacgtacgtacctacggtaggtactcggtacgtacggtaccgggtccgtaacgttacggtacgggtaacgggtaaggtccggtggttcgggtacgtcgtacggtcgtgtagtaggttcgtacggacgaactagtacgtagtacgtcggtacgcggtacgtagtcgaggtaccggacggtactacgtaccaccgttgacccgtacgaagaacccgtaacgaaccgtaacgtaaccctaactacggtaccttaacggtaacccgttaanaacggttaacgtaaccgtacggacgtaacggtacggaacggtacccggtaaggaccgggttaccgtacgttcgggttttacgtaacggttttagtacccggttaaggtacccgggttaattacgggg

SEQ ID NO: 12873 - DNA, 889 bp, Homo sapiens
  misc_feature: GYAE6OF01DLE67.43.35.D02.1.454.CMB.1.raw
  modified_base (261)..(261): a, c, t, g, unknown or other
  misc_feature (261)..(261): n is a, c, g, or t
tcagtgtgagtagtcacgaccggtgctcgatttagcacacgatagttgggtttgggcacgaccggtgctcgatttagcacacgataggttggggtttggggacgccccagcccgtgggacttcccagcttgtttctgcctgctgatcgaggactgacaacacgagtaacgaacctacacctagtaggtaagttgggcgtggtcgtttcggtttccgtcgttgtacgttaaggttttaaacggcgtaccgtaggtggtaggnggtcgacgaggtcggtgggtggggtacgggtcgggggagttcgttacggtccgacggtccggggttcggggtcctaggtacgtaccgttcgtcgtggtacgccgtcgtccgttacgtcggttaacttcccgtaacgtttacgaaccgtttaccgtagtcgggtactcggtaccgtaccggtttccggacccggtaaccgttaacggttaccgggaggggtaacggtcgttaggggtcggttacgggttccggtgtacgggttagtaaggttacgttcgggttacgaccggtaataaacgtagttacgtacgtaacggtacggtcggtacggtacggttaccgtaagggggtaacccgggtaacggtaccccgtaacttacccgtaccgtaacccggttccggtaaaccaaacgggtaaacccgaaccgaaacccggaaaccgttaaaccggaaaccttccggttaaacggtttacgtaaaccggtaattaaacccgtaaggtacgaaacgttcggacggtttaaaaccggacgggaccgggtaaacccgggtaacggaccggttaccggttaagttgttaaaacccgggtttttgttaaccggaagtttaaagggaacgggttaacgg

SEQ ID NO: 12874 - DNA, 847 bp, Homo sapiens
  misc_feature: GYAE6OF01EO0Y2.43.35.D02.1.454.CMB.1.raw
  modified_base (837)..(837): a, c, t, g, unknown or other
  misc_feature (837)..(837): n is a, c, g, or t
tcagtgtgagtagtcacgaccggtgctcgatttagcacacgatagttgggtttgggcacgaccggtgctcgatttagcacacgatagttggggtttgggggacgccccagcccgtgggacttcccagcttgtttctgcctgctgatcgaggtactgacaacaacaagaacaactcaaccagtagggtaagtttcgggacgtgggttccgttcgggttttcctgttcgtacgtttaggttttaaacggccgaccgtaggttggtggtaggttcgacgtacggtcggttgggtacgggggtacgggtaccgggggtagttcggtttacgtcggaccggggtccgggttccgggggtcctagacgttaccgttccgttcgtcggtcgtaccgtcgtccgttcgtacgttaccttccgtaccgttacctacggttaccctacggtaggtcgtcggaccggtccgggtccggtaccggtaaccggtaaccggtttacgggaacgggtaaccggtggttcggtaggttccgggttcgtacggtacggttagggtacgttaggttcggtacggtaaccgtataacggttaagtacgtacggttaggtacggttaggacgggtcgttagggtacggaacgggtcgttaaccgtcttaaccgtaccgtacgtacgtacgaacgaacgacccgaacgtaaccgacgtaaacctaccgtaacgttaccgttaacaacgttaacaaggtaacgtaacggtaggacgtaacgggacggtaacccgtaggtaacggacccgggttagttaacggttcgtttacgtttacggttaggtttaccgtaaaggtnttaaacgggg

SEQ ID NO: 12875 - DNA, 804 bp, Homo sapiens
  misc_feature: GYAE6OF01BD09E.43.35.D02.1.454.CMB.1.raw
  modified_base (448)..(448): a, c, t, g, unknown or other
  misc_feature (448)..(448): n is a, c, g, or t
tcagtgtgagtagtcacgaccggtgctcgatttagcacacgatagttgggtttggggaagctctgcttcagctgtgagcgcagaaggcaggactcgggacaatcttcatcatgacctgcctcccctctcctcctcacccttctcattcactgcacgagggtcctgggcccagtctgtcttgacgcacgcccgccctcgagtgtctcggcccggccccgaggaccaaggaacggtccaccattcctcctgaccacgtaggaacgtaccgtaccaactaggtttagggtaactttttatagttactccgttacggtaaccaaacgtaacggtccccgaaggaacccaaccggaacccccctaaaaccttcccgttacgtttactaccaactaatacgtacacggaccgaccggtacgacgggtacttccgtacgtaccgttacgttttcncgggtcctaccgtaacgttccgtacggccgtaaccgtcccgacgtaccccgtaaccgtcggtaccaccgttaccgaccccgggttaacctacccggaaggaccggttacgggggaccggtaaccgggtccgttaacgtttacgttaacgacgggtaccggaaacgtaggtacgggtacctaacggtacggggttacccggggttaggggtttcggggtcggttaccggggaacgggtacgggtaaccgtacgggttaccggtacccgggtccggttaacggccgtaccccggtaccggaaccgggttcccgtaccccggtccccggttaccggtccctccgttcccggttaccccg

SEQ ID NO: 12876 - DNA, 310 bp, Homo sapiens
  misc_feature: GYAE6OF01D94IU.43.35.D02.1.454.CMB.1.raw
  modified_base (282)..(310): a, c, t, g, unknown or other
  misc_feature (282)..(310): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggtcttgggttttcctgttgacttagttttaaaaggtcgcccagtgtgaggtcgcagtcgtgggtgggacggtccgggggtagtcgtttagttcgccgggnnnnnnnnnnnnnnnnnnnnnnnnnnnnn

SEQ ID NO: 12877 - DNA, 788 bp, Homo sapiens
  misc_feature: GYAE6OF01AOPM1.43.35.D02.1.454.CMB.1.raw
  modified_base (183)..(183): a, c, t, g, unknown or other
  misc_feature (183)..(183): n is a, c, g, or t
tcagtgtgagtagtcacgaccggtgctcgatttagcacacgatagttgggtttgggcacgaccggtgctcgatttagcacacgatagttggggtttgggggacgccccagccctgggattcccagctgtttctgcctgtcgtgatcgaggactgcacacagacgactcacagtggtagttggngtgggtcgttggttttccgtcgttcgtacgtttaggtttaaaggccgtaccgtaggtggtaggtggtagcgtacggcggttgggtgggcgggggtaccgggggagtcggttacgttcggcgggtaccgggtcggggtccgtaggtaacgtccgttctccggtgtcgcctacgtccctggtacggtacttacccgtaccgtttacgtacttacccgtcggtaggaccgtcgtacggtacgggtccgtaccgtaccggtaacgtcgggtaggggacggtcggtcggtagggtcgtccggagttcgaggttacgtaggtacgtaccggacgttaactacgtagttacgtacggtaccttggtacggtaggtacggttagtacgggtacggtaccggttacgttaacgacctaccgttcctaccgtaccggacgaacggtaaccggaacctaacggaacgtaaccttacgtacgttaacgtaccgtataaccggtacgtaacgtaacggtacgaacggcgggtaaggaaccccggtacggaacggttaaccgggttggtaaccggtttagttacggttacggttacgtttaggtaacgtgttaaacggg

SEQ ID NO: 12878 - DNA, 688 bp, Homo sapiens
  misc_feature: GYAE6OF01EIURU.43.35.D02.1.454.CMB.1.raw
  modified_base (302)..(302): a, c, t, g, unknown or other
  misc_feature (302)..(302): n is a, c, g, or t
tcagtgtgagtagtcacgaccggtgctcgatttagcacacgatagttgggtttgggcacgaccggtgctcgatttagcacacgatagttgggtttgggggagcccccagccctgggattcccagctgtttctgcctgctgatcaggactgcacacagagaactcaccatggaatttgggctgggctgggttttcctcgttgcttgtttaaaaggtgcccagtgtggaggtgcagcgtggtggaggtccgggggaggcgttagttgaggccgtgggggtccctgacgacttctccgtgtgacngtccgtctggtacttctaccgttctacgtaacctacgtgtactgcgtacgtcggtccgaccgtaacgttccgagggaaacggtcgtaggtggttacgggtctcggtcgtgtaggtagtggttacgacgtacaactaagtagtagggtactagtcggcggtacgtcgttaggacggaagggtcccgtattacccgacctactaccgtaccgaagaaccgtaaccaaccgaacccgaaacgaaccctaacgtacgttacgttaccgtaacgaactaacgtaggaaactacggtaccgtaaggacggaaccggtaccggtaacggaccgaaccgggttcttacgggtttacgtttaacgtttaggttacggttaaaggacgttaaacgg

SEQ ID NO: 12879 - DNA, 704 bp, Homo sapiens
  misc_feature: GYAE6OF01BFB20.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctagttttaaaaggtgcccagtgtgaggtgcagcgtggtgggagggtccggggggaggtcgttacggttcgacggtccggttcgggggggttcccctggacgaacgttcctcccgttggttacgcacggtcccttcgttggtactttcctacctttccgtaacgttacccttacgtcggagtcgcgtaccgttcgggtcccgaccgtaacggttccggtaacggggaaacgggtcggtcggtcggtgggtcgtccgtgggtcggttagtaagttcggttacggtacggtactaacgttaaataggtacggtaactagtggcgggttagtccgttggtagggaacgggtccgtattaccgaccctagtcctaccgagacgaaccaacgaccaagaaccacgtactgtacttacgactaatacgaactagttcgaagacggacggacccggaagggacccgacgggtctaggttacgttactttggtaaggtacgtaaggtaacgg

SEQ ID NO: 12880 - DNA, 553 bp, Homo sapiens
  misc_feature: GYAE6OF01BB9Y1.43.35.D02.1.454.CMB.1.raw
  modified_base (448)..(448): a, c, t, g, unknown or other
  misc_feature (448)..(448): n is a, c, g, or t
  modified_base (495)..(495): a, c, t, g, unknown or other
  misc_feature (495)..(495): n is a, c, g, or t
  modified_base (539)..(539): a, c, t, g, unknown or other
  misc_feature (539)..(539): n is a, c, g, or t
tcagtgtgagtagtcacgaccggtgctcgatttagcacacgatagttgggtttgggcacgaccggtgctcgatttagcacacgatagttgggtttgggggagcccccagccctgggattcccagctgtttctgcctgctgatcaggactgcacacagagaactcaccatggaatttgggctgggctgggttttcctcgttgctgtttttaaaaaggtgcccagtgtgaggtgcagctggtggagtccggggaggcttagttcagcctgggggtccctgagactctcctgtgcagcctctggattcacctttcagtacctactgatgcactgggtccgcctaagttcctagggaaagggctaggtgtgggtctcgcgtgtagaatgttgacggcaactaaatatgggactatagccggagtctgtacgaagggccaagttccaccatcnccagagacaacgcaaagaacacgtactgtaccttgacaaatgaaacngtctagagagacccgaaggacgaacgcgtagttacgtactttanacgttgtaaagtag

SEQ ID NO: 12881 - DNA, 787 bp, Homo sapiens
  misc_feature: GYAE6OF01ENBCN.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgttttctgcctgctgatcgaggacgtgcactacagacgaactccgaccagttaggaatttggggctgggtcgttgggttttcctcgttgtcgttagtttaaaggcgccagtgtgagtgcgagcgtggtggacggtccggggagtcttgtcgacggtccgggtcgggggttcctggacgtaccttccgtccgttcgtcgtccgtaccgtccgttcggttcggtactttcccgttacctttaccggaaccgtttacccgttacgtgggtaacgtcgtccgttaccggtccgggtacccgtaccgtaacggttccggtaaggggtaacgggtcggttagggtcgggttacggggttccgtcggttaggtcggttaacggttacggttcggttacgggacggtacgtaaacgttaaggtacgtacggttaacgttagtacgggtacggttaggttcgtacgggtaacggggtaccggtaccgtacttccgtaacgtacgttccgacgacggtaaaccgaaccgaaccggaccgaaacgacctacggtaacttcggttaactacgtaacgtaagttacgaaacgttcgacggtaacggaaccgtcgggtaccgacggtacggtccggttagttacggttacgttacttaggtggttaagtggtacgg

SEQ ID NO: 12882 - DNA, 520 bp, Homo sapiens
  misc_feature: GYAE6OF02H3RMP.43.35.D02.1.454.CMB.1.raw
  modified_base (498)..(498): a, c, t, g, unknown or other
  misc_feature (498)..(498): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcagcctggggggtccctgagactctcctgtgcagcctctggattcaccctttcagtacctactggatgcactgggtccgccaagttcctgggaaaggctggtgtgggtctcgcgtgtgaatgttgacggcactaatatggactatgcggagtctgtgaagggccgattcaccatctcagagacaacgcaagaacacactgtacttgacaaatgaacagtctgagagccgaggacacggntgtgtatttctgtgtaagtagg

SEQ ID NO: 12883 - DNA, 216 bp, Homo sapiens
  misc_feature: GYAE6OF02GXSQH.43.35.D02.1.454.CMB.1.raw
  modified_base (215)..(216): a, c, t, g, unknown or other
  misc_feature (215)..(216): n is a, c, g, or t
tcagtgtgagtagtcacgaccggtgctcgatttagcacacgatagttgggtttgggggaactgctcagttaggacccagagggaaccatggaagccccagctcagcttctcttcctcctgctactctggctcccaggaactgtggctgcaccatctgtcttcatcttcccgccatctgaactactcacactgagcgggctggcaaggcgcatagnn

SEQ ID NO: 12884 - DNA, 520 bp, Homo sapiens
  misc_feature: GYAE6OF02HQZPI.43.35.D02.1.454.CMB.1.raw
  modified_base (516)..(516): a, c, t, g, unknown or other
  misc_feature (516)..(516): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactacacacagagaactcaccatggaatttgggctgggctgggttttcctcgttgctgttttaaaaggtgcccagtgtgaggtgcagctggtggagtccgggggaggcttagttcagcctggggggtccctgagactctcctgtgcagcctctggattcaccttcagtacctactggatgcactgggtccgccaagttcctgggaaagggctggtgtgggtctcgcgtgtgaatgttgacggcactaatatggactatgcggagtctgtgaagggccgattcaccatctccagagacaacgccaagaacacactgtacttgcaaatgaacagtctgagagccgaggacacggctgtgtatttctgtgtagngtag

SEQ ID NO: 12885 - DNA, 519 bp, Homo sapiens
  misc_feature: GYAE6OF02FQWM1.43.35.D02.1.454.CMB.1.raw
  modified_base (510)..(510): a, c, t, g, unknown or other
  misc_feature (510)..(510): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgtctgctgatcaggactgcacacagagaactcaccatggaatttgggctgggctgggttttcctcgttgctgttttaaaaggtgcccagtgtgaggtgcagctggtggagtccgggggaggcttagttcagcctggggggtccctgagactctcctgtgcagcctctggattcaccttcagtacctactggatgcactgggtccgccaagttcctgggaaagggctggtgtgggtctcgcgtgtgaatgttgacggcactaatatgggactatgcggagtctgtgaagggccgattcaccatctcagagacaacgccaagaacacactgtacttgcaaatgaacagtctgagagccgaggacacggctggtgtatttcngtgtaagag

SEQ ID NO: 12886 - DNA, 837 bp, Homo sapiens
  misc_feature: GYAE6OF02HCAAF.43.35.D02.1.454.CMB.1.raw
  modified_base (321)..(321): a, c, t, g, unknown or other
  misc_feature (321)..(321): n is a, c, g, or t
  modified_base (373)..(373): a, c, t, g, unknown or other
  misc_feature (373)..(373): n is a, c, g, or t
tcagtgtgagtagtcacgaccggtgctcgatttagcacacgatagttgggtttggggaagctctgcttcagctgtgagcgcagaaggcaggactcgggacaatcttcatcatgacctgctcccctctcctcctcacccttctcattcactgcacagggtcctgggcccagtctgtcttgacgcagccgccctcagtgtctgcggcccaggacagaaggtcaccatcctcctgcactggaacgtacgtccaaacattgggaatttttatgtatcctaggtaccaacaagtcccaggaacacgcccccaaactcctcgtttancacaatacgtcagcgaccgtcagggtacttccgtagtaccgtatttttccgnggtcctaccgtaaagtcctacggcctaccgttccaacggtcccctaaccccgttgggtacccaacgttaccccgtaaccccgggtaccttacccgaaacgggtaccggttacgggggggaacccgtaacggggacccgttaaagtttaacgtttaacccgtgggaacccgggtaaaacctacggttacggggggtaaaccttaaccccgggaacggggtttaccccggggggttaagggggtttttccggggggttacggggttttacccgggggaccggggggtaaacgggggttaaccccggtaaaggggtttttccgggaaacccccgggtttacccggttaaaggggttccccgtaaaccggggtaccccccggtaaagggggttcccccgtttacccgggaccccccccgggttttcggggttaccccgtaacccgtttcccggttttaaccccccggg

SEQ ID NO: 12887 - DNA, 530 bp, Homo sapiens
  misc_feature: GYAE6OF02IVRRP.43.35.D02.1.454.CMB.1.raw
  modified_base (371)..(371): a, c, t, g, unknown or other
  misc_feature (371)..(371): n is a, c, g, or t
  modified_base (510)..(510): a, c, t, g, unknown or other
  misc_feature (510)..(510): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggagcttagtcagccgtggggggtccctggagactctcctgtgcagcctctggattcaccttcagtacctactggatgcactgggtccgccaagttcctagggaaaggctggtgtgggtctcgngtgtgaagtgttgacggcactaatatgactatgcggagtctgtgaacgggccgtattcactatctcagtagacaacgcaagaacacactgtacttgacaaatgaacagtctagacgaggccgaggaccacggctaggtntatttcgtagtgtaagtaag

SEQ ID NO: 12888 - DNA, 539 bp, Homo sapiens
  misc_feature: GYAE6OF02GUXJH.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcagcctggggggtccctgagactctcctgtgcagcctctggattcaccttcagtacctactggatgcacgtgggtccgcctaagttccgtagggaaagggcgtggtgtggggtctcggcgtgtgaagtgttgacggcactaatagtggactagtggacggtagtcgtggtgaagggccgattcaccatctccagacgacaacgcaagaacacactgtacttgactaaatgaacatctagagacgccgaggacacggctagtgttattcgtgtagtaagag

SEQ ID NO: 12889 - DNA, 537 bp, Homo sapiens
  misc_feature: GYAE6OF02GHB2V.43.35.D02.1.454.CMB.1.raw
  modified_base (485)..(485): a, c, t, g, unknown or other
  misc_feature (485)..(485): n is a, c, g, or t
  modified_base (496)..(496): a, c, t, g, unknown or other
  misc_feature (496)..(496): n is a, c, g, or t
  modified_base (525)..(525): a, c, t, g, unknown or other
  misc_feature (525)..(525): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggagcttagttcagccgtggggggtccctgagactctcctgtgcagcctctggattcaccttcagtacctactggatgcacgtgggtccgccaagttcctgggaaaggcgtggtgtgggtctcgcgtgtgaatgttgacggcactaatatggactagtgcggagtcgtgtggaagggccgattccaccatcctcagacgacaacgccaaagaacacactgtacttagacaaatgaacngtacgtgaggngaccgaggaccaggctggtgttatttcgngttagaagtagg

SEQ ID NO: 12890 - DNA, 524 bp, Homo sapiens
  misc_feature: GYAE6OF02GIGDA.43.35.D02.1.454.CMB.1.raw
  modified_base (481)..(481): a, c, t, g, unknown or other
  misc_feature (481)..(481): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggagcttagttcagccgtggggggtccctgagactctcctgtgcagcctctggattcaccttcagtacctactggatgcactgggtccgccaagttcctgggaaagggctggtgtgggtctcgcgtgtgaatgttgacggcactaatatggactatgcggagtctgtgaagggccgattcacctatctccagagacacgccaagaacacactgtacttgcaaatgaacagtacngagacgccgaggacacggctggtgtatttcgtgttagtagtag

SEQ ID NO: 12891 - DNA, 540 bp, Homo sapiens
  misc_feature: GYAE6OF02GKTSO.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctggggttttcctcgttgctgttttaaaaggtgcccagtgtgaggtgcagctggtggagtccgggggagcttagttcagcctggggggtccctgagactctcctgtgcagcctctggattcaccttcagtacctactggatgcactgggtcccgcctaagttccgtagggaaagggctaggtgtgggtctcgcgtgtgaatgttgacggcactaatagtggactatgcggagtctggtgaagggccgtatcaccactctccagagacacgaccaagaacacactgtacttgacaaatagaacagtcagacgaggaccgaggaacgacggctggttgtatttcgagttagagtaacgg

SEQ ID NO: 12892 - DNA, 538 bp, Homo sapiens
  misc_feature: GYAE6OF02G0A39.43.35.D02.1.454.CMB.1.raw
  modified_base (448)..(448): a, c, t, g, unknown or other
  misc_feature (448)..(448): n is a, c, g, or t
  modified_base (456)..(456): a, c, t, g, unknown or other
  misc_feature (456)..(456): n is a, c, g, or t
  modified_base (485)..(485): a, c, t, g, unknown or other
  misc_feature (485)..(485): n is a, c, g, or t
  modified_base (527)..(527): a, c, t, g, unknown or other
  misc_feature (527)..(527): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcagccgtggggggtccctgagactctcctgtgcagcctcgtggattccaccttcagtacctactggatgcacgtgggtcccgcctaagttccgaggggaaaggcgtggtggtgggtctcgcgtgtgaatgttgacggcaactaatagtggaactagtggacgggagtcgtgtggaagggctacttcacntctcaganacaacgcaagacacatgtactgacaaatnaacagtctaggacgagccgaaggacacggctgtgtatttcgnggtagaagtag

SEQ ID NO: 12893 - DNA, 571 bp, Homo sapiens
  misc_feature: GYAE6OF02GY6GC.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggaggcttagttcagcctggggggtccctgagactctcctgtgcagcctctggattcaccttcagtacctactggatgcactgggtccgcctaagttccgtagggaaggcgtggtgtggtctcgcgtgtgatgttgacggcactatatggactatgcggagtctgtggaagggccgattcacctactcctcgagacgacaaccgccaaagaccacacttgtacttgacctaaatgaacagtcgtaggaacgacggacccggaagggaaccgaccgggtcttaggttacggtttaacttttccggtaggtttaggtaacggtagg

SEQ ID NO: 12894 - DNA, 566 bp, Homo sapiens
  misc_feature: GYAE6OF02H0MNI.43.35.D02.1.454.CMB.1.raw
  modified_base (414)..(414): a, c, t, g, unknown or other
  misc_feature (414)..(414): n is a, c, g, or t
  modified_base (423)..(423): a, c, t, g, unknown or other
  misc_feature (423)..(423): n is a, c, g, or t
  modified_base (503)..(503): a, c, t, g, unknown or other
  misc_feature (503)..(503): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggaggtccggggggaggcttagttcagccgtggggggtccctgagactctcctgtgcagcctctggtattccaccttcagtacctactggatgcacgtgggtcccgcctaagttccgtgggaaaggcgtggtggtgggtctcgcgtgtgaatgtgacggctactaatagtggactangcggagtcnggtgaagggccgtaattcgaactactctaccagacgaccaaccgacaagaaccacacttagtacttagacaaaatcgaanagttcgagagtaggaccgaggaccgacggcttggtacgtttagtttcgtaggtgtaagaacgg

SEQ ID NO: 12895 - DNA, 763 bp, Homo sapiens
  misc_feature: GYAE6OF02GU0EX.43.35.D02.1.454.CMB.1.raw
  modified_base (181)..(181): a, c, t, g, unknown or other
  misc_feature (181)..(181): n is a, c, g, or t
  modified_base (304)..(304): a, c, t, g, unknown or other
  misc_feature (304)..(304): n is a, c, g, or t
tcagtgtgagtagtcacgaccggtgctcgatttagcacacgatagttgggtttgggcacgaccggtgctcgatttagcacacgatagttgggtttgggggaggccccagccctgggattcccagctgtttctgcctgctgatcaggactgcacacagagaactcaccatggaatttgggcngggctgggttttcctcgttgctagttttaaaaggtgcccagtgtgacggtgcagcgtggtggaggtccgggggagtcttagtcacggccgtggggggtcctgagtactctcctgtgcagcctntggtattccgaccttcgacgttacctacggtggatcgcctacgttcggggtacccgaccgtaacggtttcccggtaaggggtaaacgggtccgtttggggtagttacgggggttcctcgggtccgttaggtagtaacggttggttcggaaccgggtaccctaagttaaagttacgttacgggtaaccttagtcggtaccgggtaagtttccgtagggtacgggaccgggtaccgtaactccgaacccgtactccgttaccgaagtaacggaaccaaaccgtacccgaaagaaaccctaacgtaccgttagttaccttaacgaaccgtaaaggtacgaaaccgtacggttaccgtaggtaagggtccgaaacccggggtagggaacccgtaaccgggttacgttaaccggtttagttttacccggttttaccgtttagggttaaacggttacggtaaggg

SEQ ID NO: 12896 - DNA, 533 bp, Homo sapiens
  misc_feature: GYAE6OF02FKN1R.43.35.D02.1.454.CMB.1.raw
  modified_base (403)..(403): a, c, t, g, unknown or other
  misc_feature (403)..(403): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggagcttagttcagcctggggggtccctgagactctcctgtgcagcctctggattcaccttcagtacctactggatgcacgtgggtccgccaagttcctaggggaaagggctggtgtgggtctcgcgtgtgatgttgacggcactatatggactangcggagtcgtgtgagggcgtattcaccatcctcagagacaacgccaaagaacacactgtacttgacaaatgaacagtctggagagccggaggacgacggtctaggtgttactttcgtgtaggtaagtagg

SEQ ID NO: 12897 - DNA, 754 bp, Homo sapiens
  misc_feature: GYAE6OF02GI883.43.35.D02.1.454.CMB.1.raw
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcaggactgcacacagagaactcaccatggaatttgggctgggctgggttttcctcgttgctgtttaaaaggtgcccagtgtgaggtgcagctggtggaggtccgggggaggcttagttcagccgtggggggtccctgagactctcctgtgcacgcctctggacttcacccttcagttacctacgtggatcgcctacgtcgggtccccgaccgtaacgttcccggtaggggaaacgggtccgttagggtggttcggggttccgtcgggtcggttgtaggtaagttggttacgggacggtacgtaacgttaaacgttagtacgggtaatacggtcgggtacggtaaggttccgtagggttacggaaggggtacccggtacttacccgaacccgtatcccgtaacccgaaggtaacccgaaacccgtaaccggaaccccgtaaaacgaaacccgtaaccgtaccgttaccgttaccgtttaacggaacctaaacgttaacgaaaccgtacgttacggtacgtaacgggtaaccggacccggaaccggtaaccggaaccggtcgtttacggttacgttttaacgtttacgttacgggtttacggtaaagggttaacgg

SEQ ID NO: 12898 - DNA, 740 bp, Homo sapiens
  misc_feature: GYAE6OF02H95RG.43.35.D02.1.454.CMB.1.raw
  modified_base (432)..(432): a, c, t, g, unknown or other
  misc_feature (432)..(432): n is a, c, g, or t
tcagtgtgagtagtcacgaccggtgctcgatttagcacacgatagttgggtttggggaagctctgcttcagctgtgagcgcagaaggcaggactcgggacaatcttcatcatgacctgcctccctctcctcctcacccttctcattcactcgcacgagggtcctgggcccagtctgtctgacgcagcccgcctcagtgtctcggccggcccaggacagaacggtcaccatcctctcgcacgtggaacgtacgccaacagttagggtaatttttatgttactcctaggtaccaaacacgtccaacggaacaccgaccccctaaacctccgtacttttacacaactagtacgactaccgacgacccgtagagggtaacttcctacggtacttcgtttacgtcgtacctaccgaacgttcgtcgacgaccgttcncggtaccctcccgttaggtcctacgtacccgaccggaccttaccgaagtacgggttacggggccgaacgggaccctacgtttaacgttacgtacgggaccggaacgtaagtacgggtaactacccgtacgggtaccgggtacggggttggggtttaaccgggtcgggtaaccggggaccgggtaaccgtaccgggttacggtacccggttacccgggtagggttacccgaacggttaccccggaaccgggttcgtaccccggttcccccggttacgggtaccctacccggtttccttaacccccgggg

SEQ ID NO: 12899 - DNA, 723 bp, Homo sapiens
  misc_feature: GYAE6OF02F412T.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgcttgttttaaaaggtgcccagtgtgaggtgcagctggtggaggtccgggggagcgttagttcagccgtggggggtccctggacgactctcctgtgcagcctctggacttcaccttcgacgtacctacgtggtatcgcgacgtcgggtcccgacctaacggttccgtaggggaaagggtcgtggtggttcggggtcgtcggtcggtgtagtaagttgttggaccggtctaactaatagtcggtactagtcggacggtagttcgtggtacggaacgggtccgtaacgttaccgaaccgtactccgtaaccctaacggaacggaaccgtaaacccggaaccgaaaaccgtaaaccaccgtaaccgttagttaaccgtttacgtaacctaaaacgttaccgaaactacggttaccgtaaggaccggtaacgggaccccgggtaacgggtaaccggtaccgggttacgtttacggtttacggttttaacggttttacggtttacgggtttacggtaaacgggtaacgg

SEQ ID NO: 12900 - DNA, 773 bp, Homo sapiens
  misc_feature: GYAE6OF02JAL0M.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggtttcctcgttgctgtttaaaaggtgcccagtgtgaggtgcagctggtggacggtccggggggaggtcgttagttcaggccgtggggggtccctgagactctcctgtgcagtcctcgtggtacttaccacctttaccgacgttaccctaaccgttgggtacttacggaccgtaaccggttcggggttacccgttaccgttaacggtttacccggttaagggggtaaaacgggtccgttaggggttcgggttcgggggtttccttcgggtaccggtttggttacggtaaagttcgggtttgggaaccggtcctaaagttaacgttaacgttacggggaaccttaggtcgggtaccgggtaaggtttccgtagggtacgggaaacgggggtacctaacggttaccaaccgtacttccgtaccgaggaacgtaaccgaaaccgtaccgaaaacggaaacccacgtacgttacgtacttacgaactaaagtacgaacgtacgtacgtaggaacgtacggaaccggacgggtaaccgtaaccggtcgttagttacggtttaacgtttcgtaaggttacggtaagtaacggg

SEQ ID NO: 12901 - DNA, 670 bp, Homo sapiens
  misc_feature: GYAE6OF02GNTC0.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgtttaaaaggtgcccagtgtgaggtgcagctggtggaggtccgggggagcttagttcagccgtggggggtccctgacgactctcctgtcgcagcctcgtggtatccaccttcgacgtacctacgtggtatgctacgtcgggtccgccgtaacgttccgtagggaaagggtcgtggtggtgggtctcggcgttggtgtaagtgttagacggactaactaagtagtggtactagtcggacggtacgtcgtaggtaggtaacggggtccctaagttccaaccgtacttaccgtacccgtaggaacgaacccgtaaaccggaaccgtaaaacggaaacccaaccgtaccgttacggtttaacccgttagtaaaccctaaaggtaaccgaaacgttacgttacgtaggacggtaagaccggaacgggaacctacggcgttagttcgttaagtttcgtagttaggtaaggtacg

SEQ ID NO: 12902 - DNA, 679 bp, Homo sapiens
  misc_feature: GYAE6OF02GIO2Q.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgcttgttttaaaaggtgcccagtgtgaggtgcagctggtggaggtccgggggagtcttagttcagccgtggggggtccctgagactctcctgtgcacgcctcgtggacttcaccttcgacgttacctacgtggatgcacgtcgggtcccgacctaacgttccggtaggggaaacggtcgtgggtggttcggggtcctcggcgttggtagtaagttggttacggacggtactaacgttaatagtcggacttagtcggacggtagttcgtggtaggaacgggccgtaattccgaactactccgttaccgaagaacgtaacccgaaccgaaccgtaaaacggaaacctaaccgtaaccttacggttaacctttacgaacctaaagtacgaaaccgtagttacgtagtaacggacggaccggaacggtaacccgacgggtacgttaggttacgtttacgtttcggtaggttacgtaggtaacgg

SEQ ID NO: 12903 - DNA, 841 bp, Homo sapiens
  misc_feature: GYAE6OF02JUMRN.43.35.D02.1.454.CMB.1.raw
tcagtgtgagtagtcacgaccggtgctcgatttagcacacgatagttgggtttgggcacgaccggtgctcgatttagcacacgatagttgggtttggggagcccagccctggattccagctgttctgcctgctgatcaggactgcacacagagaactcaccatcggaatttggctgggcttacgggttttcctcggttcgtcgttacggtttttaaaacggtcgtacccgtaagttcggtacggtagggttcgacgtacggtccgttggggtcgggtaacgggtcccggggggtaggttacctttaacggttccgacggtccgggttcgggggggtaccccttggaacgtaccgtccgttccgttggtcgacgtacgtcccgtacgtcggtactttaccgtaccgttacacgttaaccctacgtacgggtacttcggaccgtacggttccggggtacccgtaaccgttaacggtttacccggtaagggggtaaaaccgggttccgttaggggtttcgggttaaccgggggttaccgttccgggtaccgggttttaggtaaccggttaaaggtttcgggttacggtaaccgggtaccttaaacgtttaaagtacggtacggtaacttagggtacggtacgggtacgttcggtacgggttaagggaaccgggtaccgtattaccgaaacctcgttaccgaacgtagaacgaacgaaccgtaaccgactaaccgactacgtacgtacttaacgactaaaggtacaacgtagtcgtaagcgtaacggacccgtaagtaccggtacgtacgttgttacgttacgtttacgtgggtaactacgtagg

SEQ ID NO: 12904 - DNA, 775 bp, Homo sapiens
  misc_feature: GYAE6OF02H8R6T.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaattttgggctgggctgggttttcctcgttgctgttttaaaaggtgcccagtgtgaggtgcagctggtggaggtccgggggaggtcttagttcgagtccgtcggggggtcctggagactctccgtgtagcgagcctctggtacttcctaccctttcacgttacctacgtggtatcgctacgtcgggtcccgaccgtaagttccgtaggggaaacgggtcgtagggtggttcgggttctcggtcggtgtacggtaagtttcggttcgaaccggtctaacgttaaagtttacgttacggaacttaggtcgggtaccgggtacgttcggtagggttacgggtaacgggggtacccgttaagttaccgaccccttaagttcccgttaccgaaacggtaacgtaaccaaacccggaaccgtaaaacggaacctaaccgtaaccgttacggttaaccgtttaacgaaccgtaaaacgttacgtaaaaccgtccgttacgttaaccggtaacggtaacggtaacccgggtaacgggaaccccggtaccggtacggtttcggttaacggttttacgttttaccggttagggtttaaccgtaaaggttaacggg

SEQ ID NO: 12905 - DNA, 669 bp, Homo sapiens
  misc_feature: GYAE6OF02IJ0OK.43.35.D02.1.454.CMB.1.raw
  modified_base (214)..(214): a, c, t, g, unknown or other
  misc_feature (214)..(214): n is a, c, g, or t
  modified_base (299)..(299): a, c, t, g, unknown or other
  misc_feature (299)..(299): n is a, c, g, or t
  modified_base (639)..(639): a, c, t, g, unknown or other
  misc_feature (639)..(639): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggngccagtgtgaggtgcagcgtggtggaggtccgggggagcttagtcagccgtggggggtccctgagactctccgtgtgcacgcctntggacttcaccttcacgttacctacgtggatcgctacgtcgggtcccgaccgtaaacggttccggtagggggtaaaacgggtcgttgggttcggtggggttaccttccggcggtttggtaggtaagttggttacggaccggtactaaaccgttaaagtacgttagggtaacttagtcgggacgggtagtcgtagggtacggaacgggtcctagttaccacctagttacccacgtaaggaacgaaccgaacgaaccgaaacgaaacaccgtaacgtcgttaacttagaaccaaagtaccgaaactagtacgtaagaggacggtccgaagggaccgacggtntagttcgttagttcgtagtagtaagtacgg

SEQ ID NO: 12906 - DNA, 571 bp, Homo sapiens
  misc_feature: GYAE6OF02GN93Z.43.35.D02.1.454.CMB.1.raw
  modified_base (515)..(515): a, c, t, g, unknown or other
  misc_feature (515)..(515): n is a, c, g, or t
  modified_base (524)..(524): a, c, t, g, unknown or other
  misc_feature (524)..(524): n is a, c, g, or t
  modified_base (528)..(528): a, c, t, g, unknown or other
  misc_feature (528)..(528): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagctggtggagtccgggggagcttagtcagccgtggggggtccctgagactctcctgtgcagcctctggattcaccttcagtacctactggatgcacgtcgggtcccgcctaacggttccgtaggggaaagggcgtagggtggtcggggtctcggcggttgtgaagttggttgacggcactaagtagtggtactagtggcgggtagtcgtggtggaagggtccgtagttcaccgtatcctaccgagacgacaacgaccaagaccacactgtacttagacaagtanaacagtacngagngaccgaggacgacggtctagttgtatttcgtagttagtagtag

SEQ ID NO: 12907 - DNA, 874 bp, Homo sapiens
  misc_feature: GYAE6OF02JOJ60.43.35.D02.1.454.CMB.1.raw
  modified_base (242)..(242): a, c, t, g, unknown or other
  misc_feature (242)..(242): n is a, c, g, or t
  modified_base (375)..(375): a, c, t, g, unknown or other
  misc_feature (375)..(375): n is a, c, g, or t
tcagtgtgagtagtcacgaccggtgctcgatttagcacacgatagttgggtttggggaagctctgcttcagctgtgagcgcagaaggcaggactcgggacaatcttcatcatgacctgcctccctctcctcctccacccttctctattcactgccacgtagggtccctgggcccaggttctcgtctgacgcacgcccgcctcgagtgtctcgccggacccaggacaaggaacggtccaaccnctcctccgtacggcacgtacggaacgtaccacgaactagttagggtattttatacgttacttaccgtaggtaacctaaacgaccgtacccaaggaacctacccgtaccccgtaaacttccgttacgtttaacncctaacgtaactacgtacacgtaccgtacgtacgacgggttacttccgtacggtaccttacgtttacgtacggtcctaacgtacgtccgtacgcgtaccgtcgacccgtacccgtaccgttacgtacctacggttaccccgaccgggttaaccctacccggaacgggtaccggttaacgggggaaccgttaccggggtacttacggtttaacgtacccgggtaaggtaaacccggttaacgggtaacgttaccggggtaaacccgttaaccgggtcggggtttaaaccggggggtttcggggtttacgggggttacccgggttaaccgggggtaacccgggggtaccggggttaaaccgggttcggttaaccgggtaaccccggtttacggggtaacgggtaaccggacccggggttaaccccggtagggtaacccccgtttaccccggggcccccggtttaaccggtcccggttacttacccccgggttaccccccgg

SEQ ID NO: 12908 - DNA, 727 bp, Homo sapiens
  misc_feature: GYAE6OF02HRTO6.43.35.D02.1.454.CMB.1.raw
tcagtgtgagtagtcacgaccggtgctcgatttagcacacgatagttgggtttggggaagctctgcttcagctgtgagcgcagaaggcaggactcgggacaatcttcatcatgacctgctccctctcctcctcacccttctcattcactgcacagggtcctgggcccagtctgtcttgacgcagcccgccctgagtgtctgccggcccaggacagagtcacatctcctgcacgtaggaacgtacgtaccaactagttagggtaatttttagtgttactccgtaggtaaccaacgaacgtcccgaaggaaaccaccgtaaccccctaaacgtcccttacgtttaactacaacaaagttacgtacaacggtccgaccgtacgagggtactttccgtaggtaaccgttattttcgtacggtcctaccgtaacgtccgtaggacctacgtacgaccgtccctaccgtggtaccacgtaccgaacccggtactaccgaggaccggtggggaaccgacggtaccgtattacgttacgtggaccgaacgtagtcgggtaacttaccggagggttaccgggtaggggtttcgggtacgggttcgggacgggtacgggtaaccgttaagggttccggtaacccggttcggttaacgggtccgtaacggtaccccggtaagggtccccgtacccgggtcccccgttcgggttcccacccggtttcccgttaccccgg

SEQ ID NO: 12909 - DNA, 751 bp, Homo sapiens
  misc_feature: GYAE6OF02IQM1L.43.35.D02.1.454.CMB.1.raw
  modified_base (79)..(79): a, c, t, g, unknown or other
  misc_feature (79)..(79): n is a, c, g, or t
tcagtgtgagtagtcacgaccggtgctcgatttagcacacgatagttgggtttggggaagctctgcttcagctgtgagngcagaaggcaggactcgggacaatcttcatcatgacctgctccctctcctcctcacccttctcattcactgcacagggtcctgggcccagtctgtcttgacgcacgcccgccctcagtgtcgtcggcccggcccaggacaaggaacggtccacctatcctcctgcacgtagggaacgtaccgtaccaagtagtttagggttaatttttagtgttacttccgtagtaaccaacgaacgtcccgaaggaaccacccgtaccccctaaaccttcccgttacgtttaacacaactaaattacgtcgacgccgacccgtacgacgggttacttccgtacggtaacccgttagttttcgtacggtccttaccgtaacgtcgtacggtactaccggtcaccgtaccctacccgttcggtaccacgtcccgaccggtaccctaccggacgtaccggtacggggaaccgtacggtaccgttaatttacgtacgtccgacggtaactagggtcggtaacccgtacgtacggggttacgggttacggggttcgggttggtaccggggacgggttaaccgggacgttacggttaccgggtaccggtaccggttacggaccgtaccggacgaacgggtccgttcccggcccccggttaggtacccgaccgtttccgttaccccgg

SEQ ID NO: 12910 - DNA, 695 bp, Homo sapiens
  misc_feature: GYAE6OF02GUABI.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgtcttagtttaaaaggtcgccagtgtgaggtgcagctgggtggaggtccggggggaggtcttagttcgacggtccggtcgggggggtccctggacgtactcctccgtgtcgcacgtcctcgtggtacttcctaccttcgtaccgtacctacgtcggtactcgcgtacgtcgggtacccgaccgttacggttaccggtaaggggaacgggtcgttggggtcgggtacgggttcgtcggtggttacggtagtaagttcggtacggacggtacctaagttaagttaggtacgtacttagtcgggtacggtagttcggtaggtagggtacgggtccgttactcccgtaaccgtacttcccgtacgaacgacgtaaccacggaccaaagaccaacgtactagtacctagaactaaagtacgaacgtatacggacgacggtacggaccggaaggtacccgtaggtccgttagttacggttctttaggtaggttacgtagtag

SEQ ID NO: 12911 - DNA, 676 bp, Homo sapiens
  misc_feature: GYAE6OF02JZAWU.43.35.D02.1.454.CMB.1.raw
  modified_base (503)..(503): a, c, t, g, unknown or other
  misc_feature (503)..(503): n is a, c, g, or t
  modified_base (510)..(510): a, c, t, g, unknown or other
  misc_feature (510)..(510): n is a, c, g, or t
tcagtgtgagtagtcacgaccggtgctcgatttagcacacgatagttgggtttgggcacgaccggtgctcgatttagcacacgatagttgggtttgggggagccccgagccctgggattcccagctgtttctgcctgctgatcaggctgcacacagagactcaccatggaacttggctgggcgttgggttttcctcggttgtcgttagttttaaaaggtcgaccctaggttggtggtaaggtggccaggtcgttgggtggtacgggtccgggggaagtctttaggttcacggtcggtcgggggtcctgacgacgtctcgtgtgcacgtcctcgtgtacttcgacttacacggttactcgtggtaactcgccgtacgtccgggccgtactaccggtcggtagggaacgggtcgtgggtgtcgggtcgtgtacggtgtacggtagtgttcggcggtactagtaatgtagacgttgtcgcgtagtacgtggacgtacgggactacnctaccgntaccgtcctaaggacacgaacccgtaaagtaaaccgacacgtaccgttaagtacctagaaccgtaagtaacgacgtagacggttccaaaggcccgggaacttacggggaaccgaccggtttcgtaggtttacggtaactttcgggttaagttaggtaacgtaacgg

SEQ ID NO: 12912 - DNA, 696 bp, Homo sapiens
  misc_feature: GYAE6OF02IJP2O.43.35.D02.1.454.CMB.1.raw
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcaggactgcacacagagaactcaccagtggaatttgggcgtgggccgttgggttttccctcgttgcttaggttttaaaaggtcgcctagtgtgaggtgcagcgtggtggaggtccggggagtcttagtcacggtcggtcgggggtcctggacgtacgtctccgtgtcgcacgtcctgtggtaccttacctaccgttcgaacgttacctacgtgactcgacctaccgttcggacccgcgtaaaccggttccggtagggaaacggtcgtaggtggtcggtacgttcggcgtggtacgtaagtcggtacgaccgtataacttaagtacgtaggtaaccttaggacggtacgggtaacgttcggtaggtagggtaacgggaccgttaaacgttccgaaaccttcgtccgttaacgaacgtaacgaaacccgtaaccgaaccgaaaacgtaaccacctagtaacttacgtagaaaccaaagtaacaacgtagtacgacgtaacgcggacggtacggaactcgggtactaggttactcgtttataacggtagtaagtaacgg

SEQ ID NO: 12913 - DNA, 637 bp, Homo sapiens
  misc_feature: GYAE6OF02IAFX0.43.35.D02.1.454.CMB.1.raw
  modified_base (567)..(567): a, c, t, g, unknown or other
  misc_feature (567)..(567): n is a, c, g, or t
  modified_base (604)..(604): a, c, t, g, unknown or other
  misc_feature (604)..(604): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgcttgttttaaaaggtgcccaggtgtggaggtgcagcgtggtgggaggtccggggggaggtctttagttcgacggccggttcgggggggtccctggagaccgttctccgtgtgctacgcctcgtggtacttcaccttcacgttacctacgtggatgcgtacgtcgggtccgtacctaacggttccgtaggggaaacgggtcgttggtggttcgggtcgtcggtcgttgtacgtaagttggttacgacggactaacgtaatagtaggactagtcggacggtagttcgtaggtaggaacgggtccgtattaccactactctacgagtacgaaccaacgacgaaacgaacacacgtgtacttagactaaanacgacagtagtagacgacggccgtacggaccacggtnttagttacgtacgttttcgaggttagtaagtag

SEQ ID NO: 12914 - DNA, 824 bp, Homo sapiens
  misc_feature: GYAE6OF02JM5ZQ.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctggttttctcgttgcttggttttaaaaggtgcccagttgtggaggtgacagtcgtgggtcggaggtccgggggagtcttaggttcgaggccggtggggggtccctgacgtactcctccgtggtcgccgagtccgttccgtggtactttacccgtaccttaccgtacggttaacccctacgtacggtagtaccggtaccgtacggtccggggttacccggaccgttaaacggtttccgggtacgggggtaaaaacggggtccgttgggttggtcgggggttccgttccggggtccgttagggtacggtaaagtttcggttagggaccggacgtaacgtaaacggtactttaggggaaccttaacggtcgggaccgggtaacgttacggttcggtaacgggtaacggggtacccgtagtttacccgaacctagttccctacccggaagaaccggtaaccgaacctaaccggaaacgtaacgaacccgtaagtttacgtaacccgttcgaaaccgttaaacgttaaaccgaccgttaacgtacggttaagggaacctaacggggtacccggaaaggaacccggtacggttaaccgtgggtttaaccggtttgttttaacccggtaggttagtaaggttaacgg

SEQ ID NO: 12915 - DNA, 669 bp, Homo sapiens
  misc_feature: GYAE6OF02IYNUR.43.35.D02.1.454.CMB.1.raw
  modified_base (230)..(230): a, c, t, g, unknown or other
  misc_feature (230)..(230): n is a, c, g, or t
  modified_base (299)..(299): a, c, t, g, unknown or other
  misc_feature (299)..(299): n is a, c, g, or t
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcaggactgcacacagagaactcaccatggaatttgggctggcttgggttttcctcgttgctgtttttaaaaggtcgcccagtgtgaggtncagctggtggacggtccggggagtcttagttcgagtccgttggggggtccctggagacgttcgtcgtgngccgagcctcgtggtattcctaccttacgtacgtacccgtacgtggatcgcgtacgttcgggtcccgacctaacgttccggtaggaacgggtcgtggtggttcgggtctcggcggttagtcggtaagtcggttacggaccggtactaccgttaagtacgtcgggtaactagtacggtaccggtgtacgtcggtagggtaacgggtcctagttaccgtacgtacgtccgtccgaagtacgaaccgaaccgtacaaacgtaaccacgtactacgtacttcgactaaacgtagaacgtacgtagtcgaggtaccggaccgagggtaaccgacggtagtaggttccgttaatttcggtacgtaggtaataacgg

SEQ ID NO: 12916 - DNA, 760 bp, Homo sapiens
  misc_feature: GYAE6OF02JA725.43.35.D02.1.454.CMB.1.raw
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcaggactgcacacagagaactcaccatggaatttgggctgggcttgggttttcctcgttgtcttagttttaaaaggtgcccagtgtgaggtgcagtcgtggtggacggtccgggggaggtcttagttcgaggtccggtggggggtccctgtagtacctcgtcgtgtgcacgtcctcgtcggtacttccaccttacgtacgttacctacgttggatcggacgtacgtcgggtacctaaccgtacggtttaccggtaggggtaaacgggtcggttagggttcggttcggggttccgtccggtacgggttaggttacggtaagtttcgggttacgaccgggtacctaacgtttaaagtaggttacggtaactttggtacgggacgggttacggttcgttacggtagggtaaccgggtccctaggtttacccgaccttacgttacccacgtaacggtaacgtaacccgtaacccgacgtaaaacgacccttacgtaaccgttagttaccgttacgaaacgtaaatacgaaaccgttaggtaccgtaggaacggccggtaccggaaggtacccgtacggtacgttggtttacgttacgtttcgtagggtaaccggttagtaacgg

SEQ ID NO: 12917 - DNA, 991 bp, Homo sapiens
  misc_feature: GYAE6OF02IG52W.43.35.D02.1.454.CMB.1.raw
tcagtgtgagtagtcacgaccggtgctcgatttagcacacgatagttgggtttggggaagctctgcttcagctgtgagcgcagaaggcaggactcgggacaatcttcatcatgacctgctccctctcctcctcacccttctcacttcactgcacgagggtcctgggcccagtctgtcttgacgtcacgcccgcctcgacgttgtcctacgggcccggacccccgtaaggaccgtaacggaaaacggttcccaaacccctacgtttccccgttcccgtcgaccgttaacggtacgggtaaaccggttacccgtacccaaaaccgttaggtttagggggttaaactttttttaagtcggtttaaccttccgttaccgggttaaaacccctaaaaccgtaaacccggttaccccggaacggtaaaaccccgtacccggtaaaccccccccgttaaaacccgttccccgttttacgggttttaaccctacccaaaacgttaaaactaaccggttaccgacgggtaccgtaacccggtacggtacggggttacctttacccgacgtaacccggtttacgtttttcgtcggtcccttaccgtaacggttcgtacggacgtacccggttacgaccgtaccccgttacccggttcggttacccaccggttacccgaaccccgtaccggtacccgtacgggtaaccggtcgggggaaccggtacggaccggttactttaacgtacggtacggtaccggaaactggtacgggtaaccgtaccgggtaaccgggttccggggttaagggggtttacccgggggtttagggtacccgggggtaaccggggtaacgggtacccgggtttaacggttcccggggtaaaccccggttccggtttaaccgggcccggtaaaacccggaccccgggtaacccggttcccggttaccccgggacccccggtttacccggtccccttacccggttccctttacccccggg

SEQ ID NO: 12918 - DNA, 929 bp, Homo sapiens
  misc_feature: GYAE6OF02H54IT.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggtcttgggttttcctcgttgcttagttttaaaaggtcgtcccagtgtaggaggtgagagtcgtggtgggaggtccgggggagtcgttagttcgacggtccggttacggggggtccctggacgtactccgttcgtgtcgcgtacggtcccttcggttacggtacttttacccgacccgttttacccgtaacggttaaccccgtttaaccggtgggtaacgtttcggacccgtaaccgggtttccggggttaccccgtaccccggttaaaacgggtttcccccggttagggggggtaaaaccgggtcggtttacggggttcgggttaccggggggtttccgttccggggtaccgggtttcgggtaacggtaaaggtttcgggttacggtacccgggtacgttaaccgttaaagtttacggttaacgggttaaccttagggttacggtaccggggttaaggttcggttacggggttaaggggaaaccggggttcccgttaacgttaccccgtaacggttaaccttacccgttacggaaaccggtaaccggtaaaccgaaaaccccggtacgtaaaaacccgggtaaaacctacccgttaaccgttaaccggttaccgttttaaccggaaacgttaaacgtaaccggtaaacgccggtttaacgacggttaccggaacggttacccggaacgggaaccgtaccggtagttacgttacggtttccttacggttaacgtagggtaataacggg

SEQ ID NO: 12919 - DNA, 724 bp, Homo sapiens
  misc_feature: GYAE6OF02G0KIB.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggcgttgggttttcctcgttgtcttagttttaaaaggtcgccagtgtgaggtgcagcgtggtgggacgggtccggggggagtcttagttcaggccggtcggggggtcctgacgactcctctgtgcacgtcctcgtggtacttctacccttcacgttacctacgtgatcgacgtacgtcgggtcccgaccgtaacgttccggtaagggaacggtcgtaggtggtcggtgtccggtgtagtagtagttgtcgacgtactaacgttagtagtacggtacttagtcggtacggtagtacgtacggttacgggaccgggtacgtactacccgacctacttccgtaccgaacgtaacgaaccaaccggaaccctaaacggaaccctacgtaaccgttagttaccctaagtaaaccgtaaacgtaaccgaacgttaaccgtcgtaaggtaaccggaccgggtaacccggaaagggtaacccggaacgggtttcccgtttaagggtttagttttaaccgttttacgttaaggtttaacgggaagttaaggg

SEQ ID NO: 12920 - DNA, 750 bp, Homo sapiens
  misc_feature: GYAE6OF02JJCPA.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaattgggctgggctggtttcctcgttgctgttttaaaaggcgtccagtcgtgagggtgcagcgtggtggacgggtccgggggagtcttagttcgacgtccgtggggggtccctggacgtactctccgtgtcgtcgcgtacccgtcgtacggtacttaccctacccgttacctacggtttacccgtaacgttgggtaactcgggccgttacggtcccgggtacccgaccgttaaccggttccggtaggggtaaacggggtcgtagggttggtcggggttctcggtcgttggtacggtaaagttcggtacggtaccggacctaaagttaacttacggttagggaaaccttaggtacggtagggtaccttcggtagggttaggaaccggggtcgttaacttaccgacgtacgtacccgttcgaacggtaacaaccgaccgtaaccaaaggtaacctacccgtaacgtttacgtaacttacggaaattaaaccgtaacggtaaactcggtagaggtaaccgacggtaaccggtcgggaaacctgggtacttacggttacttaccgtttataggtacgaggtacg

SEQ ID NO: 12921 - DNA, 735 bp, Homo sapiens
  misc_feature: GYAE6OF02I1N9E.43.35.D02.1.454.CMB.1.raw
  modified_base (359)..(359): a, c, t, g, unknown or other
  misc_feature (359)..(359): n is a, c, g, or t
  modified_base (530)..(530): a, c, t, g, unknown or other
  misc_feature (530)..(530): n is a, c, g, or t
tcagtgtgagtagtcacgaccggtgctcgatttagcacacgatagttgggtttgggcacgaccggtgctcgatttagcacacgatagttgggtttggggagccccagccctgggattcccagctgtttctgtcctgctgatcaggactgcacacagagaactcaccatggaattgggctgggcttcgggttttcctcggttgtcgttagttttaaaaggtcgtacccaggtcgtggaggtcgcagtcgtggtcgggacgggtccggggagtcgttagttcgacggccggttcggggggtcctaggacgtcctcttctgtcgcagtcctcgtggacttcctaccttctacgtaccgtagnggtactgtctacgtcggtccacgtagttccgtagggacggtgtacggtgtcgggtctacggtcgtaggtacgtagttcggtacggacgtactaacgttaagtgtacggtacttaggtacggaggttacgtcggtcgggttaggaaccgggtacctgttaaccaaccggttntacccggttacgaacggacccgaacgtaaccgaccgtaaacgaaccgtacgtaacgtttaccgtaacgtttacgaaacgtaaacgttaccggtaaacgtcgtttacggaacggtaccgggaaggtacccgggtaaagggtcccgtaaccgggttagtttccgtacggttttacgttaccgggtaaggttaacgtaagttaacggg

SEQ ID NO: 12922 - DNA, 760 bp, Homo sapiens
  misc_feature: GYAE6OF02JKVKF.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggcttgggttttcctcgttgacgttgttttaaaaggtcgccagtgtgaggtgcagtcgtgggtggaggtccgggggaggtcgttacggttcgaggtccggtcgggggggtccccttggacgacctcctccgtggtcgcgacgtcctcgtgggactttccacccttcgacgttacctacgtacggtactcgaccgtacgtcgggtaccccgaccgtaaacggttcccggtaagggggtaaacggtcgttagggttcgggtcggggttacctccggtcggttggttacgtaagttggttacggacggtctaaaccgtaagtacgttaggtaaccgtagtcggtacgggtaacgtccggttagggtagggaaccggggtaccgtaactttacccgaacctacggtttacccaccggtaaggtaacccggacctaaaccgggaaccctaaacgtaaaccgaccgtaacgtttaacgtacgtttaacgaaacctaaagttaacgacgtaacgtcgttaagaacggtacgaccggaaggtaccgaacgtcgttaggttcgttagttcgtagttacgtaagtacgg

SEQ ID NO: 12923 - DNA, 730 bp, Homo sapiens
  misc_feature: GYAE6OF02F44HM.43.35.D02.1.454.CMB.1.raw
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggcgtgggtcgttgggtttttcctcgttgtcgttaggttttaaaacggtcgcccgagtggtgtaggtcgcagtcgtgggtgggacgggtaccgggggacggtcgttaggttccgacggtccgggttcgggggggtcccctaggacgtaccttccttccgtggtcgcgtaccgtccgtcgtaggtacttcctacccgttacgtacgtaccgttacgtggtagtcgaccgtaccggtcgggtacccgaccgtaacggttccggtaggggtaacgggtcgtagggtggtcgggtcgtcggtcgtgtaggtagttaggtcggacggtactaacgtagtacgttgtactagtcggtacggtgttcgtagggtaggaaccggtccgtactaccgaccgttagtccctacgacgtaacgaaccgaaccgaaccgaaagaaccacttaaccgtcgtaacgttacgaataaacgtagaacgttgttacgaggacggaacggaccggaaggacccggtacggtcgttaggttacgttttactacggttagtacggtaagtacgg

SEQ ID NO: 12924 - DNA, 937 bp, Homo sapiens
  misc_feature: GYAE6OF02HFVJW.43.35.D02.1.454.CMB.1.raw
tcagtgtgagtagtcacgaccggtgctcgatttagcacacgatagttgggtttgggcacgaccggtgctcgatttagcacacgatagttgggtttggggagcccagccctgggacttcccagctgttctgcctgctgatcaggactgcacacgagacgaactcaccagtaggtaacgtttgggcgtgggtcgtttcgggttttcctcggttcgtacgtttaggttttaaaacggtcgaccgtaggttggtaggtacggtgacgtacgtcggtagggtcgggtacggggtccgggggtaggttacgttacggttacgtacgggtccgggttcggggggtaccctaggtaccgtaccttccgttccggtggtcggtaccgtacggtacccgttggttacgttacgtttaccctaccgtttaccgtaacgttaccgttacggttcggtacgtcggtaccgttccggtacgggttacccgtaaccgttaaccgggttaccgggtaacgggggtaaaccgggttcggttacgggttcggggttacgggtccgtcggtacggttaggtacggttacgtacggttacgggaccgtacgtaacttaagtcgtaacggtacgttacggtcgggttaacggtcgttacgtacggggtaacgggtaccgggttacttaacccggttaccaaaccggttcccgttacccgtaaacccgtaaaggtacccggtaaaccgtaaaccccggtaaccgtaaaccgggaaccttaacccgttaccggtacgtttaacggaaccgttaaacgtaaacgtaaccgtaacgttaccggttacggaacgggaacggtaacccgggaccgggtaaaccggcccgggtttaaccggttacgttaccgggtttagttttaacccgtttacggggttaacgttaacgggttaaggttaccgg

SEQ ID NO: 12925 - DNA, 691 bp, Homo sapiens
  misc_feature: GYAE6OF02IC37P.43.35.D02.1.454.CMB.1.raw
  modified_base (368)..(368): a, c, t, g, unknown or other
  misc_feature (368)..(368): n is a, c, g, or t
  modified_base (676)..(676): a, c, t, g, unknown or other
  misc_feature (676)..(676): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaattttgggctgggcttgggtttttcctcgttgcgttagtttttaaaaggtcgcccgtagtggtgaggtgcagcgtgggtggacgggtccgggggagcgtttaggttcacggtccggtcggggggttccctgacggacctctccgtgtcgcacggtcctcgtggacttcgacctttcgacttacctacgtggatcgcncgtcggtcccgaccgtaacgttcgtaggggtaaaggcgttagggtcggtgggttccgtcggcgttcggttaggtaacttggttacgacggtctaaaccgttaagtttactcgggattagtcggacgggtattcggttaggttacgggaacgggccttaacgtacccgtactacgtcccttacgaagtcgaccaaacgaccgtaaacaacgacctaacgttcgtaaaccgttgaaactaaacgacaacggtacttacggagtaggaacgaccggtaacggaaccgcgttacggtgttacgttatttcgnggttacgtaggtaag

SEQ ID NO: 12926 - DNA, 183 bp, Homo sapiens
  misc_feature: GYAE6OF02ID7Z7.43.35.D02.1.454.CMB.1.raw
  modified_base (151)..(151): a, c, t, g, unknown or other
  misc_feature (151)..(151): n is a, c, g, or t
  modified_base (161)..(183): a, c, t, g, unknown or other
  misc_feature (161)..(183): n is a, c, g, or t
tcagtgtgagtagtcacgaccggtgctcgatttagcacacgatagttgggtttggggaagctctgcttcagctgtgagcgcagaaggcaggactcgggacaatcttcatcatgacctgctcccctctcctcctcacccttctcattcactncgcacgggtnnnnnnnnnnnnnnnnnnnnnnn

SEQ ID NO: 12927 - DNA, 617 bp, Homo sapiens
  misc_feature: GYAE6OF02GAT5O.43.35.D02.1.454.CMB.1.raw
  modified_base (400)..(400): a, c, t, g, unknown or other
  misc_feature (400)..(400): n is a, c, g, or t
  modified_base (453)..(453): a, c, t, g, unknown or other
  misc_feature (453)..(453): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatcaggactgcacacagagaactcaccatggaatttgggctgggctgggttttcctcgttgctgttttaaaaggtgcccagtgtgaggtgcagcgtggtggaggtccgggggagtcttagttcagccgtggggggtccctgagactcgtcctgtgcacgcctcgtggtacttcctaccttcacgttacctacgtggatgcacgtcgggtccgaccgtacgttccgtaggggaacggtcggttggtggttggggtctccggnggtggtagtagttggtagacggtctacgtaatagtgtacttagtcgacgggtntacgtggtacggaacgggtcctatacacctatccgtacagacgaccacgaccaaagacaccgtactagttaccttgaacctaagtacaacgtgtacgtagacgtaacggccgaaggcccgaggttcgttagtcgtttaactttcggtagtacggttaagtacgg

SEQ ID NO: 12928 - DNA, 944 bp, Homo sapiens
  misc_feature: GYAE6OF02GJ37P.43.35.D02.1.454.CMB.1.raw
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcgaggactgcacacagagactcaccatacggtaagttgggcgtcgggtcgttcgggttttccttcggttcgtcgttaagttttaaaaggtcgtacccgtaggttcgtgggtaggtcgacgtacgtcggtagggtcggggaccggggttccgggggaacggttacgtttacggtccgtaacgggtcccgggttccggggggtacccgttaggtaccgtaaccgttccgttccgtaggtacggaccgtaacggtcccttacggtaccgggtacctttaccgaacccgtttaccggtacgttaacccgttacgtacggtacgtaccggtaccgtaccggtccgggttacccgtaacccgttaacggttaaccgggtaacggggtacggtcggttacgggtcgggttcgggttctcgggtacgtttacggtacggtacggttcggttaacggtacgtaacgttaacgtaacgttaagggtctaacgttaggtacgggtcggtacggttacgttcggggaaggtaaccgggccttagttacccgaacgttacctacggttaccgaaaccgggaaacgtaaaccgtaaaccggaaaccggtaaaactaaaccggtaccgtttaaacgtaacggtttaaccgtaacggtaaaaccgtttaaaggtaaacccgtaacgttaacggtaccgtaaacgggtaaccgggaaaaccggtaaacccgggtaacccgggtaaaccggtacccgggttacggttaagttttaaccgggttccgttttaagggtaacggtaaacggttttagggaaccgg

SEQ ID NO: 12929 - DNA, 735 bp, Homo sapiens
  misc_feature: GYAE6OF02HAS0O.43.35.D02.1.454.CMB.1.raw
  modified_base (179)..(179): a, c, t, g, unknown or other
  misc_feature (179)..(179): n is a, c, g, or t
tcagtgtgagtagtcacgaccggtgctcgatttagcacacgatagttggtttgggcacgaccggtgctcgatttagcacacgatagttgggtttggggagccccagccctggattcccagctgtttctgcctgctgatcaggactgcacacagagaactcaccagtgagttggcgtggngtggttttcctcgttgtcgttaggttttaaaaggtcgacccgtagtgtggaggtgcgagtcgtgggtggacgggtccggggagtcgttagtcgacgtccggtcggggtcccgtaggacgaccgttcgtcgtgtacgacgacgtccgtcgttagtacttcctacccgttacgtaacgttacccgtacggtaggtagtcgccgtacgtccgggtcccgaccgttaacggttccggtaacgggtaacgggtcgttaggtcggtacggttcgtcgtcgtaggtacgtaggttcgtacgggtacgtaccgtaacgttagtaacgtaggtaacgttacgtagggaccggttagtacggttgtaacgggaccggtacgttaccgtcccgtaaccgtaccgtacccgacgaaacgaccgaaccgaacccgaacgaaaccgaaccgactaacgttacgtacgttaacgaactaaagtaacgaacgtaccgtagtaacggacggtacggacggtaaggtaccgtacggtgtcggtttagttacgttagtaggttacgtagtaacgg

SEQ ID NO: 12930 - DNA, 738 bp, Homo sapiens
  misc_feature: GYAE6OF02HIEE8.43.35.D02.1.454.CMB.1.raw
  modified_base (142)..(142): a, c, t, g, unknown or other
  misc_feature (142)..(142): n is a, c, g, or t
  modified_base (542)..(542): a, c, t, g, unknown or other
  misc_feature (542)..(542): n is a, c, g, or t
  modified_base (663)..(663): a, c, t, g, unknown or other
  misc_feature (663)..(663): n is a, c, g, or t
tcagtgtgagtagtcacgaccggtgctcgatttagcacacgatagttgggtttgggcacgaccggtgctcgatttagcacacgatagttgggtttgggggagccccagccctgggattcccagctgtttctgcctgctgatnaggctgcacacagagaactcaccatggtagtttgggctgggcgttgggttttcccttcggttcgtacgtttaggtttttaaaaggtcgtcccgtagttggtggtaggtgcgaggtcgtgggttagggacggggtccgggggaggttacgttacgtacgtacggtccgggttccggggggttcccgtagggacgtaccgttccgtcctggtcgaccgtacgtcccttcgtacggtacgttacctacccttacgtaccgttacctacgtgacgtcgacgtaccgtcggtccgaccgtacgttaccggtaggggaaacggtgtacggtggtcggtcgtcggtacggttcggtagttagtacggtaggacgtacgtacgttagtagtacggtacgtagtacggngtacgtaggtacggtaggtaaccggaccgtactaccgactaccttaccgtaccagaacgaccgaaaccggacgaaacgtacaccgtaacgtcgttaacgttagaacctaagaacgtaacgngtactaggacggcggaacggacggtacgtacggacgttcgttaggttagttaccgtaggttacggtaagttacgg

SEQ ID NO: 12931 - DNA, 753 bp, Homo sapiens
  misc_feature: GYAE6OF02HJPAW.43.35.D02.1.454.CMB.1.raw
  modified_base (366)..(366): a, c, t, g, unknown or other
  misc_feature (366)..(366): n is a, c, g, or t
  modified_base (625)..(625): a, c, t, g, unknown or other
  misc_feature (625)..(625): n is a, c, g, or t
  modified_base (645)..(645): a, c, t, g, unknown or other
  misc_feature (645)..(645): n is a, c, g, or t
tcagtgtgagtagtcacgaccggtgctcgatttagcacacgatagttgggtttgggcacgaccggtgctcgatttagcacacgatagttgggtttgggggagccccagcccgtgggattcccgagctgtttctcgcctgctgactcgaggactcgaccacacaagacgtaacctcctaccagtaggtaacgtttcgggcgttgggtcgttcgggttttccttggttcgtacgtttaaggttttaaacggtcgtccctaggttcggtaggtacggtgaccgtagtcgtcgggtcggtacgggtaccgggggagtcgttacggttacgcggtccgggtacgggggtcctaggtacgtaccgtcctcgngtacgccacgtcgtcgtagccttcgtaacctcgtacgtccgtagtcgtagtcgtaccgtacgggtaccggtccgtaccggtaacggttacgggtacggggaacgggtcggttagggttccgggtagtccgttccgggtactaggtacggttaaggtcgtaccggacgtaacgtaacgtagttaccgaggtactggtaggtacggatcggtaggacggacgtagtactcgaagttcctacgacagacgacacacgtaacnccgtacgacgtgtacgaacncgtaaactagtaacccgtatccgggtaactacggcggttaaccggaacggtccgtacccgggatttcggttaagttcccgtttaggacgtaaccgggttgtaaacggg

SEQ ID NO: 12932 - DNA, 716 bp, Homo sapiens
  misc_feature: GYAE6OF02FQ8LP.43.35.D02.1.454.CMB.1.raw
  modified_base (102)..(102): a, c, t, g, unknown or other
  misc_feature (102)..(102): n is a, c, g, or t
  modified_base (309)..(309): a, c, t, g, unknown or other
  misc_feature (309)..(309): n is a, c, g, or t
tcagtgtgagtagtcacgaccggtgctcgatttagcacacgatagttgggtttgggcacgaccggtgctcgatttagcacacgatagttgggtttggggganccccagccctgggattcccagctgtttctgcctgctgatcaggactgcacacagagactcaccatggatttggctggcgttggttttcctgtgtcgttagtttaaacggtcgccgtagtgtgtaggtcgacgagtcgtggtcggacggtccggggagtcttagttcgagtccgtggggactccgtgagtaccttactccgttggtcncgtacggtccgttcgtacggtacttcccgtacccgttacgtaccgtaaccgttcgtaggtcctacggcctaacccgggttcggtacccgtaccgttaacggttccggtaaggggtaacggtcggttagggtgtcgggtacgtcgtacgtgtactagttcgttcggacgtcttaactagtagtcggtaactggcgtaacgtgtacgtgtacggacggtcgtacgtcaccacgtcgtaccagtacgaacctacgaacgtaacgtacaacgttacgtagttaacgtacgaattaacgtacgtaacttacggtcggtaagtcggtaacccgtacggaaaccgggtaaccgtacggttaccggtttaggtttaaccggtttcccggttacggttaacggttaggtaaacggg

SEQ ID NO: 12933 - DNA, 691 bp, Homo sapiens
  misc_feature: GYAE6OF02J1BPC.43.35.D02.1.454.CMB.1.raw
  modified_base (207)..(207): a, c, t, g, unknown or other
  misc_feature (207)..(207): n is a, c, g, or t
  modified_base (223)..(223): a, c, t, g, unknown or other
  misc_feature (223)..(223): n is a, c, g, or t
  modified_base (357)..(357): a, c, t, g, unknown or other
  misc_feature (357)..(357): n is a, c, g, or t
  modified_base (362)..(362): a, c, t, g, unknown or other
  misc_feature (362)..(362): n is a, c, g, or t
tcagtgtgagtagtcacgaccggtgctcgatttagcacacgatagttgggtttgggcacgaccggtgctcgatttagcacacgatagttgggtttggggagcccagccctgggattcccagctgttctgcctgctgatcaggactgcacacagagaactcaccatggaatttggctggctgggtttctcgttgcgtagtttaaacgngcctagtgtgaggtcncagtcgtggtaggacgggtccggggagtcgttacgttcgacggtcgttcggggggtaccctgagtactccgtcgtcggtcgcgtagtcctgtacggtacttcctacgttcgacgtttaaccgtactaggttacngtacncggtcggttaccgacgtaccggtgtacgggaagtcgtaggtcgtggtcgtcggtacgtgtacgacgttgtacggtacgactacgtatagtcgtaagttgcgtaggagttcgtagggtagtacggtcgtaacgttcctaccgttatcccggtacgaacgtacgtaaacaccgtaaccgaaacgtacgtaacctacgttacggtacgttaacgaacgtaaacggtcgtaacggttactacggtaaccggagtaaccgtaaccggggtacaacccgttaaggttcgttaccgttagtaccggttttacggaaggttaccggaagtttacccg

SEQ ID NO: 12934 - DNA, 629 bp, Homo sapiens
  misc_feature: GYAE6OF02GPAAZ.43.35.D02.1.454.CMB.1.raw
  modified_base (362)..(362): a, c, t, g, unknown or other
  misc_feature (362)..(362): n is a, c, g, or t
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcgaggactgcacacagagaactcaccatggtaattgggctgggcttgggttttcctgttgtcttaggtttaaaagcgcctagtgtgaggtgcagcgtggtggacgggtccgggggagtcgttagtcgacggtccggtggggggtccctggacgtacttctccgtgtcgcgtacgccttagtggtacttcctacccttgtacgttacctacgtggactcgacncggtcggtccctacgtaacggttcggaagggaacggtcgtggtggtcggtctcgcgtgtgtagtgtcgacgtactacgtagtagtgactagtcggacgtgtcgtggtagtacggtactatccacgtactcgtacgagacgtacgaacgaccgaaacgactacgtacttacgttaactcgaactaaaggtccaacgttctacgacggaccgacggaccggaagccgtacggtcttacggtatttccgttgtacggtacggtaatacgg

SEQ ID NO: 12935 - DNA, 881 bp, Homo sapiens
  misc_feature: GYAE6OF02JZEQU.43.35.D02.1.454.CMB.1.raw
tcagtgtgagtagtcacgaccggtgctcgatttagcacacgatagttgggtttggggcacgaccggtgctcgatttagcacacgatagttgggtttgggggagccccgagccctgggattcccagcgtgtttctgcctgctgatcaggactgcacacagagactcacatggtattggctggctggtttcctcgttgacttgtttaaagcgtaccgagtgtacggtaggtacgacgacgtcgttacgggtgggtacgggtaccgggggagtacgtttacgttaccgaggtcccggtttcggggggtaccttaggtacgtaccgttcgttccgtaggtccgtacgaacgtccgttaccggtaggtacttacccgtacccgttacgtaaccgttaccgtaacgttggaccgttacggtaccgtaaccgggttccgggttaacccgtaaccgggttaacgtttacccgggggttaaggggtaaaccggggttccggttaagggttaccgggttacgggtttccggtaccggtaggtttaacgggttacggttaacggttacggttacgggtaaccgtaccggttaaacgtaagtttacggtaacggtaaccggtttactacggggtacgttacggtttacggtacggtaaaccgggtacggtaccccgttaattccccgtaacggttactaaccggtactaaccggaactaaccgaaaccggtactaaaccggaactaacgtaccgtaacgtttacgaaccggtaactaaataacggtaaccgttccggacttaaggaaccgggaacccgtaacggaaacggtaccggtacccgttaagtacggttaaccggttagttaccgggtttagaacggttacgtaacgg

SEQ ID NO: 12936 - DNA, 707 bp, Homo sapiens
  misc_feature: GYAE6OF02IOH50.43.35.D02.1.454.CMB.1.raw
  modified_base (614)..(614): a, c, t, g, unknown or other
  misc_feature (614)..(614): n is a, c, g, or t
tcagtgtgagtagtcacgaccggtgctcgatttagcacacgatagttggggtttgggcacgaccggtgctcgatttagcgacacgatagttggggtttgggggagccccagccctggggattcccagctgttctgcctgctgatcaggactgcgacacagagaactcaccatggaatttgggctgggcttgggttttcctcgttgctagttttaaaaggtcgaccctagtgtgaggtcgcagtcgtggtggacggtccgggggagtacgttacgttcgacggtccggtggggggtcccctggacgtacctcctccgtgtcgacctaagcccttccgtaggtacttccactttacacgttacctacgtggatacgcaccgtcgggtaccgtaccgtaacgttcccggtagggaaaccgggtcgtaggtggtacgggttctacggtcgtaggtcgtaagttcgtcggaccggactaactaaacgtgtcggaacttcgtaggcgggtagtcgtagggtcggaacgggtaccgttactaccctaaccgttactccgtaccgtaacgaacgaaccgtaaccgtacgaaccggtaaacctaccgacttaggtaccgttanaacgtaaatcgaaagttcgacgttaggacgtacggaccggacggtacgaccggtactcggttacgttacctttcgtaggttagtaagtaacgg

SEQ ID NO: 12937 - DNA, 780 bp, Homo sapiens
  misc_feature: GYAE6OF02HNCBL.43.35.D02.1.454.CMB.1.raw
  modified_base (257)..(257): a, c, t, g, unknown or other
  misc_feature (257)..(257): n is a, c, g, or t
  modified_base (667)..(667): a, c, t, g, unknown or other
  misc_feature (667)..(667): n is a, c, g, or t
tcagtgtgagtagtcacgaccggtgctcgatttagcacacgatagttgggtttgggcacgaccggtgctcgatttagcacacgatagttggggtttgggggagccccagccctgggattcccagcttgtttctgcctgctgatcaggactgcacacagagaactcaccatggtaagtttgggctgggtcgtttcgggtttttcctcggttgtacgtttaggtttttaaaacggtcgaccctagttggtggtagggtnctaggtcgttgggtacgggacggggtccggggggaggttcgtttaggttcgacgggtccgggttcggggggtcccttggacgtaccgttcctccgtgtcggcctacggtcctcgtggtacttacctaccgttaccgtacgttacccgtacgtaggactcggaccgtacggttccgggtacccgtacggttaaccggttaccggtaagggggtaaccggtcgttacgggtggttcgggtcgtcggtcggttgtagtaaggttgtacgaccgactaacgtaagtcgtacggtacttgtacggtcgtagttcggtaggtacgggaacggtcctaactccgaacgtacttaccgaacgacgaacgtaaccaaaccgtaccgaaacgtaaccacgttacgttacgtaaccgttanaaaccgtaaagtacgtaaacgtacgtacgaacggaccggaaccgaccggacggtaacccgacgggttattacggttaacgtttcgtttacggtaaggttacgtaaggtaacgg

SEQ ID NO: 12938 - DNA, 758 bp, Homo sapiens
  misc_feature: GYAE6OF02GI07L.43.35.D02.1.454.CMB.1.raw
  modified_base (332)..(332): a, c, t, g, unknown or other
  misc_feature (332)..(332): n is a, c, g, or t
  modified_base (414)..(414): a, c, t, g, unknown or other
  misc_feature (414)..(414): n is a, c, g, or t
  modified_base (421)..(421): a, c, t, g, unknown or other
  misc_feature (421)..(421): n is a, c, g, or t
  modified_base (476)..(476): a, c, t, g, unknown or other
  misc_feature (476)..(476): n is a, c, g, or t
  modified_base (757)..(757): a, c, t, g, unknown or other
  misc_feature (757)..(757): n is a, c, g, or t
tcagtgtgagtagtcacgaccggtgctcgatttagcacacgatagttgggtttgggcacgaccggtgctcgatttagcacacgatagttgggtttggggagccccagccctgggattcccagctgtttctgcctgctgatcaggactcgcacacacgagaactcgaccagtcggaatttcggccgtgggcttcggggttttcctcgttgtcttgttttaaaacggtcgcccgtagttcggtcggtaggtcggtacgcggtcgtcgggttagggtacgggttccgggggaggttacgttacggtttcgacggtccggtcgggggggttacccnggtaaccgcgttccgttccgtggtcgacgtacgccgttcgtacggtcttctccgtttccgacgttaccgttacgtggtaccnggtaccncggttacggtccgtaccgtacgttaccggtgggaacgtcgtaggtcggtggtcgnggtcgtagtcgtaagttcggtgacggtctaactacgtgtacgatcgtagcggtagttcgtggtaagggtccggtaactacgtaccaccggttaacttccggacgttacaacggacctaacggaccaaacgtaccaccgtttagtcggttaacgtctaaccggtaattaacccggaataccggggtttacaacgggtacccggtagggtaacccggtaagggaacccgtttccggacggttattaccgggttttactaccgggtaggtttacggaaacgggng

SEQ ID NO: 12939 - DNA, 251 bp, Homo sapiens
  misc_feature: GYAE6OF01AK71Y.15.27.C05.1.454.CMB.1.raw
  modified_base (249)..(251): a, c, t, g, unknown or other
  misc_feature (249)..(251): n is a, c, g, or t
tcagtctacgtagccacgaccggtgctcgatttagacgcgatcgaaggttgggcaaagctgccctgaccctttcggtgcgcagcctgaggatgaggctgagtattactgcttgctctcctatagtggtgttcgggtgttcggcggagggaccaagctgaccgtcctaggtcagcccaaggctgcccctcggtcactctgttcccaccctcctcgctacgtagactgagcgggctggcaaggcgcatagnnn

SEQ ID NO: 12940 - DNA, 255 bp, Homo sapiens
  misc_feature: GYAE6OF01C03ET.15.27.C05.1.454.CMB.1.raw
  modified_base (253)..(255): a, c, t, g, unknown or other
  misc_feature (253)..(255): n is a, c, g, or t
tcagtctacgtagccacgaccggtgctcgatttagacgcgatcgaagggttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccctcctcgctacgtagactgagcgggctggcaaggcgcatagnnn

SEQ ID NO: 12941 - DNA, 261 bp, Homo sapiens
  misc_feature: GYAE6OF01EOBNZ.15.27.C05.1.454.CMB.1.raw
  modified_base (253)..(261): a, c, t, g, unknown or other
  misc_feature (253)..(261): n is a, c, g, or t
tcagtctacgtagccacgaccggtgctcgatttagacgcgatcgaagtttgggggcaaaggctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccgccctcctcgctacgtagactgagcgggctggcaaggcgcatagnnnnnnnnn

SEQ ID NO: 12942 - DNA, 254 bp, Homo sapiens
  misc_feature: GYAE6OF01BJNMS.15.27.C05.1.454.CMB.1.raw
  modified_base (251)..(254): a, c, t, g, unknown or other
  misc_feature (251)..(254): n is a, c, g, or t
tcagtctacgtagccacgaccggtgctcgatttagacgcgatcgaagtttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccaccctcctcgctacgtagactgagcgggctggcaaggcgcatagnnnn

SEQ ID NO: 12943 - DNA, 253 bp, Homo sapiens
  misc_feature: GYAE6OF01DDHLY.15.27.C05.1.454.CMB.1.raw
  modified_base (251)..(253): a, c, t, g, unknown or other
  misc_feature (251)..(253): n is a, c, g, or t
tcagtctacgtagccacgaccggtgctcgatttagacgcgatcgaagggtttgggggcaaagctgccctgaccctttcgggtgcgcagcctgaggatgaggctgagtattactgcttgctctcctatagtggtgttcgggtgttcggcggaggaccaagctgaccgtcctaggtcagcccaaggctgcccctggtcactctgttcccaccctctcgctacgtagactgagcgggctggcaaggcgcatagnnn

SEQ ID NO: 12944 - DNA, 255 bp, Homo sapiens
  misc_feature: GYAE6OF01BWSTU.15.27.C05.1.454.CMB.1.raw
  modified_base (253)..(255): a, c, t, g, unknown or other
  misc_feature (253)..(255): n is a, c, g, or t
tcagtctacgtagccacgaccggtgctcgatttagacgcgatcgaagggttgggggcaaagctgccctgaccctttcgggtgcgcagcctgaggatgaggctgagtattactgcttgctctcctatagtggtgttagggtgttcggcggagggaccaagctgaccgtcctaggtcagcccaaggctgccccctggtcactctgttcccgccctcctcgctacgtagactgagcgggctggcaaggcgcatagnnn

SEQ ID NO: 12945 - DNA, 254 bp, Homo sapiens
  misc_feature: GYAE6OF01ATT3B.15.27.C05.1.454.CMB.1.raw
  modified_base (251)..(254): a, c, t, g, unknown or other
  misc_feature (251)..(254): n is a, c, g, or t
tcagtctacgtagccacgaccggtgctcgatttagacgcgatcgaagtttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttccagccctcctcgctacgtagactgagcggctggcaaggcgcatagnnnn

SEQ ID NO: 12946 - DNA, 256 bp, Homo sapiens
  misc_feature: GYAE6OF01EOZ49.15.27.C05.1.454.CMB.1.raw
  modified_base (254)..(256): a, c, t, g, unknown or other
  misc_feature (254)..(256): n is a, c, g, or t
tcagtctacgtagccacgaccggtgctcgatttagacgcgatcgaagggtttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcccgctacgtagactgagcgggctggcaaggcgcatagnnn

SEQ ID NO: 12947 - DNA, 254 bp, Homo sapiens
  misc_feature: GYAE6OF01EH3UX.15.27.C05.1.454.CMB.1.raw
  modified_base (250)..(254): a, c, t, g, unknown or other
  misc_feature (250)..(254): n is a, c, g, or t
tcagtctacgtagccacgaccggtgctcgatttagacgcgatcgaagttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccaccctctcgctacgtagactgagcgggctggcaaggcgcatagnnnnn

SEQ ID NO: 12948 - DNA, 261 bp, Homo sapiens
  misc_feature: GYAE6OF02H2M8Z.15.27.C05.1.454.CMB.1.raw
  modified_base (255)..(261): a, c, t, g, unknown or other
  misc_feature (255)..(261): n is a, c, g, or t
tcagtctacgtagccacgaccggtgctcgatttagacgcgatcgaagtttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgcccctcggtcactctgtccaccctcctccgctacgtagactcgagcgggcgtggcgaaggacggcatagnnnnnnn

SEQ ID NO: 12949 - DNA, 252 bp, Homo sapiens
  misc_feature: GYAE6OF02F7D59.15.27.C05.1.454.CMB.1.raw
  modified_base (251)..(252): a, c, t, g, unknown or other
  misc_feature (251)..(252): n is a, c, g, or t
tcagtctacgtagccacgaccggtgctcgatttagacgcgatcgaagttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtagactgagcgggctggcaaggcgcatagnn

SEQ ID NO: 12950 - DNA, 259 bp, Homo sapiens
  misc_feature: GYAE6OF02IZLMY.15.27.C05.1.454.CMB.1.raw
  modified_base (255)..(259): a, c, t, g, unknown or other
  misc_feature (255)..(259): n is a, c, g, or t
tcagtctacgtagccacgaccggtgctcgatttagacgcgatcgaagggtttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcgctacgtagactgagcgggctggcaaggcgcatagnnnnn

SEQ ID NO: 12951 - DNA, 256 bp, Homo sapiens
  misc_feature: GYAE6OF02HEXQ6.15.27.C05.1.454.CMB.1.raw
  modified_base (253)..(256): a, c, t, g, unknown or other
  misc_feature (253)..(256): n is a, c, g, or t
tcagtctacgtagccacgaccggtgctcgatttagacgcgatcgaagggtttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttcccaccctcctcgctacgtagactgagcgggctggcaaggcgcatagnnnn

SEQ ID NO: 12952 - DNA, 272 bp, Homo sapiens
  misc_feature: GYAE6OF02IW3E8.15.27.C05.1.454.CMB.1.raw
  modified_base (255)..(272): a, c, t, g, unknown or other
  misc_feature (255)..(272): n is a, c, g, or t
tcagtctacgtagccacgaccggtgctcgatttagacgcgatcgaagtttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctggtcactctgttccccaccctcctcgctacgtagactgagcgggctggacaaggcgacatagnnnnnnnnnnnnnnnnnn

SEQ ID NO: 12953 - DNA, 258 bp, Homo sapiens
  misc_feature: GYAE6OF02GKXGG.15.27.C05.1.454.CMB.1.raw
  modified_base (254)..(258): a, c, t, g, unknown or other
  misc_feature (254)..(258): n is a, c, g, or t
tcagtctacgtagccacgaccggtgctcgatttagacgcgatcgaagggttgggggcaaagctgccctgaccctttcgggtgcgcagcctgaggatgaggctgagtattactgcttgctctcctatagtggtgttcgggtgttcggcggagggaccaagctgaccgccctaggtcagcccaaggctcgccccctcggtcactctgttcccgccctcctcgctacgtagactgagcggctggcaaggcgcatagnnnnn

SEQ ID NO: 12954 - DNA, 267 bp, Homo sapiens
  misc_feature: GYAE6OF02HOF8C.15.27.C05.1.454.CMB.1.raw
  modified_base (249)..(249): a, c, t, g, unknown or other
  misc_feature (249)..(249): n is a, c, g, or t
  modified_base (255)..(267): a, c, t, g, unknown or other
  misc_feature (255)..(267): n is a, c, g, or t
tcagtctacgtagccacgaccggtgctcgatttagacgcgatcgaagggttgggggcaaagctgccctgaccctttcgggtgcgcagcctgaggatgaggctgagtattactgcttgctctcctatagtggtgttcgggtgttcggcggaggaccaagctgaccgtcctaggtcagcccaaggctcgccccctcggtcactctcgttcccaccctcctcgctacgtagactgagcgggctggcaaggcncatagnnnnnnnnnnnnn

SEQ ID NO: 12955 - DNA, 264 bp, Homo sapiens
  misc_feature: GYAE6OF02GRR6E.15.27.C05.1.454.CMB.1.raw
  modified_base (253)..(264): a, c, t, g, unknown or other
  misc_feature (253)..(264): n is a, c, g, or t
tcagtctacgtagccacgaccggtgctcgatttagacgcgatcgaagtttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctgttcccgccttcctcgctacgtagactgagcggctggcaaggcgcatagnnnnnnnnnnnn

SEQ ID NO: 12956 - DNA, 286 bp, Homo sapiens
  misc_feature: GYAE6OF02F933N.15.27.C05.1.454.CMB.1.raw
  modified_base (256)..(286): a, c, t, g, unknown or other
  misc_feature (256)..(286): n is a, c, g, or t
tcagtctacgtagccacgaccggtgctcgatttagacgcgatcgaagggtttggggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctgtcactctcgttcccgccctcctcgctacgtagactgagcgggctggacaggcgcatagnnnnnnnnnnnnnnnnnnnnnnnnnnnnnnn

SEQ ID NO: 12957 - DNA, 262 bp, Homo sapiens
  misc_feature: GYAE6OF02IL0VH.15.27.C05.1.454.CMB.1.raw
  modified_base (255)..(262): a, c, t, g, unknown or other
  misc_feature (255)..(262): n is a, c, g, or t
tcagtctacgtagccacgaccggtgctcgatttagacgcgatcgaagggtttgggggcaaagctgccctgaccctttcgggtgcgcagcctgaggatgaggctgagtattactgcttgctctcctatagtggtgttcggtgttcggcggaggaccaagctgaccgtcctaggtcagcccaaggctcgccccctcggtcactctcgttcccgccctcctcgctacgtagactgagcgggctggcaaggcgcatagnnnnnnnn

SEQ ID NO: 12958 - DNA, 398 bp, Homo sapiens
  misc_feature: GYAE6OF01ALGUN.34.66.F11.1.454.CMB.1.raw
  modified_base (383)..(383): a, c, t, g, unknown or other
  misc_feature (383)..(383): n is a, c, g, or t
  modified_base (389)..(398): a, c, t, g, unknown or other
  misc_feature (389)..(398): n is a, c, g, or t
tcagtacacgtgatcacgaccggtgctcgatttagtcacgcgagaagggctctggagataaattggaagataaatatgcttcctggtttcagcagaagccgggccagtcccctgtgcaggtcatctatcaagatactaagaggccctcagggatccctgagcgattctctggctccaactctgggaacacagccactctgaccatcagcgagacccaggctatggatgacgctgactattactgtcaggcgtgggacaatagcattgtggtattcggcggagggaccaagctgaccgtctaggtcagcccaaggctcgccccctggtccactctcgttcccaccctcctcatccacgtgtactgagcgggctgggcaagggcncatagnnnnnnnnnn

SEQ ID NO: 12959 - DNA, 385 bp, Homo sapiens
  misc_feature: GYAE6OF02F0S94.34.66.F11.1.454.CMB.1.raw
  modified_base (278)..(278): a, c, t, g, unknown or other
  misc_feature (278)..(278): n is a, c, g, or t
  modified_base (380)..(385): a, c, t, g, unknown or other
  misc_feature (380)..(385): n is a, c, g, or t
tcagtacacgtgatcacgaccggtgctcgatttagtcacgcgagaagggctctggagataaattggaagataaatatgcttcctggtttcagcagaagccgggccagtcccctgtgcaggtcatctatcaagatactaagcggccctcagggatccctgagcgattctctggctccaactctgggaacacagccactctgaccatcagcgagacccaggctatggatgacgctgactattactgtcaggcgtgggacaatagcattgtggtattcggnggagggaccaagctgaccgtctaggtcagcccaaggctgccccctggtcactctgttcccacctcctcatcacgtgtactgagcggctggcaggcgcatagnnnnnn

SEQ ID NO: 12960 - DNA, 647 bp, Homo sapiens
  misc_feature: GYAE6OF01DBEXN.43.64.F09.1.454.CMB.1.raw
  modified_base (170)..(170): a, c, t, g, unknown or other
  misc_feature (170)..(170): n is a, c, g, or t
  modified_base (406)..(406): a, c, t, g, unknown or other
  misc_feature (406)..(406): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcncaggactgctgaagccttcggagaccctgtccctcacctgcgcagtctcgtggtggtctttcaatggttacacgtggagctggatccgccagtccccgagggaagggactggaatggattggcggaagtcactacgaaatcggaacgtcccaactaaccgaacccgtcctcgtcggtcgagtcacgatacgcttagactcgtaccaagacgccgcttctctctagaaactcacctntgtcgaccgccgcgacacggtctttctatttctgtcgcgcgacgtaccgtagggaacgggtatttcggacgttcgggacccggtacaacgtacccgaaaacgtcgggtttcgggtttacccggacccccggttcggggggaaccccccgggtaaacccggttcgggtacccgtacccggttcccgttcccgtaccaaccggtccttaccccgaaacccggtaaccgggtcccctaaccggg

SEQ ID NO: 12961 - DNA, 650 bp, Homo sapiens
  misc_feature: GYAE6OF01BVOPA.43.64.F09.1.454.CMB.1.raw
  modified_base (417)..(417): a, c, t, g, unknown or other
  misc_feature (417)..(417): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctctggtgggtctttcaatggttactactggagctggatccgccacgtccccagggaaggactggaatggattgcggaagtcactcgaaatggaacgtcccaactacaaccccgtccctcgtcggtcgagtcacgatagccttagactcgtacaagagccgcttctctctcgaaactcacctctgtcgacccgccgcggacncggtctttctatttctgtcgcgcgacgacccgtgggaagggtatttacggacgtcgggcccgcgtaactacccgtaaacgtcggtttaccgggttacccggtacccccggtacgggggggaccccccggggtaaaccccgttgggggtacccctaccccgggttcccgtccccgttacccgtacggtcccctttaccccggaaccccgtaaaccgggggtccccctaaccggg

SEQ ID NO: 12962 - DNA, 600 bp, Homo sapiens
  misc_feature: GYAE6OF01BWZVL.43.64.F09.1.454.CMB.1.raw
  modified_base (457)..(457): a, c, t, g, unknown or other
  misc_feature (457)..(457): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagacccctgtccctcacctgcgcagtctctggtggtctttcaatggttactactggagctggatccgccagtccccagggaaggactggaatggattgcggaagtcactcgaaatggaagtcccaactacaacccgtccctcgtcggtcgagtcacggatagccttagactcgtccaagacgccgcttctctctgaaactcacctctgtgaccgcgcggacacggtctttctatttctgtgccgcgacgacccgtgggaacggggtntttaggaccgtgggcccgtcacgtacccaaacgtaggtttcggttccgacccccggtacgggggtacccccggggaacccgttgggtaccctacccggtcctccctcgtacgccttaccccgaccgtaacgggcccctaccgg

SEQ ID NO: 12963 - DNA, 612 bp, Homo sapiens
  misc_feature: GYAE6OF01ALWUE.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaagccttcggagacccctgtccctcacctgcgcagtctcgtggtggtctttcaatggttactactggagctggactccgccacggtccccgagggaacgggactggaatggattggcggaagtcacgtcgaaatggaacgtccaactaccaacccgtccctcgtcggtcgagtcacgactagccttagactcgtccgaagacgccgcttctctctacgaacctcacctctcgtcgaccgccgacggaccacggtctttctattctgtcgccgcgacgacccgtagggacgggtatttcggacgtcggccgtacgactaccgaaacgtcgttcgggtccgaccccggtcggggaccccgggtaacccgtggtaccctcccggtcctcccgtacgtaccgtcccgttaccaacccggtacgggcccctaccgg

SEQ ID NO: 12964 - DNA, 646 bp, Homo sapiens
  misc_feature: GYAE6OF01DYXW0.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaagccttcggagaccctgtccctcacctgcgcagtctctggtggtctttcaattggttactactggagctggactccgccagtccccagggaaggactggaatggattggcggaagtcactacgaaatggaacgtcccaactaccaaccccgtcctcgtcggtcgagtcacgatacgccttagactcgtaccaagcgccgtcttctctctagaactcacctctgtcgaccgcgcgacacggtctttctatttctgtcgcgcgacgtacccgtgggaagggtctttggaccgtcgggcccgactactaccgaaacgtggtttccgggttacccgacccccgggttccggggggaaccccccgggttaaaccccgttcggggttaccccgtaccccggttcccgttccccgtaccgtaccggtcccgtttaccccgaacccggtaaccggggtcccccttaaccggg

SEQ ID NO: 12965 - DNA, 619 bp, Homo sapiens
  misc_feature: GYAE6OF01A6CI1.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctctggtgggtctttcaatggttactactggagctggactccgccacgtccccgaggggaaggactggaatggattggcggaagtcactacgaaatggaacgtcccaactaccaacccgtcctcgtcggtacgagtcacgatacgaccttagactcgtaccaagacgcccgtacttcctctctacgaactcacctctcgtcgaccgccgacggacacggtctttactactttctgtcgcgcgacgtcccgtagggaacgggtatttcgacgtcggccgacactaccgaacgtgttaccggtcccgacccggtacggggccccgggtaacccgttggtacccgtacccggttctcccgtaccgtaccgtcccgttaccccgaaccgaaccgggtcccctaccggg

SEQ ID NO: 12966 - DNA, 638 bp, Homo sapiens
  misc_feature: GYAE6OF01DAX5P.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctcgtggtgggtctttcaattggttactactggagctggactccgccagtccccgagggaaggactggaatggattgcggaagtcactacgaaatggaacgtcccaactaccaacccgtccctcggtcggtcgagtcacgatacgccttagactcgtaccgaagacgccgcttctctactacgaaactcacctctcgtcgaccgccgacggtacacggtctttctatttctgtgcgccgacgacccgtagggaacgggtatttcggaccgttcgggcccgaccacgttacccaaacgttacggttcgggttcccggacccccggttccgggggacccccgggtaaaccccgttgggtaccctacccggttccttccccgtacgaccgtacccttacccgaacccgaacggggtcccctaccgg

SEQ ID NO: 12967 - DNA, 652 bp, Homo sapiens
  misc_feature: GYAE6OF01EKRQM.43.64.F09.1.454.CMB.1.raw
  modified_base (169)..(169): a, c, t, g, unknown or other
  misc_feature (169)..(169): n is a, c, g, or t
  modified_base (423)..(423): a, c, t, g, unknown or other
  misc_feature (423)..(423): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcncaggactgctgaagccttcggagaccctgtccctcacctgcgcagtctctggtggtctttcaatggttactactggagctggactccgccagtccccgaggggaacggactggaatggattggcggaagtcacgtcggaaagtggaacgtcccaactaccaacccgtccctcgtcggtcgagtcacgatagccttagactcgtacaagcgccgtcttctctctacgaactcacctctcgtcgaccgccgcgacncggtctttactatttctgtgcgcgacgtacccgtgggaacgggtactttacggaccgttcgggcccgtactaacgtacccgtaaacgtacggtttccgggttacccggaacccccggttcggggggtacccccgggtaaccccgttgggtaccccgtacccggttcccttacccgtccgtaccggtacccgttacccccgaacccgtaaccggggcccccttaaccggg

SEQ ID NO: 12968 - DNA, 700 bp, Homo sapiens
  misc_feature: GYAE6OF01BGVVT.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaacgccttcggacgaccctgtccctcacctgcgcagtctcgtggtcgggttctttcgaagttggttactacgtggagctggactcccgccacgtccccgaagggaacgggactggaatggtattcggacggtaagtcacgtacggaaagtcggaacgtacccaaactaccaaccccgttcctaccggtcggtcgagtccaacgatacgccttaagactcgtacaagcgccgtcttctctactacgtaacctcgtacctcgtacgtaccgacccgccggacggtaacctacggttcctttacgttacgtttcgtggtcgccggtacgacggtaacccgtaggggtaacgggttactttcggaccggtcgggtacccacgtacgttaacccgaaagttcgggtttcgggttacccccgaccccggggttaccggggacccccggtaaccgttcgggtacctacccggtccttacccgtacgtaccggtacccttaccgaacccgtacgggtcccctaccgg

SEQ ID NO: 12969 - DNA, 595 bp, Homo sapiens
  misc_feature: GYAE6OF01BOZQZ.43.64.F09.1.454.CMB.1.raw
  modified_base (248)..(248): a, c, t, g, unknown or other
  misc_feature (248)..(248): n is a, c, g, or t
tcagtgtgagtagtcacgaccggtgctcgatttagcgcgtatacaagggggtgcgtttctgagagtcgtggaccgtcctgcacaagaacatgaaacacctgtggttcttcctcctcctggtggcagctccgagatgggtcctgtcgcaggtgcagctacagcagtgggcgcaggactgctgaagccttcggagaccctgtccctcacctgcgcagtctctggtggtctttcaatggttaacactgganctggatccgcagtccccagggaaggactggaatggattggcgaagtcactcgaaatggaagtcccaactacaacccgtccctcgtcggtcgagtcacgatagccttagactcgtccaagacgtccgcttctctctcgaaactcacctctgtcgtaccgccgcggacacggtctttctatttctgtcgcgcggacgacccgtagggaacgggtctttggaccgtgggccgactactaccgaaactcgtttcggttaccgaccccggtcgggggaccccggaacccgttgggtcccgacccgttccgtcccgtcgacgtcccttacccgaccgtaacgggcccctacgg

SEQ ID NO: 12970 - DNA, 673 bp, Homo sapiens
  misc_feature: GYAE6OF01DKUYV.43.64.F09.1.454.CMB.1.raw
tcagtgtgagtagtcacgaccggtgctcgatttagcgcgtatacaaggggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaagccttcggagaccctgtccctcacctgcgcagtctctggtgggtctttcaattggttactacgtggagctggactccgccagtccccgaggggaacgggactgggaactggattggcggaagtcactcgaaatcggaagtcccaactaccaacccgtccctcggtcggtcgagtcacgtatacgccttagactccgtaccaaagacgcccgtctttctccttactagaaaccttcacccttctcgtacggacccgccgacggacctaaccgggtcttttactatttcgtgtgccgcggacgacccgtgggaacggggttatttcggacgttcgggccctactactacccgaacgtacgggtttaccggttccggaccccggttcggggggaccccccgggtaaacccgttcggggtaccctacccggttcccgttacccttaccgacgtacccgtttacccgaacccggtaacgggtccccctaccggg

SEQ ID NO: 12971 - DNA, 831 bp, Homo sapiens
  misc_feature: GYAE6OF01CBOXF.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctctggtgcagctccgagatgggtcctgtcgcaggtgcagctacagcaggtgggcgcaggactgctgaacgtccttcggacaccctgtccctcacctgcgcagtctcgtggtggtctttacgaagttggttactacgtggagtcgtggactccgccgtacgtcccgaagggaggtactaggaatggattcggacggtaagtcactacgaaagtcggaactcccaactaccaacccgtccgtcgtccggtacgtacgtccgaacgactacgtaccctttaagaccgttaccggtccgaaagggtaccgtcccggtaccttttccgtaccgtttaccgtaaacggtaaaacccttcccgtaaccccgtttaccgtacggttaccccgggtaaccccgggcccggtaaccgggtaaacccgttaccgggtttacccttttacgttaacgtttccgtcggttacgaccgtaccggaacgtacccgggtaaggggtaacgggttcttttacggaaccgtccgggacccgtaccgtaacttaaccccggtaaacgtttcgggtttacccgggttaaccccggacccccggggttaaccggggggaaccccccgggttaaccccggttcgggttaacccctaccccgggtttcccttaccccgttacggtccccgttacccgtttaacccccggaaccggtaaacccgggttccccttaaacccggg

SEQ ID NO: 12972 - DNA, 605 bp, Homo sapiens
  misc_feature: GYAE6OF01A5IAP.43.64.F09.1.454.CMB.1.raw
  modified_base (457)..(457): a, c, t, g, unknown or other
  misc_feature (457)..(457): n is a, c, g, or t
  modified_base (498)..(498): a, c, t, g, unknown or other
  misc_feature (498)..(498): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaagtccttcggagacccctgtccctcacctgcgcagtctctggtggtctttcaagtggttactacgtggagctggactcccgccacgtccccgagggaaggactggaatggattggacggaagtcacgtacgaaagtcggaacgtacccaactaaccaaccccgtccctcggtcggtcgacgtcacgatagcctagactcgtaccaagcgcgtcttcgtcacgtacgaactccacctctcgtcgaccggccgcgacgtaccgtctttctatttcgngtcgcgccgacgaccgtagggaggtacgttgacgtggaccncactaccaaacgtcggttcggtacccggacccggtaccggggaccccggtaaccgtcgaccgtccgtcctccgtctcgtaccctaccgaccgaaccggtccgtaccg

SEQ ID NO: 12973 - DNA, 944 bp, Homo sapiens
  misc_feature: GYAE6OF01AHMK3.43.64.F09.1.454.CMB.1.raw
  modified_base (170)..(170): a, c, t, g, unknown or other
  misc_feature (170)..(170): n is a, c, g, or t
  modified_base (213)..(213): a, c, t, g, unknown or other
  misc_feature (213)..(213): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcncaggactgctgaagccttcggacgaccctgtccctcacctgcncagtctcgtggtcggtcttcaagttcggttactagtggacgtcgtaggacctcccggaccgtaccggtacccccggaaggggggtaaaccggtaccgttaggggaaacttcggggtagttttacgggaccggggtaaacgttaccgtaaccgtaacggtaaaacggttcgggaaaccgttacccccgtaaacgttaaccccggtaaacccccgttcccgttacgggttacccgggtacggtaaaccggttacccaaaccgggtaaccttaaccggtacccgtttaaacgggtaccccgttacgggtaaaccccgtaaacgggtaacccggtccccgttacccgttttccgtaccctttaccggtaccgtaaaaccccgttccttaaccccgttcgttacgggtaccgaccccgggtcccggtaacccgggtaacccgttacccggtttacctttttacgtttaccgtttacggtcgtacccgggtcggacccggtaacggtacccgggttaagggggttaacgggttcgtttaccgggaacggttccgggtacccgtaccttaaccgtaacccggttaaggttaccgggtttacgggtaccccgggtaaccccggggttacccggggtaaccccgggttacccggtcgggttaccccgtcccggttacccgtcccgtaccggttaaccctcccgttaacccgaccggtaaacccggtccccttaacccggg

SEQ ID NO: 12974 - DNA, 639 bp, Homo sapiens
  misc_feature: GYAE6OF01DOLRO.43.64.F09.1.454.CMB.1.raw
  modified_base (468)..(468): a, c, t, g, unknown or other
  misc_feature (468)..(468): n is a, c, g, or t
  modified_base (515)..(515): a, c, t, g, unknown or other
  misc_feature (515)..(515): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaacgccgttcggacgaccctcgtccctcacctgcgcagtctcgtggtggtctttcaattggttactacgtggagtcgtggactccgccacgtccccgagggaaggactggaatggattggacggaagtcacgtacgaaagtggaacgtccaaacaccaacccgtccctcgtaccggtgacgtcaacgtatacgaccttagactcgtacaagcgtaccgtctttcgcttactagtaaacctcaccttctgtaccgaccgccgacggactcggtctttcgtactttcgngtcgcgtcgacgtaccgtgggaacggtcttaggacgtcgggaccctnaacgtaccgtaacgtcggtttccggtacccggaccccggtcgggggtaccccgtaacccgtggtacccgtacccggtcctacccgtacgtacgttccacccgaccgtaaccggcccttacccgg

SEQ ID NO: 12975 - DNA, 798 bp, Homo sapiens
  misc_feature: GYAE6OF01EIKFV.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagacccctgtccctcacctgcgcagtctcgtggtggtctttcaatggttactacgtggagcgtggactcccgccacggtccccgaaggggaagggactaggaagtggagttggacggtaagtccaacgtacggaaagtggaacgtacccaacctacccaaccccgtcccgtcggttccggtcgaacgtccaacggtaactacgtaccgttagtacctccgtaccgaaaggacgtcccgtacgtttccctacgttcctaacgaaaccttccctaaccttccgttcgtaccgaccccggcccggtaccggaccgtaccgggttccttttacgttacttttaccgtggttaccgggtcccggaccggtaacggtaacccccggttagggggtaaaccggggttacgttttacgggaaccgttcggggtacccgtaaccgtaacgtaaccccgtaaaacgtccgggttttaccgggtacccgtacccccgggtacggggggtaccccccgggtaacccggtaccgggtacccgtaccccggtttcccgtaccccgttacccgtacggtccccttaaccccgaacccggtaacccgggtccccttaacccggg

SEQ ID NO: 12976 - DNA, 986 bp, Homo sapiens
  misc_feature: GYAE6OF01BI0RT.43.64.F09.1.454.CMB.1.raw
  modified_base (260)..(260): a, c, t, g, unknown or other
  misc_feature (260)..(260): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtgcagctccgagatgggtcctgtcgcaggtgcagctacagcagtggggcgcaggactgctgaagtccttcggacgaccctgtccctcacctgccgcagttctcgtggtgggttcctttacaagttcggttactacgtggacncgtgactccgacctacgtcccgagggacggactggaatggtagtcggacggagtacacgttcgaagtcggaactcccaacgtaccctacccgtcctcggtcgacgtagtccacggtactacgtcctaacgaccgtccgtaaccgaaggactcccgtacttccgtacttaccgtaacgtaaaccttcccgtaaccttcggttaccggtaccggtaacccgccccggggtaaccggtaacccgttacccgggtttaccttttacccgttttacggtttcccgttacgggtaccggtacccggtaaccggggtttaaccccgggtaacccgggtttaacggggggttaaaccgggggttttacgttttaccccgggggtaacccggtttaccgggggtaacccccccgggttaaacgttttaaaccccggtttaaaccccccgggttaaaaaccgggtttaccccggggggtttttaaacccccggggggtttaacccccccggggttaccccccccggggggtttaaacccgggggggggtacccccccggtttaaaaccccggggttccccgggttaacccccgggtttaacccccgggtttaccccccggttttaaccccccggtaaacccggttaccccgggtttaaccccccggtttaacccccccggaaaccccccggggtttaaaaaccccgggggtcccccgttttaaacccccccggggg

SEQ ID NO: 12977 - DNA, 888 bp, Homo sapiens
  misc_feature: GYAE6OF01C9CD1.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcagggactggctaggaacgtccttcggacgtaccctgtccctcacctgcgcagttctcgtgggtggttctttacaagttggtttactacgtgggacgtcgtagggactcccggaccaacggtacccccggaaagggggtaacgggtacctaggggtaaacgttcgggtaagtttacgggaccgggtaaacgttacctaaacggttacggaaaagttacgggtaaaccgtaccccgtaaacgtaacccgtaaaccccgttcccgttacggtaccgggtaccgaacgtaccgtaacgacgttacggtacccgtttagaaccgttccgtaaccgaaacggtaccggtccccgtacctttaccgtaccgttaccgttaacggtaaaccttcctaccgtttaccgtcggtaccggtaccccggccggtaccggtaaccgtaccgggtttacttttacgttacgtttccgtaggttacggtccggaccgggtaacggtacccggttagggggtaaacggggtttactttacgggaccgttcgggacccgtagtaaccgttaccgaacgttacgggtttccgggttacccggacccccgggttcgggggaaccccccgggtaaccgtacgggttacccgttaaccccggttcccttacccgtaccggttaccggtaccccgtttacccggaaaccccggtaaccggggtcccccgttaaaccggg

SEQ ID NO: 12978 - DNA, 649 bp, Homo sapiens
  misc_feature: GYAE6OF01AJBAG.43.64.F09.1.454.CMB.1.raw
  modified_base (379)..(379): a, c, t, g, unknown or other
  misc_feature (379)..(379): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaacgtccttcggacgtacccctgtcccctcaccgtgcgcctagtctcgtggtgggttctttcgaattggttacctacgtggagtctggactcccggccacgtccccgaaggggaacgggtactggaatggattgacggagtcactacgaaatgacgtaccaacgtacaccccgtcctcgtcgtcgacgtcacagtacnctagactcgacaacgacgtccgtcttctctctacgtaactccacccttctcggtcgacccgccggacggaccgtccggtcttttcgtatttccgtgtcggtccgcgtaaccggtacccgtaggggacggttatttcggacgtcggtacccgacactacccgaacgttcggttcggtacccggaccccggtccggggaccccggtaccgtccggtacctccccgttccgtccctacgaccgtcccgttacccgacgtccggccctaccggg

SEQ ID NO: 12979 - DNA, 707 bp, Homo sapiens
  misc_feature: GYAE6OF01EE5GJ.43.64.F09.1.454.CMB.1.raw
  modified_base (168)..(168): a, c, t, g, unknown or other
  misc_feature (168)..(168): n is a, c, g, or t
  modified_base (449)..(449): a, c, t, g, unknown or other
  misc_feature (449)..(449): n is a, c, g, or t
  modified_base (570)..(570): a, c, t, g, unknown or other
  misc_feature (570)..(570): n is a, c, g, or t
  modified_base (657)..(657): a, c, t, g, unknown or other
  misc_feature (657)..(657): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtgggcncaggactgctgaagtccgttcggacgtaccctgtacccctcaccgtgcgcagtctcgtggtggtctttcaattggttactacgtgagctggactccgccacgtccccgaaggggaacgggtactaggaagtggtagttcggacgggtaagtccgtacgtaacggtaaagtcgggaaaccgtaccccaaacgtacccgtaaaccccggtcccgttcggtacgggttacgacgtaccgaacgtactacgtccttagaccgtcgtacgaacgcgccgtccttcnctactacgtaaacctcctacctcgtacgtaccgaacccggccggtaccgtaaccgtacgttcctttacttacgtttcgtaggtacgccgtacggtacgtacccggtaggggtaacgggttnttacggacgtccgggacctctaacgtaccgaaagttcggttccggtcccggtacccgggtacgggaccccggtaaccgtcggtaccncccgttcctccgcgtacgtccctaccggaacccgtaccggccctaaccgg

SEQ ID NO: 12980 - DNA, 865 bp, Homo sapiens
  misc_feature: GYAE6OF01CLWRH.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctctggtggcagctccgagagtcggtcctgtcgcaggtgcagctacagcaggtgggcgcaggactgctaggaacgtcccgttacggacgtacccttcgtcccctcgaccctggccgcgtaacggttcttccgtgggttacggtttctttacgaagtttcggttaactacgtggacgtcgttaggaccgttccgaccgtacggtaccccggaaggggtaacgggacgttagggaagttggtacgttcggacggtaagtaccgtaacgtacggtaaaagttcggaaacgtaccccgtaaacgtaacccgtaacccccgttcccgttacggtccggtaccgtacgtccgaacgtacgtacgtaccgtttacggaccttaccgtaaccgaacgacgtacccgtctttacgtcctacgtacgtaaaccttccgtaacccttcgttacggtacccgaacccggtaccggacggtaccgtaccggttactttactacgtttcgtcggtaccgcggtaccgtaacggtaccggtaacgggtaagggttactttacggaccgtcgggtaccgtaaccgtaacgttaaacccgtaacggttaccgggtttacccgggtacccccggttaacccccggggtacggggttaacccccgggtacccggttaccgggtaccccgtaacccggtttaccccgtaccccgttaccgttaccgtaccccgttaacccgaacccgggtaacccgggtcccttaaaccccggg

SEQ ID NO: 12981 - DNA, 910 bp, Homo sapiens
  misc_feature: GYAE6OF01DW8D2.43.64.F09.1.454.CMB.1.raw
  modified_base (169)..(169): a, c, t, g, unknown or other
  misc_feature (169)..(169): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctcgagatgggtcctgtcgcaggtgcagctacagcaggtggggcncgaggactgctagaagtcccgttcggacgaccccttgtcccctcaccgttgccgacagttctcgttgggtcggttctttacgaaagttcggttaactacggtggacgtcgttaggactcccgaccgtaccggtccccgaagggggaacgggtaccgttagggaaacgttgggacttacgggaacggtaaacgtccgtaacgtaccggtaaaaggtcgggtaaaccgtacccctaaacgtaaccccgtaaccccggttccccgttccgggttacgggtacgaaccgttaccgaaccggtaagttaaccggtaccctttaaggaccgtttacccggtaacctaaaacgggtcgtaccccggtcttttacccgtaccgttaccgtaacggtaaacccttccgtaacccgtttcgtaccggttcccggaccccggtccggacccggttaaccgtaccgggtttccttttaccgtttacggttttcgaacgggttccggtaccggtaccggaaccgggtttccccggtaaggggggttaaggtttacgttaaccgggtcgttacccgggtaccctacgttaactaaccccggtaaaggttccgggtttcccgggttaaccccgggacccccggggttacgggggtaacccccccggttacggttacccgggtacccgttacccgtcccttaccccggacgttaccgtaccccctaccggaacccgtacccgggtccccttaccggg

SEQ ID NO: 12982 - DNA, 550 bp, Homo sapiens
  misc_feature: GYAE6OF02FXYD2.43.64.F09.1.454.CMB.1.raw
  modified_base (472)..(472): a, c, t, g, unknown or other
  misc_feature (472)..(472): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctctggtgggtctttcaatggttactactggagctggatccgccagtccccagggaaggactggaatggattgcggaagtcactcgaaatggaagtcccaactacaacccgtccctcgtcggtcgagtcacgatagccttagactcgtccaagagccgcttctctctgaaactcacctctgtgaccgccgcggacacggctttctatttctgtgcgcgagaccctgggaagggattgactgggccgcactccaaacngttcgttccgacccgtcggggcccgggaaccctggtccaccggtctccgtcacgtccttccaccgtacgggccctacg

SEQ ID NO: 12983 - DNA, 618 bp, Homo sapiens
  misc_feature: GYAE6OF02JF1ND.43.64.F09.1.454.CMB.1.raw
  modified_base (442)..(442): a, c, t, g, unknown or other
  misc_feature (442)..(442): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctcgagatgggtcctgtcgcaggtgcagctacagcagtggggcgcaggactgctgaagccttcggagaccctgtccctcacctgcgcagtctctggtggtctttcaatggttactactggagctggatccgccagtccccgagggaaggactggaatggattgcggaagtcactcgaaatggaacgtccaactaccaacccgtccctcgtcggtcgagtcacgatacgccttagactcgtaccaaggacgccgtacttctctactagaaaccttccaaccttctagtcgaccgccgcggacacggtctttactattcngtgcgcgacgtaccgtgggaagggtactttgaccgttaggccgactactaccgaaacgtcgttcggttaccgaccccggttgggggacccccgggtaaccgttcgggtacccgaacccgttccgttacccgtacgtaccgtccgttacccgaccccgtaacgggaccccttacggg

SEQ ID NO: 12984 - DNA, 724 bp, Homo sapiens
  misc_feature: GYAE6OF02HH5T0.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcaggctccgagatgggttcctgtcgcaggtgacagctacagcagtgggcgcaggactgctgaagccgttcggagaccctgtccctcacctgcgcgaggtctctggtcgggtctttacaatcggttactacgtggagctggactccgccacgtcccgagggaacggactggactggattcggacggtacgtcaccgtcgaacgtcggaactacccaacgtaccaaccccgtcctacggtcggtacgacgtcgacgacgtacgtccgttacgacgttccgtaccgaaacggacgtcccgtacgtttcctcctacgtaacgtaaccttccgacccttcgtacggtcggaccccggccggaccgggacctacgggttcctttacgtactttcgtagtcgcgccgacgtcccgagggtaacgggtactttacggacgttcggacccgtacgtaacgtaacccgtaaacgttacggtttaccggttacccggtaccccgggtcgggggtaccccccgggtaaaccgttccgggtacccgtaccccggttcccgttcccgtaccgtaccggtcccttacccgaacccggtaccgggccccttaacccggg

SEQ ID NO: 12985 - DNA, 614 bp, Homo sapiens
  misc_feature: GYAE6OF02JFEQ8.43.64.F09.1.454.CMB.1.raw
  modified_base (446)..(446): a, c, t, g, unknown or other
  misc_feature (446)..(446): n is a, c, g, or t
tcagtgtgagtagtcacgaccggtgctcgatttagcgcgtatacaaggggtgctttctgagagtcgtggacctcctgcacaagaacaatgaaacacctgtggttcttcctcctcctggtggcagctccgagatgggtcctgtcgcaggtgcagctacagcagtggggcgcaggactgctgaagccttcggagaccctgtccctcacctgcgcagtctcgtggtgggtcttttcgaattggttactactggagctggatccgccagtccccagggaacggactggaatggattgcggaagtcactcgaaatggaatcccaactaccaacccgtcctacgtctgtcgagtcacgatagccttagacctcgtccaagtacgccgcttctctctcgaaacctcaacctctgtgacccgccgcggacacggtctttctacttttctgttcncgtcgagacccgttgggaacggggtatttcggactcgggcccgactcgtacccaaacgtcgttacggttacccgaccccggttgggggccccgggtaacccgttcgggtaccctaccggttccgttcccttccgacgttccccgttaccgacctaaccggggtacccc

SEQ ID NO: 12986 - DNA, 587 bp, Homo sapiens
  misc_feature: GYAE6OF02HW9G5.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctctggtgggtctttcaatggttactactggagctggatccgccagtccccagggaggactggaatggattgcggaagtcactcgaaatggaatcccaataccaacccgtcctcgtcggtcgagtcacgatagccttagactcgtcaagacgccgcttctctctgaaactcacctctgtcgaccgccgcggaccacggctttctatttctgtgcgcgagaccctggaacggggatttggaacctgggcccgactactcccgaaaacaggtttcggtaccgaccccgttcgggggccccgggaacccttcgggtaccacccggttcctcccgtacacggcctttaccccgaacctaaccggggcccctaacgg

SEQ ID NO: 12987 - DNA, 588 bp, Homo sapiens
  misc_feature: GYAE6OF02HMLQK.43.64.F09.1.454.CMB.1.raw
  modified_base (430)..(430): a, c, t, g, unknown or other
  misc_feature (430)..(430): n is a, c, g, or t
  modified_base (472)..(472): a, c, t, g, unknown or other
  misc_feature (472)..(472): n is a, c, g, or t
tcagtgtgagtagtcacgaccggtgctcgatttagcgcgtatacaaggggggtgctttctgagagtcgtggacctcctgcacaagaacatgaaacacctgtggttcttcctcctcctggtggcagctccgagatggggtcctgtcgcaggtgcagctacagcaggtgggggcgcaggactgctgaagccttcgggagacccctgtccctcacctgcgcagtctctgggtgggtctttcaatggttactactggagctggatccgccagtccccgagggaagggactggaatgggattgcggaagtcactcgaaatggaacgtcccaactaccaacccgtccctcggtcggtcgagtcacgatacgcctttagactcgtaccaagacgccgcttctctctagaaactcacctctgtcgaccgccgcggacncgtctttctatttctgtgcgcgacgtacccgtgggaagggtntttgacgtggccgctacgtccaaacgtggtttcgtccgaccccgtggggaccccgggtaaccgtcggtcctacccgtcctccctcgacgtccttacccgaccgacggtccctacgg

SEQ ID NO: 12988 - DNA, 657 bp, Homo sapiens
  misc_feature: GYAE6OF02JE244.43.64.F09.1.454.CMB.1.raw
  modified_base (174)..(174): a, c, t, g, unknown or other
  misc_feature (174)..(174): n is a, c, g, or t
  modified_base (256)..(256): a, c, t, g, unknown or other
  misc_feature (256)..(256): n is a, c, g, or t
  modified_base (504)..(504): a, c, t, g, unknown or other
  misc_feature (504)..(504): n is a, c, g, or t
tcagtgtgagtagtcacgaccggtgctcgatttagcgcgtatacaaggggtggctttcgtgtagagtcggtggacctcctgcacaagaacactgaaacacctgtggttcttcctcctcctggtggccagctccgagatgggtcctgtcgcaggtgcgagctacagcagtgggcngacgggactgctgaagcctttcggataccctgtccctcacctgcgcacgtctctggtcggtcttcaatggttactactgganctggatccgcagtcccaggaaggctggatggattgaggagtcacgtcgaatggaactccgaactaccaacccgtcccgtacgtccggtacgtacggtacaccggtactacgcccgtttaagaccgtcgttaccaaagtacggtacccgtctttaccgtccttactcgaaaaccgtttcctaaccttccgttagtcggttaacccggccgtacggaccgacgggtctttcgtacttctagtcggctcgngaccctagggacggtattcgacgtgtccgtactctaccgtaaactgttacgttcccgtcccggtacgggaccccgggtaacctcggtccgtaacccgtccgttaccctacggtcccgtacgtttaccccgaacgaaccggggtccctaaccgg

SEQ ID NO: 12989 - DNA, 610 bp, Homo sapiens
  misc_feature: GYAE6OF02I4QST.43.64.F09.1.454.CMB.1.raw
  modified_base (170)..(170): a, c, t, g, unknown or other
  misc_feature (170)..(170): n is a, c, g, or t
  modified_base (248)..(248): a, c, t, g, unknown or other
  misc_feature (248)..(248): n is a, c, g, or t
  modified_base (345)..(345): a, c, t, g, unknown or other
  misc_feature (345)..(345): n is a, c, g, or t
  modified_base (475)..(475): a, c, t, g, unknown or other
  misc_feature (475)..(475): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcggcaggtgcagctacagcagtggggcncaggactgctgaagccttcggagaccctgtccctcacctgcgcagtctctggtggtctttcaatggttactactgganctggatccgccagtccccagggaggactggaatggattgcggaagtcatcgaaatggaatcccaactacaacccgtccctcgtcggtcgagtcacgntagccttagactcgtccaagcgccgcttctctctagaaacctcacctctcgtgaccgccgcggacacgggtctttctatttctgtgcgcgacgacccgtgggaaaggggtctttaggacttcgggacccncgtactacccaaacgttacgttacggttacccggaccccgttggggggaccccggtaacccgtcgggttaccacccggttccgtccccgttacgacggttcccgttacccaacccggtacgggccccttaaccgg

SEQ ID NO: 12990 - DNA, 622 bp, Homo sapiens
  misc_feature: GYAE6OF02G8V4D.43.64.F09.1.454.CMB.1.raw
  modified_base (474)..(474): a, c, t, g, unknown or other
  misc_feature (474)..(474): n is a, c, g, or t
tcagtgtgagtagtcacgaccggtgctcgatttagcgcgtatacaaggggggtgctttctgagagtcgtggacctcctgcacaagaacatgaaacacctgtggttctcctcctcctggtggcagctccgagatgggtcctgtcgcaggtgcagctacagcagtgggggcgcaggactggctgaagccttcgggagaccctgtccctcacctgccgcagtctctggtgggtctttcaattggttactactgggagcgtggatccgccagtccccagggaaggactggatggattgcggaagtcactcgaaatggaagtcccaactaccaacccgtccctcgtcggtcgagtcacgatacgccttagactcgaccaagcgccgtcttctctctagtaaactccaacctctgtcgaccggccgacggacaccggtctttctactttcgtgtcgcgcgacgtacccgtgggaagggtntttacggacgtcgggccgacgtaccttaccgaaacgttcgttgggttacccgaccccggtccgggggtaccccgggtaacccttcgggtaccctacccggttccttcccgtaccgcgtcccttacccgacccgaccgggccctaccgg

SEQ ID NO: 12991 - DNA, 588 bp, Homo sapiens
  misc_feature: GYAE6OF02IXR3N.43.64.F09.1.454.CMB.1.raw
  modified_base (211)..(211): a, c, t, g, unknown or other
  misc_feature (211)..(211): n is a, c, g, or t
  modified_base (247)..(247): a, c, t, g, unknown or other
  misc_feature (247)..(247): n is a, c, g, or t
  modified_base (377)..(377): a, c, t, g, unknown or other
  misc_feature (377)..(377): n is a, c, g, or t
  modified_base (412)..(412): a, c, t, g, unknown or other
  misc_feature (412)..(412): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcncagtctcgtggtggtctttcaatggttacactgganctggatccgcagtccccagggaaggctggaatggattgcggaagtcactcgaaatggaagtccaactacaaccgtccctgtcggtcgagtcacgtatagccttagactcgtacaacgacgccgtcttccncgtctagaaacctcacctctgcgaccgccgcgacncgtcttctatttcgtgtcgcgcgacgtacccgtaggaacgggtatttcggacgtggccgacgtagttacccaaagtcggttcgttacccggacccggtcggggtaccccggtaacccgtcgtcccgaaccgttctcccgtacgacgtccttacccgaaccgaccgggtccctacgg

SEQ ID NO: 12992 - DNA, 600 bp, Homo sapiens
  misc_feature: GYAE6OF02HZUO8.43.64.F09.1.454.CMB.1.raw
tcagtgtgagtagtcacgaccggtgctcgatttagcgcgtatacaaggggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctctggtgggtctttcaattggttactactggagctggactccgccacgtccccagggaaggactggaatggattgcggaagtcactcgaaatggaatccaactaccaacccgtccctcgtcgtcgagtcacgatacgcttagactcgtacaagacgcgcttctctctcgaactcacctctgtcgaccgcgcggacacggtctttctatttctgtcgcgcgacgtacccgtgggaacgggtatttggaccgtcgggccgcaacgttaccgaaacgtggtttcggtaccgtaccccggtcgggggaccccgggaacccgttcgggtaccacccggttacctcccgttcgacgtccttaacccgaccggtaccgggccctaaccgg

SEQ ID NO: 12993 - DNA, 616 bp, Homo sapiens
  misc_feature: GYAE6OF02HHA6Z.43.64.F09.1.454.CMB.1.raw
  modified_base (468)..(468): a, c, t, g, unknown or other
  misc_feature (468)..(468): n is a, c, g, or t
tcagtgtgagtagtcacgaccggtgctcgatttagcgcgtatacaaggggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagccttcggagaccctgtccctcacctgcgcagtctctggtggtctttcaatggttactactggagctggatccgccagtccccgagggaagggactggaatggattggcggaagtcactcgaaatggaagtccaactacaacccgtccctcgtcggtcgagtcacgatagccttagactcgtccaagacgccgtcttctctctagaactcacctctcgtcgacccgtccgcggaccacggtctttctactttctgtcgcgccgacgacccgtagggaacggggtntttacggacgttcgggccgtcgaatacccaaacgtacggttacggttcccggaccccgttcggggggtacccccgggtaacccgttcgggtaccctacccggtccttcccgtccacgtcccttccgaacccgtacgggcccctaccgg

SEQ ID NO: 12994 - DNA, 642 bp, Homo sapiens
  misc_feature: GYAE6OF02HVLGN.43.64.F09.1.454.CMB.1.raw
  modified_base (169)..(169): a, c, t, g, unknown or other
  misc_feature (169)..(169): n is a, c, g, or t
  modified_base (441)..(441): a, c, t, g, unknown or other
  misc_feature (441)..(441): n is a, c, g, or t
  modified_base (447)..(447): a, c, t, g, unknown or other
  misc_feature (447)..(447): n is a, c, g, or t
  modified_base (471)..(471): a, c, t, g, unknown or other
  misc_feature (471)..(471): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcncaggactgctgaagccttcggagaccctgtccctcacctgcgcagtctcgtggtgggtctttcaattggttactacgtggagctggactccgccagtccccgaagggaaggactggaatggattggcggaagtcacgtacgaaatggaacgtcccaactaaccaacccgtcctcgtcggtcgagtcacgatacgtcctagactcgtcaagacgccgtcttctctctagaactcacctctgtcgaccgccgcggacacggtctttcttattcngtcgcncgagtacccgtgggtaacggggtntttcggacgtcgggcccgtactaacgtacccaaagtacggtttcgggttaccccgacccccgggttcgggggtacccccggtaaacccgtcgggtaccctacccggttacccttccccgtaccgtacggcccttttaccccgaacccgtaccggggtacccttaacccggg

SEQ ID NO: 12995 - DNA, 716 bp, Homo sapiens
  misc_feature: GYAE6OF02GNNEO.43.64.F09.1.454.CMB.1.raw
  modified_base (230)..(230): a, c, t, g, unknown or other
  misc_feature (230)..(230): n is a, c, g, or t
  modified_base (267)..(267): a, c, t, g, unknown or other
  misc_feature (267)..(267): n is a, c, g, or t
  modified_base (386)..(386): a, c, t, g, unknown or other
  misc_feature (386)..(386): n is a, c, g, or t
tcagtgtgagtagtcacgaccggtgctcgatttagcgcgtatacaagggggtgcgtttctcgagagtcgtggacctcctgcacaagaacatgaaacacctgtggttcttcctcctcctggtggcagtcgtccgagatgggtccgttgtcgcaggtgtacagctacagcgaggtggggcgcgaggactggctggaagccttcgggacgacccgtcgtccctcacctgcgcngtctcgtggtcggtctttacaatggttactagtggancgtggactccgccacgtccccgagggacggacgtggaatgggacttggcgggaagtcactacgaagtggactacccaactacacccgtccctggtcggtcgacgtcacgatagccttanactcgtaccaagtacgcccgtattccgtctacctacggtaaaacctccgtacccgttacgttaggtaccgaacccggccgggtaaccgggacctaaccgggttaccttttaccgttaacgtttcggtacggtacgggacccgtacggtaaccgttaccccggtaggggtaacggggtttacttcgggaccggttcgggaccctgtaaccgttaaccaaacggtttcgggttacgggttcccggtacccgggtcggggaccccggtacggtacgggtccacccggttccttccgacgtcgttaccacccgtaccgtaccgggcctacccgg

SEQ ID NO: 12996 - DNA, 632 bp, Homo sapiens
  misc_feature: GYAE6OF02HU1L6.43.64.F09.1.454.CMB.1.raw
  modified_base (171)..(171): a, c, t, g, unknown or other
  misc_feature (171)..(171): n is a, c, g, or t
  modified_base (194)..(194): a, c, t, g, unknown or other
  misc_feature (194)..(194): n is a, c, g, or t
  modified_base (387)..(387): a, c, t, g, unknown or other
  misc_feature (387)..(387): n is a, c, g, or t
tcagtgtgagtagtcacgaccggtgctcgatttagcgcgtatacaaggggggtgctttctgagagtcgtggacctcctgcacaagaacatgaaacacctgtggttcttcctcctcctggtggcagctccgagatgggtcctgtcgcaggtgcagctacagcaggtggggcncaggactgctgaagccttcgganaccctgtccctcacctgcgcagtctctggtggtctttcaattggttactactggagtctggactccgccacgtccccgaggggaaggactaggaatggattgcggaatccactacggaatggaacgtacccaactaccaacccgtcctcgtcggtacagtcacgatacgcttagactcgtaccaagcgccgtnttacctctactacgaactccaacctctcggtacgtaccgccggacggacgaccggtctttactactttcgtgtcgcgacgagcccgtagggaaggttatttacggacgtcgaccgctaacctaccgtaaacgtggtttaccggtccgtaccccggtccgggggacccggtaaacccgttggtacccgtaacccgttcctaccctcgacggtccctttacccggaaccgtaccgggacctacccgg

SEQ ID NO: 12997 - DNA, 1018 bp, Homo sapiens
  misc_feature: GYAE6OF02F2U0P.43.64.F09.1.454.CMB.1.raw
  modified_base (159)..(159): a, c, t, g, unknown or other
  misc_feature (159)..(159): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacancggggggggggggggggatgggggcgacaggactgctgaacgtccttcggacgacccctgtcccctcacctgcgcagtctcgtggtggttctttcaagttggttactacgtggacgtcgtggactcccgccgtacgttcccccgaagggggaacgggtactagggaattcgggaatttcggaccgggtaaacgttccaacgttaccggtaaaagttcgggaaaccgtttacccccgaaaaccgttaacccgtaaaccccccggtttcccccgttacccgggtttacccggggttaccggtaacggttacccgtaaaccggtaaacgtttaaccgggttccccgtttttaaacggaaccccgtttacccggtttaacccccgaaaaagggtacccgggtacccccgggttaaccctttttccccggttacccgtttacccgtttaaccgggtaaaaaaccccgtttccccttaaaccccgttttacccggtttaccgggttaccccgggtaaaccccccggggtaccccgggtaaccccggggtaaacccggttaacccggggttacccttttttaccgtttaaaccgttttttccgttaacgggttcgtacccgggtaccgggtaaccggtaacccccgggtttagggggtaaacgggggtttacgtttacgggaccgttacgggcccgtaaccgttaacgtaaccccgtaaacgtacgggtttccggttacccggtaccccggtccggggggtacccccgggttaacccggtcgggttaccccgtaacccggttccgttacccgtaccgttacgtccccgtttacccggaacccggtacccgggtacccgttacccgg

SEQ ID NO: 12998 - DNA, 665 bp, Homo sapiens
  misc_feature: GYAE6OF02G0G51.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcaggtggggcgcaggactgctgaagccttcggagaccctgtccctcacctgcgcagtctctgggtggttcttcaattcggttactacgtggagctggactcccgaccacgtccccgagggtacggacggtacggtagtagtagttcgtcgggaacgtcacgtacgaagtaggaacgtaccctaacctaccgtaacccgtcccgtacgtccgggtcgtacgtacgaccgtaactacgtaccgtacgtacctaccgtacaacgacggccgtcgtccttacctcgtagtaacctacaccgttctacgtacggtacccgcccggtccggtaacgtaccggtatttccttacgttacttcggtcgccgtacggacacccggtagggtagggacgttacggtcgacggcgctaactaccgtaaacgtagtccggttccgacccggttccgggaccggtacccgtcgtacgtacccgtcgttccacgctccacccgtcgaccggtacccgtcg

SEQ ID NO: 12999 - DNA, 946 bp, Homo sapiens
  misc_feature: GYAE6OF02JDE40.43.64.F09.1.454.CMB.1.raw
  modified_base (169)..(169): a, c, t, g, unknown or other
  misc_feature (169)..(169): n is a, c, g, or t
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcncaggactgctgaacgcccttcggagacccctgtccctcacctgcgcagtctcgtaggtcggtctttacaagttcggttactacgtggagtctggtactcccgccacgttccccgaaggggaacgggtactagggaactggtaacgttggaccggtaaggttccgaaccgttacggtaaaacgttcgggtaaaccgtaccccgtaaaccgttaacccgtaaacccccggttccccgttacccgggttaccggggttacccggtaacggttacccgtaaaccggtaacgtttaaaccggtaccccgttttaaaccggtaaccggtttccccgggttaaacccgaaaacggtacccgggtaccccgtttaccggttttacccgttcccttaaacccggtttaccgaaaaacccgtttcccggtaaaccccgttttcccgttaacccgggttaaccggtaaacccccggggtaccccgggtaacccgggttaacccggtaaacccggggttccctttttaacgttaacccgtttttcgtaaccggttccggttacggacccgggttaaccggtaccccggtagggggtaaacggggttacctttacggtaccggttccggggtcccgtaccgtaaccgttaaccgtaaacgttacgggtttaccgggtccccgtaccccgggtcggggtacccccgggtaacccgttcggtacccgtaccggttcccgtacccgttaccacggttccctacccgaacccggtaccggtacccttacccggg

SEQ ID NO: 13000 - DNA, 666 bp, Homo sapiens
  misc_feature: GYAE6OF02HN91T.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctcctcctggtggcagctccgagatgggtcctgtcgcaggtgcagctacagcagtggggcgcaggactgctgaagcctttcggagaccctgtccctcacctgcgcagtctcgtggtgggtctttcaatggttactactggagctggactccgccacgtccccgagggaacgggactaggaatggattggacggtaagtcactagaaagtggaacgtacccaactaaccaacccgtccctcgtccggtcgagtacacgatacgccttagactcgtacaagcgccgtcttctctctagaacctcacctcgtcgtcgaccgccgacggacacgttctttctatttcgtgtcgcgtccgacgtaccgtaggggtaagggtagtttacggaccgtcgggaccctacgtaaccgtacccgtaaaggtaccgttttacggttacccgggttaccccggtacccggggttaccccggggtaacccggtccggttaccggtaccccgttacccgttccgtaccgtaccgtaccgttcccgtaaccccggaccggacccgttacccgg

SEQ ID NO: 13001 - DNA, 587 bp, Homo sapiens
  misc_feature: GYAE6OF02IMXI7.43.64.F09.1.454.CMB.1.raw
  modified_base (53)..(53): a, c, t, g, unknown or other
  misc_feature (53)..(53): n is a, c, g, or t
  modified_base (394)..(394): a, c, t, g, unknown or other
  misc_feature (394)..(394): n is a, c, g, or t
  modified_base (420)..(420): a, c, t, g, unknown or other
  misc_feature (420)..(420): n is a, c, g, or t
  modified_base (430)..(430): a, c, t, g, unknown or other
  misc_feature (430)..(430): n is a, c, g, or t
  modified_base (435)..(435): a, c, t, g, unknown or other
  misc_feature (435)..(435): n is a, c, g, or t
  modified_base (451)..(451): a, c, t, g, unknown or other
  misc_feature (451)..(451): n is a, c, g, or t
tcagtgtgagtagtcacgaccggtgctcgatttagcgcgtatacaagggggtnctttctgagagtcgtggacctcctgcacaagaacatgaaacacctgtggttcttcctcctcctggtggcagctccgagatgggtcctgtcgcaggtgcagctacagcaggtggggcgcaggactgctgaagccttcggagaccctgtccctcacctgcgcagtctctggtcggtctttcaagtggttactactggagcgtggactccgccacgtccccgagggaacgggactggaagtggatggacggagtcactacgaatcggaactaccaactacacccgtccgtcgtcggtacgacgtacacgatacgcttagactcgtaccaagacgctctctctcnaactcacctctgtcgaccgcgcgacncggtcttctnttcgngtcgcgcacgtcccgngggtaagggtcttacgacgtcggccgacataccgaaagtcgttcgtaccgacccgtcggggtacccggaccgtcggtacctaccggttctacccgtacgtcgtacccgtacccggaaccgtaccggaccctaccgg

SEQ ID NO: 13002 - DNA, 887 bp, Homo sapiens
  misc_feature: GYAE6OF02IKA5Z.43.64.F09.1.454.CMB.1.raw
tcagtgtgagtagtcacgaccggtgctcgatttagcgcgtatacaagggggtgctttctgagagtcgtggacctcctgcacaagaacatgaaacacctgtggttcttcctctcctggtgcagctccgagatgggtcctgtcgcaggtgcagctacagcaggtggggcgcaggactgctgaagccttcggacaccctgtccctcacctgcgcagtctcgtggtggtctttcaattggttacctacgtggagctggactaccgccgtacgtccccgaagggaaacggctaggaatcggattacggacgggtaagttccgtaaacgttacggaaaagttcggggaaccgttaccccgtaaaccgttaacccgaaaaccccccggtttccccgtaccggttaacccgggttcccgtaaacggttaccgaaaccggttaagtaaaccggtacccttttaaacggacccgttacgtaacccaaacggtacggtacccgtccgtttaacccttacgttaccgtaacggtaaacccttcctaacccgtttcccgttaacgggttaaccggaacccccgggtacccggccggggttaaaacccgtaccggggtttccctttttaacccgttagtttttacccgtggttacggttacccggaaccggtaaccggtacccccgtaagggggtaacggggttttaactttaccgggtaaccggttacgggcccgttaaccgaaccgttttaaacccgaaaccgttaacgggtttccgggttacccggtacccccgggttaccgggggtacccccggtaaaccggttccggtacccgtacccgttccttacccgttccgacgttaccgttaccccgaaccgtacccgggacccttaccgg

SEQ ID NO: 13003 - DNA, 763 bp, Homo sapiens
  misc_feature: GYAE6OF02FROB4.43.64.F09.1.454.CMB.1.raw
  modified_base (116)..(116): a, c, t, g, unknown or other
  misc_feature (116)..(116): n is a, c, g, or t
  modified_base (150)..(150): a, c, t, g, unknown or other
  misc_feature (150)..(150): n is a, c, g, or t
  modified_base (170)..(170): a, c, t, g, unknown or other
  misc_feature (170)..(170): n is a, c, g, or t
  modified_base (214)..(214): a, c, t, g, unknown or other
  misc_feature (214)..(214): n is a, c, g, or t
  modified_base (459)..(459): a, c, t, g, unknown or other
  misc_feature (459)..(459): n is a, c, g, or t
tcagtgtgagtagtcacgaccggtgctcgatttagcgcgtatacaagggggtgctttctgagagtcgtggacctcctgcacaagaacatgaaacacctgtggttcttcctcctccnggtggcagctccgagatgggtcctgtcgcaggtncagctacagcagtggggacncaggacttgcgtgaacgtccgtttcgggaatccccttgtccccncgaccttcggacgccgtagtccttcgtggggttcggttctttacgaaacgttggtttaaccacggttgggactcgtacgtccgtcccgaccgtaccggtacccggaaaggggtacgttacgtaggtaactgggttaatcggacggtaccgtcgtacgtaagacggtaggacctacccgtaacgttcccgaaccccgttggtacgttccgtacggactccaagtcgttaccgactttcacccgtanaacggacgccgttaccgttccttagccttacgaaaccgtcgtacctcgtacgtcgaccgccgcggcgtaccgtcgttacttcgttacgttcgtgacgtccgaacgtcccggtacgtacgggtacggttgtaccgttcgaccggtactccgtaacgttaccgtaacggtttaccgggtcccgttaccccgggaccggggttccgggtaaccccgggttcccggttcggttaaccccggtccgtttacccggtacgttccgaccggttcccgtaccccggtaacgtaccggccccgttaacccggg

SEQ ID NO: 13004 - DNA, 526 bp, Homo sapiens
  misc_feature: GYAE6OF01CA8BD.25.39.D06.1.454.CMB.1.raw
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagccgtgacattggtgcttataactatgtctcctggtcccaacaacacccaggcaacggcccccaaactcatcatttatgatgtcagtcatcggccctctggtagtttctggtcgcttctctggctccaagtctggcaactcggcctcctgaccatcgtcggggctccgaggctgaggacgaggtctacttattattgctatttcatacagagacaaccaacagtcgtggtgttcggcgggagggaccaagttcgaccgtccgtcggtcacgccaacggctcgccccctggtcctaccg

SEQ ID NO: 13005 - DNA, 563 bp, Homo sapiens
  misc_feature: GYAE6OF01B3GQM.25.39.D06.1.454.CMB.1.raw
  modified_base (518)..(518): a, c, t, g, unknown or other
  misc_feature (518)..(518): n is a, c, g, or t
  modified_base (557)..(557): a, c, t, g, unknown or other
  misc_feature (557)..(557): n is a, c, g, or t
tcagactgtacagtcacgaccggtgctcgatttagtgacatctcgcagttctttgggggagctacaacaggcaggcaggggcagcaagatggtgttgcagacccaggtcttcatttctctgttgctctggatctctggtgtccccggggacatcatattgaaccagtctccagagtccctgtctgtgtctctgggcgggagggccaccatcaactgcaggtccagccagagtgtttcgacgactccgccaataggaacttcttaggtggtatcagcagcggccaggacagcctcctaagttgctcgtttactgggccctcgaacccggcacctccggcgtccctggccgattcactggcaggcggtctgggacagtatttcactcctcaccctcacgtaacctgaccaacctgaaagtactcggccggtactagttttaattagtttcggacaagtctaaatacctaatacccacttccgaatccaccttcgggccgtagggacccaggacgtggaanactaccgaaaacgtactggtacggcttagccctaaccgngttccg

SEQ ID NO: 13006 - DNA, 488 bp, Homo sapiens
  misc_feature: GYAE6OF01DLQ3A.25.39.D06.1.454.CMB.1.raw
  modified_base (319)..(319): a, c, t, g, unknown or other
  misc_feature (319)..(319): n is a, c, g, or t
  modified_base (366)..(366): a, c, t, g, unknown or other
  misc_feature (366)..(366): n is a, c, g, or t
  modified_base (379)..(379): a, c, t, g, unknown or other
  misc_feature (379)..(379): n is a, c, g, or t
  modified_base (390)..(390): a, c, t, g, unknown or other
  misc_feature (390)..(390): n is a, c, g, or t
  modified_base (402)..(402): a, c, t, g, unknown or other
  misc_feature (402)..(402): n is a, c, g, or t
  modified_base (407)..(407): a, c, t, g, unknown or other
  misc_feature (407)..(407): n is a, c, g, or t
  modified_base (411)..(411): a, c, t, g, unknown or other
  misc_feature (411)..(411): n is a, c, g, or t
  modified_base (417)..(417): a, c, t, g, unknown or other
  misc_feature (417)..(417): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctctgtacaacacacccgacaaacgccccaaactcatgatttatgaggcactaagcgccctnagggttctgctcgcttctctggctccagtctggcatacggcctcctnacaatctctgtcncagctgagcgngctgattatctncttcncacntgtcgnagtagcctagttgggtgttcggcaaggacgggacaaaggtcgaccgtccgtaggtcacgcccgaggtcccg

SEQ ID NO: 13007 - DNA, 524 bp, Homo sapiens
  misc_feature: GYAE6OF01EGW9J.25.39.D06.1.454.CMB.1.raw
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataatttttgagaccagtaagcggccctctggggtttctagtcgattcactggctccaagtctggcaacacggcctccctaacaatctctgggctccagctgaagacgaggctgattattactgctactcatatggacacatcacaaatcccgtcttcggacctgggaccagggtcaccgtcctgggtcagcccaaggccaaccccactcgtcactctgtcccgcccc

SEQ ID NO: 13008 - DNA, 520 bp, Homo sapiens
  misc_feature: GYAE6OF01D8OVI.25.39.D06.1.454.CMB.1.raw
  modified_base (332)..(332): a, c, t, g, unknown or other
  misc_feature (332)..(332): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctgtaccaacaacaccccgacaaacgccccaaactcatgatttatgaggcactaagcgcctcgtagggttcngctcgcttctctcggctcaagtctggacaatacggcctcctgacaatctctgtctcgagctgagcgagctgtattatactgtccttctcatagttcgtcgactagtacgcgtacgtttgggtcgttcggcgtaggacgggaaccaaaggtcgacccggtccgtagggtaccacggcccgaaggtcccg

SEQ ID NO: 13009 - DNA, 610 bp, Homo sapiens
  misc_feature: GYAE6OF01CTMVI.25.39.D06.1.454.CMB.1.raw
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacctatttcctgcactggaaccagcactgatgttggcttactttgtaccttgtctcttcggtaccaacaacaccgacaacgctaccaactactataatttgagacagtaacgcggcctcgttgggtttctagtcgtattctacgtcgtctcctaaaaaaacgtctacggactaacaccggtccctaccctaactaactctcgtcggtctccgacggcgtacgaacgacggacggtcgttgtttactttcttgtcgttgttgtcttagttgtggtacgttacgtaaactaagtttaggttcggtcgtcggtacgggacgggtaccgtaagttcgtaccgtacgttacgtacgtacgaccgacggtcgtccgtcccgtcgtcctactcctccgttccctccctccc

SEQ ID NO: 13010 - DNA, 576 bp, Homo sapiens
  misc_feature: GYAE6OF01EPDDS.25.39.D06.1.454.CMB.1.raw
  modified_base (217)..(217): a, c, t, g, unknown or other
  misc_feature (217)..(217): n is a, c, g, or t
  modified_base (279)..(279): a, c, t, g, unknown or other
  misc_feature (279)..(279): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgtgctacttgaccttgtctcttggtaccaacaacacccgganaaacggctaccaaactcataatttttagagtaccagtaagacggccctcgtgggtttctagtcgattcactgctcaagtctggcaacacggcctaccctaactaatctactcgggctccaggctagaagacgaggtctgtttattctgcttgttctctatgtgactagaaaactattggtgtcgtcgggcggtagggacccggttgaccggtaccgtaggtccacggccccgaaggtccgtccgcccccgttcggtacctaccgtccttacggttcccccacccgttccgttacccg

SEQ ID NO: 13011 - DNA, 531 bp, Homo sapiens
  misc_feature: GYAE6OF01BIICM.25.39.D06.1.454.CMB.1.raw
  modified_base (364)..(364): a, c, t, g, unknown or other
  misc_feature (364)..(364): n is a, c, g, or t
  modified_base (375)..(375): a, c, t, g, unknown or other
  misc_feature (375)..(375): n is a, c, g, or t
  modified_base (398)..(398): a, c, t, g, unknown or other
  misc_feature (398)..(398): n is a, c, g, or t
  modified_base (421)..(421): a, c, t, g, unknown or other
  misc_feature (421)..(421): n is a, c, g, or t
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgtgctactttgaccttgtctcttggtaccaactaacacccggacaaaggctccaaactcataattttgagaccagtaacgcggccctctggggtttctagtcgattcactggctccaagtctgcaacncggctcccaanatctctggctcgagctgagacgnggctgattatactgctactcatntggacacatcacaaactcccgtcttcggacctcgggaccagggtccaccggtcctgggtcagcccaacggcccaaccccgacttcgtaccactcctcgtccccgtccccg

SEQ ID NO: 13012 - DNA, 538 bp, Homo sapiens
  misc_feature: GYAE6OF01AHTBH.25.39.D06.1.454.CMB.1.raw
  modified_base (470)..(470): a, c, t, g, unknown or other
  misc_feature (470)..(470): n is a, c, g, or t
  modified_base (474)..(474): a, c, t, g, unknown or other
  misc_feature (474)..(474): n is a, c, g, or t
tcagactgtacagtcacgaccggtgctcgatttagtgacatctcgcagttctttggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggagcttggtacagccaggccggtccctgaccactctcctgcacagcttccggactcacctttggtgagcatgctatgaccgtgggtccgccaggctccgagggaggtctggagtggcgttgggttcagttagagcgaagcctagtgggtggggacaacacaataccggccgcgtctaggtaaaaggcaagattcgacgccctctcaaagagatgtaacttaccaaagcctaatcgcctatctcgcactangacncagcctgacgagcgacggctcgacggtccgtagtattactcgtttacttattactgtggtaagg

SEQ ID NO: 13013 - DNA, 633 bp, Homo sapiens
  misc_feature: GYAE6OF01CMTWN.25.39.D06.1.454.CMB.1.raw
  modified_base (303)..(303): a, c, t, g, unknown or other
  misc_feature (303)..(303): n is a, c, g, or t
  modified_base (373)..(373): a, c, t, g, unknown or other
  misc_feature (373)..(373): n is a, c, g, or t
tcagactgtacagtcacgaccggtgctcgatttagtgacatctcgcagttcgtttgggggggtcacaagaggcagcgctctcgggacgtctccaccatggcctgggctctgctgctcctcactctcctcactcaggacacagggtcctgggcccagtctcgccctgactcagcctgcctcgtgtctggtctctggacagtcgatcacatctcctgcactgaatcaccatgatgttgctatttcatgaccttgtctctagaccaacaacacccgaacaaacgaccccaaatcatgtaatttagngaggactaacgtaacgcggccctgtacggggttctgctcgcttctcgtcggtctacctaagttcacgganaaacgtccggtcctaccctagtaacaacttctcgtaggttccacgtacggtccgtaggaacgggacgtaaagggtcttaaggatttttaacgtaacgttcgtcctttcttacccaaagttcgttcgggtacgaaccgtagtaacgccgttaaggttccggggttagttaccgggaccgtaaaggaaacggggtaacccgtaaaggtccggtaacccggttcccggtacgggtaccgaaccggacccgtaacggtcccccg

SEQ ID NO: 13014 - DNA, 724 bp, Homo sapiens
  misc_feature: GYAE6OF01AHZYM.25.39.D06.1.454.CMB.1.raw
tcagactgtacagtcacgaccggtgctcgatttagtgacatctcgcagttctttggggggggtcacaagaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaacccagccgtgacagttggtgcttaataactatgtctcctggtcccaacaacaccaggcaacggcccccaaactcatctatttatgatgtcagtcagtccggtccctcgtggtacgttttcgtcggttccgtctttccgtcgttcgggtccttaccgtaaggttccgtacggacctaaccgttcccggcccttccccgtacggtaccctacgttcccggtaccgggggtccctaccggacggtcgtcgggaacggaccggacggtaccttaacgtttatttagttacgtcttaacgttttccaagttaccgaacggaacgtaaaccctaacctaaaccgttacggttccgttacgggtacgggtttaccggggtacggggtaaccgggtaacccgtaaacgggtttccggaccccgggttacgttccgggttaccgaaccggtaccccggtaacgggtcccgttacccggttaccccccgttccgggttcctaccccgg

SEQ ID NO: 13015 - DNA, 652 bp, Homo sapiens
  misc_feature: GYAE6OF01BJ9AD.25.39.D06.1.454.CMB.1.raw
tcagactgtacagtcacgaccggtgctcgatttagtgacatctcgcagttctttgggggagctacaacaggcaggcaggggcagcaagatggtgttgcagacccaggtcttcatttctctgttgctctggatctctggtcgtccccggggacatcatattgaaccagtctccagacgtccctgtctgtgtctcgtgggcgggacgggccaccgatacgaacgtcgactaggtccagccagtagtgtttcgacgactccgacaagtacggaacttcgtaggtgtatcgagcaggcgacctaggacaggccctcgtaagttcgcttcgtttacgcgggcctacgaaccccggctaaccgtcccggccgtccctggcccgtattcacgttggcacggtcggtcgtagggacagtactttcaacctcgtaccacctacgtactaaccgtgaactaccgttagaacgtagtcgacggtaccgttagtttagttacgttcgtacaacgtactaataacctactaaccctacgttaccgacttaccgacccgtttaccgggccggttaccggaaccgtaacggtacggtacggtaaacgtacgtaaacccgaaaacgtacgtacggtcggtacctacgtaaccgtaccttaacgtttcg

SEQ ID NO: 13016 - DNA, 536 bp, Homo sapiens
  misc_feature: GYAE6OF01D4R22.25.39.D06.1.454.CMB.1.raw
  modified_base (455)..(455): a, c, t, g, unknown or other
  misc_feature (455)..(455): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactttcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacaccggacaaaggctccaaactcataattttgagaccagtaagcggccctctggggtttctagtcgtattcactggctccaagtctggcaacacggcctccctaacaatctcgtggctccaggctgaagacgaggtctgtttactttctgtctgttgctatgtggctagaaactaatttggntcgtcggacggacgggacccattcggaccgtcttagcagcccaaggctcgcccctcggtcactctcttccccgccctcctc

SEQ ID NO: 13017 - DNA, 566 bp, Homo sapiens
  misc_feature: GYAE6OF01BPQ25.25.39.D06.1.454.CMB.1.raw
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgtcctgactcagcctgcctccgtgtctgggtctcctggacagtcgatcaccatcctcctgcactggaatcaccactgatgttgcatttcatgaccttgtctcctggtaccaacaaccaccccgacaaacgcccccaaatcatgattangaggcactagcgccctcgtaggggtttcngcctcgccttcgtctggctaccaagtctcggactaaactaccggccctccctgactaactcctcgtcgtcctaccgaggctgacggacggagacgtgtacttattacctgtcttctcctactagtcgtcggctagtacgcgtacgttcgggtgttccggacagggtaacgggaacccaaaggtccgtaacccggttcggtacgggtaccgaccggtacccgacggtcccg

SEQ ID NO: 13018 - DNA, 588 bp, Homo sapiens
  misc_feature: GYAE6OF01EA2FW.25.39.D06.1.454.CMB.1.raw
  modified_base (214)..(214): a, c, t, g, unknown or other
  misc_feature (214)..(214): n is a, c, g, or t
  modified_base (226)..(226): a, c, t, g, unknown or other
  misc_feature (226)..(226): n is a, c, g, or t
  modified_base (383)..(383): a, c, t, g, unknown or other
  misc_feature (383)..(383): n is a, c, g, or t
  modified_base (444)..(444): a, c, t, g, unknown or other
  misc_feature (444)..(444): n is a, c, g, or t
  modified_base (473)..(473): a, c, t, g, unknown or other
  misc_feature (473)..(473): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctcgtgtctgggtctctggacgtcaatcactatttccngcactggaaccngcactgatgtggcttactttgacctcgtctctaggtaccaacaacacccggaacaaacggctaccaaactctaattaattttgacgaccagtaagccgtcctgtgggtttctagtcgattcacgtcgctcaagtctggacaacacgcctaccctaanaactctcgtcgggctccgaggctagaacgtacgagtcttagtttattcgtgtcttgttcgntagtgtgtactaagaaaacttagtttggngtcgtcggacggacggtacctaagtcggtaccgttattaacgtcgacggaccgaacggtcctacccggtcccccgtcggttacctaccttccgtccgttcccccgcccttacccg

SEQ ID NO: 13019 - DNA, 742 bp, Homo sapiens
  misc_feature: GYAE6OF01DWN0W.25.39.D06.1.454.CMB.1.raw
tcagactgtacagtcacgaccggtgctcgatttagtgacatctcgcagttcgtttgggggggggtcacaagaggcagcgctctcgggacgtctccaccatggcctgggctctgctgctcctcactctcctcactcaggacacagggtcctgggcccagtctggcctgactcaacctgcctccgtgtctgggtctccgtggacgtcaatcacctatttcctgcctacgtggaaccagcactgatgttgacttactttcgtaccttgttcttcgttacggtaacccaaaccgaaaccgaacccggaacaaaacggtcctaacctaaactactaatttaacgtttttagaacgtaaccgaagtaacggccggtcccttcggtttgggtttacttacggttacgtacttcgtacgtacggccgttaacctaaggttcgtacggacaaaccgtaccggtacccttaacccgtaaactaactccgttacgtacgggtccctaccgacgggtactacggaacggtacggtacggttctttaggtttactttcgtcgttcgttaggttcgtacttagtggttacggtacgtaacgtaaagttacgtttgggcgtccggttacgggacgggtaaccggaaccgttagtaccggttaccgttacgttaaacggtccgaaccggtacccgaacggtccgtacccggtccccttacgggtccctacgttccgttccgtccccgtcccttacccg

SEQ ID NO: 13020 - DNA, 608 bp, Homo sapiens
  misc_feature: GYAE6OF01DLIRS.25.39.D06.1.454.CMB.1.raw
  modified_base (311)..(311): a, c, t, g, unknown or other
  misc_feature (311)..(311): n is a, c, g, or t
  modified_base (380)..(380): a, c, t, g, unknown or other
  misc_feature (380)..(380): n is a, c, g, or t
  modified_base (431)..(431): a, c, t, g, unknown or other
  misc_feature (431)..(431): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctccgtggacggtcaatcacctatttcctgcactggaaccagcactgatggttgcttactttgtaccttgtctcttggtaaccaacaacaccggacaacgctacaactctataattttganacagtaagcgcctgttgggtttctagtcgattcactcgctcgaagtctggacaacacggctaccctaanactctactgggctcgagctagaagacggagtcttgtttattctgtcttgtntcttatcggtgtctaagtaaacttaagtttggtacgtcgtacgggacgggtacggtaacccgtaagttaccggtaccgttacgttaaacggttacgaaccggtaccgaacggtcctaccggtcccccccgttagggtccctaccgttcccgtaccttcccccgtaaccctttccccg

SEQ ID NO: 13021 - DNA, 697 bp, Homo sapiens
  misc_feature: GYAE6OF01EK0EM.25.39.D06.1.454.CMB.1.raw
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggactcctggacagtccgtcaccatctcctgcactggaaccagccgtgacagttggtgtcttaataactattcgtctcctcggtacccaaaccaaccacccacggaccaacggaccccccaaactccatactatttatgtatgtcagtcatccggcctcgtggtacgtttcgtggtcgtcttctcgtcggtctcctaacgtctcggctaaccgtccggtcccttccctcgaccctacgtccggtccggggtcctccggacggtccgtacgggacgggaaccggtacggtactttaacgtttatttagtttcgtacttatttaccgaattaaccgagtaaccgaacctaacccgaacgtacggttcgttcgggttacggtttccggggacgggtaaccggggtaaccgttaacgggtttaccggtaccccggttcccgttacggggtacccgtaacccgggacccccgtaaaggggtccccgttccccgggtcccccccgtttacccgggg

SEQ ID NO: 13022 - DNA, 725 bp, Homo sapiens
  misc_feature: GYAE6OF01C7EFI.25.39.D06.1.454.CMB.1.raw
  modified_base (143)..(143): a, c, t, g, unknown or other
  misc_feature (143)..(143): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
tcagactgtacagtcacgaccggtgctcgatttagtgacatctcgcagttcgtttggggggggtcacaagaggcagcgctctcgggacgtctccaccatggcctgggctctgctgctcctcactctcctcactcaggacacgnggtcctgggcccagtctggcctgactcaacctgcctccgtgtctgggtctccgtggacggtcaactcaacctntttccngcacgtacggaaccagcactgtgtgtcggtcttacgttcgtaccgttgtcctcgttacggtaaccaaccgaaaccgacccggaagtaaccggcctaaccaaacttactacttttaaattttcgaaccgtaccgtaaggtaacggtccggtacccgtttcggtttaaggggttccttaacggttcggtaactttcgaccgttcggtacctacgtaaacggtcgttaacgggacctaaccgaccgttacccctaacgtaacctaactccgtacgcggttccacggtacgacgttaacggaggtacccggagtttacgtttacggtttaatttcggcgtttccgttggttacgtcgttaagtggttacgtacgtaaagtaaacgttgttcggacggtcgcgggtacgtaaccggtacttacgttcgtacgttacgtaagtccgacggtccgtagccctcccggtacccgtgtccctacgttccgttccccgcccgtcgttaacccg

SEQ ID NO: 13023 - DNA, 592 bp, Homo sapiens
  misc_feature: GYAE6OF01EKRMT.25.39.D06.1.454.CMB.1.raw
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgtaccttgtctcttggtaccaacaacaccgacaagctccaaactctattaattttgagaccagtaagcggcccttcgtgggtttctagtcgattcactggctacgaagtcgtgacaacgacggcctaccctaaacactctcgtggctccgagctagaagacgaggtcttgtttattctgtcgttgttgcttagtggtgactaagaaactagtttggtgtcgtcgggcggaacgggacctaagttcggtaccgttacgttaacgtcgaacggtacccctaaagggtcccgtccgtccccccgttacggtacctaccgttccgttccgttcccccacccgttccc

SEQ ID NO: 13024 - DNA, 780 bp, Homo sapiens
  misc_feature: GYAE6OF01B5CRE.25.39.D06.1.454.CMB.1.raw
  modified_base (232)..(232): a, c, t, g, unknown or other
  misc_feature (232)..(232): n is a, c, g, or t
tcagactgtacagtcacgaccggtgctcgatttagtgacatctcgcagttcgtttgggggggggtcacaagaggcagcgctctcgggacgtctccaccatggcctgggctctgctgctcctcactcctcctcactcaggacacagggtcctgggcccagtctggcctgactcaacctgcctccgtgtctgggtctcctggacggtcaatcaccatttcctgcactggaaccngcactgatggttggcttactttcgaccttgtcttcttaggtaaccctaaccaaccgaacccggaacaaacggcctacccaaactctaattaactttttgaacgtacgaaggtaacggccggtaccccttcgttcgggggtttctaggttcgtactttcaacgtcggtccgtacctaacggtcgtaggaccctaaacgacccggtccctaaccccgtaaactaaacttccgtaccgttacgggcccttacccgacgggtaccgtaggaaccggtacggtacgggtccttttaggttttactttccgtagtccgtttcggttcgttacgttacgttcgggttacgggtacccgttaaggtaaaaaccgtttaaggttttacgggtacggtacccggttcggggaacggggtaaccgggtaacccgttaagtttaccgggtaaccgttacggttaacttaccggaacgttacccgaacgggtcccgtcccggtaccccccggttgggtaccctaccgtttccgttccccggttccccgtcccgttaccccg

SEQ ID NO: 13025 - DNA, 616 bp, Homo sapiens
  misc_feature: GYAE6OF01D5U3Y.25.39.D06.1.454.CMB.1.raw
  modified_base (299)..(299): a, c, t, g, unknown or other
  misc_feature (299)..(299): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcacctatttcctgcactggaaccagcactgatgttgctactttgaccttgtctctgtaccaacaacaccgacaaggctcaactcatatttganacagtagcgcctgtgggttctagtcgattcactggctcgaagtctggcaacacggcctaccctaacaatctcgtggctccaggctagaacgacgaggtcttagtttatttcgtgtcttgttgtctagttggtcgtactaagtaaaacgttagttttggtagtccggttcgggacggggtaaccgggacccttaagttaccggtaaccgtttacgtttaaacggtccgaacgtaccccgtaagggtcccttacccggtccccccgttacgggtcccttaaccgttcccgtttcccggttccccccgcccctttacccg

SEQ ID NO: 13026 - DNA, 791 bp, Homo sapiens
  misc_feature: GYAE6OF01CP60H.25.39.D06.1.454.CMB.1.raw
  modified_base (152)..(152): a, c, t, g, unknown or other
  misc_feature (152)..(152): n is a, c, g, or t
tcagactgtacagtcacgaccggtgctcgatttagtgacatctcgcagttcgtttggggggggtcacaagaggcagcgctctcgggacgtctccaccagtggcctgggctctgctgcctcctcactctcctcactcaggacacgagggtccncgggcccagtctcgccctgactcacgcctcgcctccgtgtcgtcgggtcctccgaggacagtcatccacctatctcctgcacgtacgaactccaccagtgtagttgttgcttactttcgaagttccgttacctttcgtcctaccgtaacggtaaacccaaacccaacccgtaacccccgaaacaaaacccccttaacccccgaaaatcctaaattaggttaaattttcgacgggaaccgggtaacctaaaccggaacggtccccggttaacccgttgggtttaacggggtttcctacgtccgttccggttaactttcccgtacgttcgggacccttaccggtaacgttcctaacgggactaaccggtacccggtccctaaccgtaacgaaccttacctcgttaccgttcggttacccacgtacggtcgtaaggacgggaacgtaggaccttaggttaactttaacgttcgttcgtcctttaccggtataaccgttgtaccgggtaccgactaagggttctacggttacgggttgggtccgttaaggacgggtaaggtaccgggtaaaacccgtcgggtaacccgtccgggtttaccgggtaccggtaccaacccggtcccggtaaccgggttccccccg

SEQ ID NO: 13027 - DNA, 511 bp, Homo sapiens
  misc_feature: GYAE6OF01A0Q8Z.25.39.D06.1.454.CMB.1.raw
  modified_base (307)..(307): a, c, t, g, unknown or other
  misc_feature (307)..(307): n is a, c, g, or t
  modified_base (333)..(333): a, c, t, g, unknown or other
  misc_feature (333)..(333): n is a, c, g, or t
  modified_base (400)..(400): a, c, t, g, unknown or other
  misc_feature (400)..(400): n is a, c, g, or t
  modified_base (420)..(420): a, c, t, g, unknown or other
  misc_feature (420)..(420): n is a, c, g, or t
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgctatttcatgaccttgtctcctggtaccaacaaccaccccgacaaacgcccccaaatcatgatttangaggcactaagcgcctgagggtttcngctcgcttctctcggctcaagtctggcaagtaccgctcctgacatctctgtctccaggctgagacgnggctgattagtactgcttcnctactatgtcgactagtacgcgtacgttggtcgttcggcgaggaggaccaaaggttcgacccgttcgtaggtaccacgcccgaaggtcccg

SEQ ID NO: 13028 - DNA, 742 bp, Homo sapiens
  misc_feature: GYAE6OF01CCKOG.25.39.D06.1.454.CMB.1.raw
  modified_base (391)..(391): a, c, t, g, unknown or other
  misc_feature (391)..(391): n is a, c, g, or t
tcagactgtacagtcacgaccggtgctcgatttagtgacatctcgcagttcgtttggggggggtcacaagaggcagcgctctcgggacgtctccaccatggcctgggctctgctgctcctcactctcctcactcaggacacgagggtcctgggcccagtctcgccctgacctcacgcctcgcctccgtgtcgtgggtcctccgtggacagtcgatccacctatctcctgcactggaactcacactgtagtgttcgacttatttcatcgtacctttcgtacctccgtaacggtacccaaaccaaaccaaccccgaacaaacccgaccccctaaatcaactagtaatttacgaggacggtactacgtaacggcccgtccgtggtacgggttcncgtactcgtcttcgtcgtcgcctacgacgtcgtacgactaacgtccgtccctccgagtactacttccgtcgtcggtacctccggaaggtcgtacgggaacggtacgtcggtacgttacgttaacgtttacgttacccgttcgttaccgtttcccgtaacgtaccgttaggttccggtaccggtacgttacggttaacccggtggtttaccggggttcgggttacgggttacccggggaacggtaaaccggggaaacgggttaacccgtaaacgggtttcccgggtacccggttccggggtaaacccggggtcccgtaaaccccgggacccgggttcccggtaccccccggg

SEQ ID NO: 13029 - DNA, 755 bp, Homo sapiens
  misc_feature: GYAE6OF01EVJYQ.25.39.D06.1.454.CMB.1.raw
  modified_base (304)..(304): a, c, t, g, unknown or other
  misc_feature (304)..(304): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacgtcaatcactatttcctgcactggaaccagcactgatgttgctaggttattactttgtctctgtaccaacaacaccagacaacgacccctaaattatctatttangacggaccactaacgccgcctcgaggtactttactaatccgtcttctcgtcggtccttaccgaagttcgtggactacgtccgaacccggtccctacccgtacggtaacctaacgttccgtacggttcgggacccttacccggtaagggtaccgttagggaacgggtaaccggtaacgggtacttaacggttaactttaacgtttaccgtacggtaacctttaaccgttcgtaaacgttacgtaacgggaacctaacgtaacttaaccaaaccgttaaaccgttccccgtttaccgttaccgggtaaccccggttacgggggtaaccccgtacggggttaccccgtaacccgggtttccccggttacgggggtaacccctaacccgggaacccccggtaaacccgggacccccgtaaaacccccgttacgttccggtaacccttaaccccgg

SEQ ID NO: 13030 - DNA, 682 bp, Homo sapiens
  misc_feature: GYAE6OF01A35CV.25.39.D06.1.454.CMB.1.raw
  modified_base (230)..(230): a, c, t, g, unknown or other
  misc_feature (230)..(230): n is a, c, g, or t
  modified_base (470)..(470): a, c, t, g, unknown or other
  misc_feature (470)..(470): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctcgtgtctgggtctccgtggacggtcaatcacctatttcctgcactggaaccngcactgatgttgcttacttcgtaccttgtctcttacggtaaccaactaacaccggaacaaaggcctaccaactctattaatttgacgaccgaagtaacgccgtacctgtgggtttactagtcgtacttcacgtcggctaccgaagtctggacgaacgtaccggccctacccgtaaactactccgtacgtcgggtcctaccgacggacgtagaacgtaacggtagtacttgtttactttcngtcgttgttgtcgttatcggtagtacgtaagtaaaaccgttagtttggcgtaccggtacggggaccggtaacgggtaacctaggtttaaccgtaccggtttaccgttaaaacgggttcccaaccggtaacccggtaacgggtccctaccccggtacccccggttcggttaccctacccgttccgtttcccgttcccccggtcccttaccccg

SEQ ID NO: 13031 - DNA, 658 bp, Homo sapiens
  misc_feature: GYAE6OF01C4AK5.25.39.D06.1.454.CMB.1.raw
  modified_base (201)..(201): a, c, t, g, unknown or other
  misc_feature (201)..(201): n is a, c, g, or t
  modified_base (212)..(212): a, c, t, g, unknown or other
  misc_feature (212)..(212): n is a, c, g, or t
  modified_base (492)..(492): a, c, t, g, unknown or other
  misc_feature (492)..(492): n is a, c, g, or t
  modified_base (547)..(547): a, c, t, g, unknown or other
  misc_feature (547)..(547): n is a, c, g, or t
tcagactgtacagtcacgaccggtgctcgatttagtgacatctcgcagttctttgggggggggtcacaagaggcagcgctctcgggacgtctccaccatggcctgggctctgctgcctcctcactctcctcactcaggacacagggtcctgggcccagtctgccctgactcagcctgcctccgtgtcgtggtctctggacngtcgatcaccntctcctgcataggaactccacactgtatgttgctatttcatcgtacctttgtcctccgtacggtaaccaacctaaccccaaccccggaaacaaaaccccgtaccccctaaaactcaattcgttaatttagcgggaacggacctaaacgtaccggacccggtaccccgtcggttacggggtttctcggtccttccgtaccgtttctccgtacggtccttacccgtagtcgtacggactaaccggtccgtccctcctagacctacgttctccgtcggtaccncgaggtcgtaggaaggtaccgtaggacttagttaattgttactgttcccttcaancctacgtcgtacggctagtcgtacgttaggttcgggttagtccgggaacgtaggtaacccggtacgtaacggtccgaccggttcgcgggtacacccggtcgacgtccccgg

SEQ ID NO: 13032 - DNA, 779 bp, Homo sapiens
  misc_feature: GYAE6OF01CYL6L.25.39.D06.1.454.CMB.1.raw
tcagactgtacagtcacgaccggtgctcgatttagtgacatctcgcagttctttggggagctctgggagaggagccccagccgtgagattcccaggagtctccacttggtgatcagcactgaacacagaccaccaaccatggtagttgggcttaactgttcttttcttgttgtcttagtttaaaggtgtacaagtgtgaggtgactaacgtgggtggaggtcggtggggggagtcgtttggtacgacggccgacgggcccggtccctagacctactcctcctgccaacgtcgtccgttcccggacttccgtaccgttttgggagacgtctagtgtaccttaagtccggaccgttcggggtacccgaccgtacggtccgttaccgggaaggggtaacgggttcggtaggggtacggttcggtacgggttttcggttactaaagttaggaacggacggtaacgtccgttaggtacggggtacgggaacaaacgtacgtaaacgtcccggacggttaccgtacggtaaacgggtaaacggcgtaaaggtacgttaccgaaccgccgttaacctaaacgaaaggtagtaacgttaacggttaaccttaaaccgaaaacgtcctaacgttacccgtacctttaacgtccgtacgacctaagacgtaggacgccgacgaccgtaaggaacgaccggtaacggtacggaccgttaccggacggttaccgtttagtttacctttacggtttactttaccgtttaagtacgttcggttaaggtaaagg

SEQ ID NO: 13033 - DNA, 583 bp, Homo sapiens
  misc_feature: GYAE6OF01ELWRZ.25.39.D06.1.454.CMB.1.raw
  modified_base (242)..(242): a, c, t, g, unknown or other
  misc_feature (242)..(242): n is a, c, g, or t
  modified_base (291)..(291): a, c, t, g, unknown or other
  misc_feature (291)..(291): n is a, c, g, or t
  modified_base (299)..(299): a, c, t, g, unknown or other
  misc_feature (299)..(299): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
tcagactgtacagtcacgaccggtgctcgatttagtgacatctcgcagtttcgtttggggggggtcacaagaggcagcgctctcgggacgtctccaccatggcctgggctctgctgctcctcactctcctcactcaggacacagggtcctgggcccagtctggcctgactcaacctgcctcgtgtctgggtctcctggacggtcaatcacctatttcctgcacgtggactcagcatgatgtnctaggttatacttgtactccgtgtaccaacacaccagcaacgcccaatntcatttangagccactaagcgacctcagtagttctaatcgtcttctctaggctccgaagtcgtgtcagcacggcctcctgactatctcgtacggctacgngtcgngaggacgaggtcctagtacttattacgagtccttaagtctaagtagtacggtactaactataaccaacgtaaacctccccgttagtacccggtacgtaccggggtaccgtacgggttacccaacccggttccgtaccgggtacctaccgacccgtaaccggacccctaaccctaacgtcggtaaccc

SEQ ID NO: 13034 - DNA, 744 bp, Homo sapiens
  misc_feature: GYAE6OF01BIJ4S.25.39.D06.1.454.CMB.1.raw
  modified_base (248)..(248): a, c, t, g, unknown or other
  misc_feature (248)..(248): n is a, c, g, or t
tcagactgtacagtcacgaccggtgctcgatttagtgacatctcgcagttctttgggggggggtctcaggaggcagcgctctcgggacgtctccaccatggcctgggctctgctgttcctcaccctctcactcagggcacagggtcctgggcccagtctgccctgactcagcctgcctcgtgtctgggactccgtggacaggtcgtcaccatctctgctactaggaaccagccgtagactagttggtntacttataactagtcgtcctccgtcggtaccctaaacaacctacccgaaggaccaaccggacccccaaactcctaactactatttagtagtatcgtactacgtctacgtccgtcctgtcggtacgttcgtcgtctcttcgtcgtgtcctacgtacgtcgtacgacctaaccgtccggcccttacccgtcgtacctacgttacccggtccgggtcctaccggagggtccgtaggggaaccggtaccggtacggttacctttaacgtttaacgtttactcgtacctttacgtttacaacgttaaccaagtaaaccgtaccctaacctaacggttacgttcggttacgggttacggttaccgggaaccgggtaacggtaaccccggttaaggttacccggttaacccggtcccggtttacccgggacccgtaaccggaacccccggttaacggcccccgttaacccggtacccccggttaccggtccctttaaccccgg

SEQ ID NO: 13035 - DNA, 706 bp, Homo sapiens
  misc_feature: GYAE6OF01BZAVY.25.39.D06.1.454.CMB.1.raw
tcagactgtacagtcacgaccggtgctcgatttagtgacatctcgcagttctttgggggagctacaacaggcaggcaggggcagcaagatggtgttgcagacccaggtcttcatttctctgttgctctggatctcgtggtcggtccccggggacatcatattgaaccagtctccagacgtccctgtctgtgtctcgtgggcgggacggccaccatacgaactgcaggtccagcagagtgtttcgacgtactccgccaaagtacggaacttcgttaggttggtatcagcaggccggcaggacagtcctactaagtgactgtttacgcggccctacgaacccggcaccgtcccggcgtccccgtggacccgtacttccgaacgttcgggccgaacgggtcgggttcgtacgggggacctaaggttactttccgaaccttccctcccgtaaccctacgtaaccgttaaaccctcggaacccctaaaccgtaggaaacggtacgttgggacccggtacgtttaacgtttttaagttaacgtttcggttaacaaccgtaaccgtaaattaacccgttaactaacccctaaccgttacccgtaacttcccgttaacccgttcccgggtaccgtagggggtaaacccagggtacggtacgaagtaacgtacccgaaaacggtacgtggtacgaccgtagcccacgtacttacg

SEQ ID NO: 13036 - DNA, 698 bp, Homo sapiens
  misc_feature: GYAE6OF01BQ32W.25.39.D06.1.454.CMB.1.raw
  modified_base (266)..(266): a, c, t, g, unknown or other
  misc_feature (266)..(266): n is a, c, g, or t
  modified_base (310)..(310): a, c, t, g, unknown or other
  misc_feature (310)..(310): n is a, c, g, or t
tcagactgtacagtcacgaccggtgctcgatttagtgacatctcgcagttctttggggagctctgggagaggagccccagccgtgagacttcccaggagtctccacttggtgtatcagcactgaacacagaccaccaaccatggagtttgggctttaactgtcttttccttgttgcttagttttaaaacggtgtcctaatgtgaggtgcaactggtggagtcgtgggggaggcttggtacagaccgagggcccgtcccctagaccncctctcctgaccacagtccgttaccggacctccgtacgtttggnacgctagtgtctacgtcgtccggtacgggtcccgccgacggtcctaccgggaacggggtaacggtccgtgggaggttcggtcggtttcgggttactagttaaggacggacgaacgtccgtaggtcgggtacgggaacctaacgacgtaacgtaccgccggtacgttacgtaaacgggtaaacgcgtaagtacttaccggaactcccttagacgaaagtatacgtacgtaactaaaccgaaactcaacgtccacttgccgtacgacctacgtagcggaacgacgtaccggacgtaagaaccggtagaacccggtaaggtccctacggacggttccgttaagtttacctttacgttacgtttactttaacgtacttgtaaccgggttaag

SEQ ID NO: 13037 - DNA, 804 bp, Homo sapiens
  misc_feature: GYAE6OF01BT0T9.25.39.D06.1.454.CMB.1.raw
tcagactgtacagtcacgaccggtgctcgatttagtgacatctcgcagttctttggggagctctgggagaggagccccagccgtgagattcccaggagtctccacttggtgatcagcactgaacacagaccaccaaccatggagtttgggcttaactgtcttttcctgttgctagttttaaagtgtccaatgtgaggtgcaacgtgggtggagtcgtgggggagtcgttaggtacacgccgacgggtcccggtccccgtggaacctaccttccgtcctcggccacgtacgtccgttacccggtacctccgttaccgtttggtagacgtacgtagtcgtacgttacgtccggtacccggtccgggtacccgaccggtacggtcccgtacgggaacggggtacgggttcggtagggtacggttcggttacggtttacgggttacgtaagttaacggaacggtacggtaacggtaccgttaagggtcggggtacgggaaccaaacgtaacgtaacggtcccggtaccggtacggttaacggtaacgggtaaaccggtcgtaacgtacgttaccgaaccgtacccgtaacgtaacgaaaggtaacgtacgtaacgtaaaccgtaaccgaaacgtacctacgttaccgtaccttacgtaccgtacgacctaacgtacgtacgacgtaccgtaccggtacgtaagggacggacggtaccggtaaccgtaccgttaccggaccggttccgttaacgtttaaccgttacgtttacgttttaacctttaacgttcgttacggttaagggtacg

SEQ ID NO: 13038 - DNA, 790 bp, Homo sapiens
  misc_feature: GYAE6OF01CVAJF.25.39.D06.1.454.CMB.1.raw
  modified_base (278)..(278): a, c, t, g, unknown or other
  misc_feature (278)..(278): n is a, c, g, or t
tcagactgtacagtcacgaccggtgctcgatttagtgacatctcgcagtttcgtttggggggggtcacaagaggcagcgctcgtcgggacgtctccaccagtggccgtgggctctgctgcctcctcactctcctcactcgaggacacgtacgggtccgtcgggccctagtcctcggccctagacctcacgtcctcgtcctcgtgtcgtcggtcctcgtgacagtcgactcacctactcctcctgactacgtacgactaccacctagtgtagttcgttntacttatttcgacttcgtcctttcgtcctacgtaacgaaacccaaccgaaacccgaaccccgaaacaaaccccgtaccccaaatcgtaattacgttattacggacgaacggtacctaacggaccggtcccggtaaccgtttagggttccggtttcaccgtaccgttcggttccttcgtcggtacccacgtttaacgtacgtgtacggtacctaaccgtacccggtacctacggaattaaccgtccgtttcgtcggtccgttaccgacgaaccggtggtaaggacggacgttagtactttaacgttaacgtttacttaaccgtcggttaacctaacgtacgtaacgttcggaaccaacttacttaaccgttaaaccggtaacccctttacggttccccggttacggtaacccggggtacccgggttaaccgtaccgggtaacgttccccgggtaacttccggggtaaaccctacccgggacccggtaacctaacccccggaaccccttaccgg

SEQ ID NO: 13039 - DNA, 660 bp, Homo sapiens
  misc_feature: GYAE6OF01AUM6B.25.39.D06.1.454.CMB.1.raw
  modified_base (360)..(360): a, c, t, g, unknown or other
  misc_feature (360)..(360): n is a, c, g, or t
tcagactgtacagtcacgaccggtgctcgatttagtgacatctcgcagttctttgggggggtcacaagaggcagcgctctcgggacgtcgtccaccatggcctgggctctgctgctcctcactctctcactcaggacacagggtcctgggcccagtctgccctgactcagcctgcctccgtgtcgtgggtctcctggacagtcgatccaccatcctcctgccacgtggaaactccaccactgattgttgctattttcatgtaccttgtcctccgtggtaccaaccaacaccccgacaaaccgccccaaactcatgtatttagtggacggcacgtaacgccggccctcgtacggggtttcncgctcgtcttctcgtggccttaccgacgtcgtaggacctaacgtacccggtccctacccgtacgaacctaacgtcgttacgttcggttccctaccgacgggtccgtgggaacgggacgacgggtctagttaactttaacgtttaccgtcgttccttcgtaccaactacgttccggtaccgatacggtacgtccgtacggtttcggggtacgttacgggacgacgggtaaccgggtacctaaacgggtccgtacccggttaccggttacgggtaccaccggtacccggaacggttccccgg

SEQ ID NO: 13040 - DNA, 715 bp, Homo sapiens
  misc_feature: GYAE6OF01BIDJ6.25.39.D06.1.454.CMB.1.raw
  modified_base (229)..(229): a, c, t, g, unknown or other
  misc_feature (229)..(229): n is a, c, g, or t
  modified_base (562)..(562): a, c, t, g, unknown or other
  misc_feature (562)..(562): n is a, c, g, or t
  modified_base (604)..(604): a, c, t, g, unknown or other
  misc_feature (604)..(604): n is a, c, g, or t
tcagactgtacagtcacgaccggtgctcgatttagtgacatctcgcagttcgtttgggggggggtcacaagaggcagcgctctcgggacgtctccaccatggcctgggctctgctgctcctcactcctcctcactcagacacgacgggtcctcgggcccagtctcggctagactacaacctgcctcgtcgtcgtcgggtctcgtgggacggtcaatcacctactttccncgcaactacggaaccagcgactgagttggttcggtacttacgttcgtaccgtttcgttccttcgttacgtaaaccgaacctaaccgtaaacccgggaacgaaacggtacctaaccgtaaacttactaacgtttaagttttacgacgtaaccgtaacgtaacggccggtccttaggttacgggtttactacggttctaacttcgacgttcgaccgtacacgtacgtacggactaaaccgacgtaccctacctaacgtacttcgacgtcggactacggtcgactaggaacggtaacgtcggtactttagtttaacgttcgtcgttgttacggttntacgtaggttccgtagtaacgtaagtaacgttagttcggtcncggttacgggacggtacgtaaccgtagtaccgtaacgttactacggacgtaccgacgtacggtccacccgtccggacttacgtcccttacgttcccgtccccgtccctacg

SEQ ID NO: 13041 - DNA, 728 bp, Homo sapiens
  misc_feature: GYAE6OF01E388T.25.39.D06.1.454.CMB.1.raw
  modified_base (264)..(264): a, c, t, g, unknown or other
  misc_feature (264)..(264): n is a, c, g, or t
  modified_base (417)..(417): a, c, t, g, unknown or other
  misc_feature (417)..(417): n is a, c, g, or t
tcagactgtacagtcacgaccggtgctcgatttagtgacatctcgcagttcgtttggggggggtcacaagaggcagcgctctcgggacgtctccaccatggcctgggctctgctgctcctcactctcctcactcaggacacgagggtccgtgggccctagtctcgccctagactcacgcctcgccttcgtgtcgtcgggtctccgtgactagtcgatcaccatctcctcgctaacgtgaactccacctacgtgtagttcgttancttattctacgttccgtaccgtttcgtccttaccgtacggtaaaccccaaaccaaaccccgtaaccccgaaaccgaaaccctaccccaactacagttataagttacggtacggacgtacacggtaaccgtcccggtccgtaggttacggttcncgtcctcgtcgttctcgtcgtacctcgtacgtcgacgtaccgtaaccgtcccgtaccctacgtacgtaacttaccgtctcggttccgtaccgacggtacggtacggtacgggaaggtaccgacggtacttagttaacgttactaccgtcttccgttaccacggtaacttgggtccggtaacgtcggttacgtacgtacgttccgggtttggacccggttacggacgggtaaacgggtaaccggtaaccgaccggtaccggttaacccggtcggttaaccggaaccgggtctaacccgggtccgtccccggg

SEQ ID NO: 13042 - DNA, 826 bp, Homo sapiens
  misc_feature: GYAE6OF01BLKKN.25.39.D06.1.454.CMB.1.raw
  modified_base (141)..(141): a, c, t, g, unknown or other
  misc_feature (141)..(141): n is a, c, g, or t
tcagactgtacagtcacgaccggtgctcgatttagtgacatctcgcagttcgtttgggggggtcacaagaggcagcgctctcgggacgtctccaccatggcctgggctctgctgctcctcactctcctcactcaggacacngggtcctgggcccagtctacgccctgacctcgagcctgcctcgtgtcgtggtcctcgtggacagtcgatcaccatcctcctgccacgtagaactccaacctactgagttcgttcgtctatttacgactcgtacctttgtccttacccgtacggtaaacccaaaccaaccccgaaacccccgaaccgaaacccgaacccccctaaataccgtaattacgtaacgttttagacggaacgggtacccaaacggttaacgccccggtacccgttggttacggggttttccacgtccgtacgtcctttcgtcctagtacctaccgtacgtacgtcgaaccgtaaccggttcccgtacccgtaccgtactaacgtacttccgtcgttacgtacctacccggtaggtacccgtagggtaaccggtacgggtacggttaccgttaacgtttacgttttaacgttacccgggttctttaccggtttacctaacccggttacgtaaaccgggtttccggtaaaccgtcgtaaaccgggttacggttaaccgttcggggtttcggggtttaccggttacccggggaaacgggttaaaccgggtaacccgggggaaaccgtttaaccgggtccgggtaacccggtttcggtcccgggttaaaacccgccggtaaacccgggtcccggttccccccgg

SEQ ID NO: 13043 - DNA, 504 bp, Homo sapiens
  misc_feature: GYAE6OF02ISDUX.25.39.D06.1.454.CMB.1.raw
  modified_base (334)..(334): a, c, t, g, unknown or other
  misc_feature (334)..(334): n is a, c, g, or t
  modified_base (386)..(386): a, c, t, g, unknown or other
  misc_feature (386)..(386): n is a, c, g, or t
  modified_base (426)..(426): a, c, t, g, unknown or other
  misc_feature (426)..(426): n is a, c, g, or t
  modified_base (438)..(438): a, c, t, g, unknown or other
  misc_feature (438)..(438): n is a, c, g, or t
  modified_base (450)..(450): a, c, t, g, unknown or other
  misc_feature (450)..(450): n is a, c, g, or t
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgcatttcatgaccttgtctcctgtaccaacaacacccgacaaacgcccccaaactcatgatttatgaggcactaagcggccctcgaggggtttcngctcgcttctctggctcaagtctggcatacggcctcctgacatctctggtcncagctgaggacgaggctagatttatactgtcttctcactntcgtcgcagtanctacgttgggtnttcggcaggagggaaccaaggtcgaccgttcgtgggtacacgacccgaggtccg

SEQ ID NO: 13044 - DNA, 523 bp, Homo sapiens
  misc_feature: GYAE6OF02JSBOK.25.39.D06.1.454.CMB.1.raw
  modified_base (476)..(476): a, c, t, g, unknown or other
  misc_feature (476)..(476): n is a, c, g, or t
tcagactgtacagtcacgaccggtgctcgatttagtgacatctcgcagttctttgggggggtcacaagaggcagcgctctcgggacgtctccatcatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccggacaaaggctccaaactcataattttgagaccagtaagcggccctctggggtttctagtcgattcactggctccaagtctggcaacacggcctccctaacaatctctgggctccaggctgaagacgaggctgttattctgctgttgctatgtggctagaaacatttggtgcttcggcggaggacccaattgaccgttnttaagtcagcccaaggcctgcccctcggtccactctcgtcccgtccc

SEQ ID NO: 13045 - DNA, 517 bp, Homo sapiens
  misc_feature: GYAE6OF02IJ4IJ.25.39.D06.1.454.CMB.1.raw
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggactcagcactgatgttgcaggttattactttgtctcctggtaccaacaacacccaggcaaagcccccaaacttatcatttatgaggccactaagcggccctcaggagtttctaatcgcttctctggctccaagtctggcagcacggcctccctgacaatctctgggctccaggctgaggacgaggctgattattactgctactcacatgtcggctagtacgctactttgggtgttcggcaggagggaaccaaaggtcgacccgtctgggtcaggcccaaggcctcgcccctcgg

SEQ ID NO: 13046 - DNA, 507 bp, Homo sapiens
  misc_feature: GYAE6OF02HA486.25.39.D06.1.454.CMB.1.raw
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttcctgcactggactcagcactgatgttgcaggttattactttgtctcctggtaccaacaacacccaggcaaacgcccccaaacttatcatttatgagccactaagcggccctcaggtagtttctaatcgcttctctggctccaagtctgcagcacgcctcctgacaatctctggctcgaggctgaggacgaggctgattattactgtcttctcactatgtcgcagtagctacgttgggtgttcggcgaggacggaccaaggtcgaccgtcgtgggtcacggcccgaggctcccgg

SEQ ID NO: 13047 - DNA, 663 bp, Homo sapiens
  misc_feature: GYAE6OF02HJ1M5.25.39.D06.1.454.CMB.1.raw
  modified_base (244)..(244): a, c, t, g, unknown or other
  misc_feature (244)..(244): n is a, c, g, or t
  modified_base (305)..(305): a, c, t, g, unknown or other
  misc_feature (305)..(305): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
tcagactgtacagtcacgaccggtgctcgatttagtgacatctcgcagttctttgggggggtcacaagaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagccgtgacagttggtncttataactatgtctcctggtcccaacaacacccaggcaacggccccaaatcatcatttangatgtcagtcatcggcctntggatttcnggtcgcttctctggctcgaagtcctggcaacgtccggcctcccgtagacctatccgtcgggtcctccgaggtctaggacggtaccgagggtccttaacgtttacgttacttcggacttacgttttaccaacgttaccgaacggtacgtaacctaaccgtaacgtacggttaccgttagggttacggtttaccgggacgggtaacgggtaacccttaagggtttccggtaaccccggtttcccgttaaccgggttacccgtaacgggtaccccgtaaacgggtccccgtttacccgggtacccccccgtttagggtaccccgttaacccgg

SEQ ID NO: 13048 - DNA, 521 bp, Homo sapiens
  misc_feature: GYAE6OF02GJ0BA.25.39.D06.1.454.CMB.1.raw
  modified_base (216)..(216): a, c, t, g, unknown or other
  misc_feature (216)..(216): n is a, c, g, or t
  modified_base (377)..(377): a, c, t, g, unknown or other
  misc_feature (377)..(377): n is a, c, g, or t
  modified_base (429)..(429): a, c, t, g, unknown or other
  misc_feature (429)..(429): n is a, c, g, or t
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccgtgactcagcctgcctccgtgtctgggtctcctggacagtcgatcaccatttccngcactggactcagcactgatgttgcaggttattactttgtctcctggtaccaacaacacccaggcaaagcccccaaacttatcatttatgaggccactaagccggccctcaggagtttcaaatcgctttctctggctccaagtctggcagcacggcctccngacaatctctggctccaggctggacggacgaggctgattattactgcttacnctatactggaacacatcaacaaatcccgtattcggacctgggaccagggtccaccgttccgtgggtccacgcccaacggcccaacccctacg

SEQ ID NO: 13049 - DNA, 504 bp, Homo sapiens
  misc_feature: GYAE6OF02IYB42.25.39.D06.1.454.CMB.1.raw
  modified_base (307)..(307): a, c, t, g, unknown or other
  misc_feature (307)..(307): n is a, c, g, or t
  modified_base (333)..(333): a, c, t, g, unknown or other
  misc_feature (333)..(333): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgtcgcatttcatgaccttgtctcctggtaccaacaacaccccgacaaacgcccccaaactcatgatttangagggcactaagcgcctcagggttcngctcgcttctctggctcaagtctggcaatacggcctccctgacaatctctgtctcagctgaggacgaggctgattatactgtcttctcactatcgtcgctagtagctagttgggtcgttcggctaggacgggaacaaggtcgaccgtcgtgggtcacggcccgaggtcccg

SEQ ID NO: 13050 - DNA, 562 bp, Homo sapiens
  misc_feature: GYAE6OF02IT4JJ.25.39.D06.1.454.CMB.1.raw
  modified_base (217)..(217): a, c, t, g, unknown or other
  misc_feature (217)..(217): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttccngcactggaaccagcactgatgttggctactttgaccttgtctcttggtaccaacaacacccggacaaaggctccaaactcataattttgagacagtaagcgcctcgtgggtttctagtcgattcactgctccaagtctgcacacgcctcctaacatctctggctccgaggctagaacgacgagtcttgtttatttctgtcttgttgcttatgtcggctagaaacttagtttggtgcgtcgggacggtacgggaccctaagtcgtaccgttcgttaacgtacgacgacccgaggtcctaccggtcccctcggtcctaccgtccgttccgttccccgcccttacccg

SEQ ID NO: 13051 - DNA, 658 bp, Homo sapiens
  misc_feature: GYAE6OF02J2P4M.25.39.D06.1.454.CMB.1.raw
  modified_base (239)..(239): a, c, t, g, unknown or other
  misc_feature (239)..(239): n is a, c, g, or t
  modified_base (297)..(297): a, c, t, g, unknown or other
  misc_feature (297)..(297): n is a, c, g, or t
  modified_base (306)..(306): a, c, t, g, unknown or other
  misc_feature (306)..(306): n is a, c, g, or t
tcagactgtacagtcacgaccggtgctcgatttagtgacatctcgcagttctttggggggtcacaagaggcagcgctctcgggacgtctccaccatggcctggctctgctgctcctcactctcctcactcaggacacagggtcctgggcccagtctgccctgactcagcctgcctccgtgtctgggtcctcctggacagtcgatcacctatctcctgcactggaatcacactgatgttnctattcatcgacttgtctacctgtaccaactaacacccgacaacgccccaaacttacnctaatttancgacggccaacgtaacgccggaccctacgaggtactttcaatccgcttcgtactcggtctaccgtaagtcctgggtaccacgtccgaaccggtcccttccgtacgaacctaacttccgtacgttcggcctaccgtaggctacggaacggaccgtacggccttagggtacttaacgttaccgtacgtccttaaccgtagtaacttacggtacgtaaaccgactaacttccaaacgtaacccttccgttaccgtttacgggaaccccgttacgggaaccctaacggggttcccctaaccggttcgttaccggggacctaacccgggtccctaaccgggtaccccctaaaccccg

SEQ ID NO: 13052 - DNA, 616 bp, Homo sapiens
  misc_feature: GYAE6OF02G4K5W.25.39.D06.1.454.CMB.1.raw
tcagactgtacagtcacgaccggtgctcgatttagtgacatctcgcagttctttggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtctgggggaggcttggtacagccaggccggtccctgacactctcctgcacagcttccggactcacctttggtgagcatgctatgaccgtgggtccgccaggctccgagggaggtctgggagtgggtcttggggttcagttagaagcgaagcctagtgggtggggacaacgacaagtacggccgtcgtactaggtaaacggcaaggtattcacgtcctctacgaaagagactagtaacttaaccgaaagctaacgtccgtaccttatccgttagacctaacagtagaacgccgtaacgcccgttagaacgggacgaccgggtaaggaccctaccggaacggtcccggtttagttaactttacgttggttttaccctttaagtttaccctttacgtaggtaacgg

SEQ ID NO: 13053 - DNA, 575 bp, Homo sapiens
  misc_feature: GYAE6OF02HJXEV.25.39.D06.1.454.CMB.1.raw
  modified_base (281)..(281): a, c, t, g, unknown or other
  misc_feature (281)..(281): n is a, c, g, or t
  modified_base (426)..(426): a, c, t, g, unknown or other
  misc_feature (426)..(426): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggcttactttgaccttgtctcttggtaccaacaacaccganaagctacaaactcatattttgagacagtaagcgcctgtgggtttctagtcgattcactggctcaagtctaggcaacacggcctacctaaacaatctctgggtctccgaggctagaagacgaggtcttgtttattctgtcttgttncttagtgtgctagaaactagtttggtagcgttcggacggtacgggacctaagttcgaccgttacgttaagtccgtaacgacccgtaaggtcctaccggtcccccgtacggttccaccgtttcccgtccggttcccccgcccttaccccg

SEQ ID NO: 13054 - DNA, 581 bp, Homo sapiens
  misc_feature: GYAE6OF02GVCSH.25.39.D06.1.454.CMB.1.raw
  modified_base (282)..(282): a, c, t, g, unknown or other
  misc_feature (282)..(282): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (455)..(455): a, c, t, g, unknown or other
  misc_feature (455)..(455): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgttggctactttgaccttgtctcttggtaccaacaacacccgganaaacggctaccaaactcattaatttttgagaccagtaacgcggtccctcgttggggtttctagtcgattcactggctccaagtctggcaacacggcctcctaacatctctggctcagctgaagacgagctgtttattcngtctgttncttatgtggctagaaaatagtttggntcgttcgggacggacgggtaccctaagttcgacccgttcgttaacgtccgacggtacccgaacggtcctacccgccccgttacgggccttacccttccgttccggttccccccgtcccgttacccg

SEQ ID NO: 13055 - DNA, 595 bp, Homo sapiens
  misc_feature: GYAE6OF02JYXT4.25.39.D06.1.454.CMB.1.raw
  modified_base (235)..(235): a, c, t, g, unknown or other
  misc_feature (235)..(235): n is a, c, g, or t
  modified_base (277)..(277): a, c, t, g, unknown or other
  misc_feature (277)..(277): n is a, c, g, or t
  modified_base (355)..(355): a, c, t, g, unknown or other
  misc_feature (355)..(355): n is a, c, g, or t
  modified_base (527)..(527): a, c, t, g, unknown or other
  misc_feature (527)..(527): n is a, c, g, or t
  modified_base (555)..(555): a, c, t, g, unknown or other
  misc_feature (555)..(555): n is a, c, g, or t
  modified_base (562)..(562): a, c, t, g, unknown or other
  misc_feature (562)..(562): n is a, c, g, or t
  modified_base (578)..(578): a, c, t, g, unknown or other
  misc_feature (578)..(578): n is a, c, g, or t
tcagactgtacagtcacgaccggtgctcgatttagtgacatctcgcagttctttggggggtcgtacgaagaggcgagcgctctcgggacgtctccaccatggcctggctctgctgctcctcactctcctcactcaggacacagggtcctgggcccagtctgccctgacctcagcctgcctccgtgtctgggtctcctggacagtcgatcaccatctcctgcactggaatcacacngactgttgctatttcatgaccttgtctcctggtacacaaccncccgaacaaacgccccaaactcatcgaatttatgaggcattaacgccggtcctcaggggtttctgcttcggctttccncttcggaccttacccgaagttcgtaggtcaaacgtttaccggccctttaccctcggtaacctaaacgttccgtccttacgggttcctacccctagggtccgttagacggttaacggtacgtacgttacggtattacgttaactggttacctctactacgtattcggtaccgntacgttagctacggttggttcgttacgngtaacgngggtaccaagtgaccncgtggtcacgccgagtc

SEQ ID NO: 13056 - DNA, 741 bp, Homo sapiens
  misc_feature: GYAE6OF02FQATV.25.39.D06.1.454.CMB.1.raw
  modified_base (316)..(316): a, c, t, g, unknown or other
  misc_feature (316)..(316): n is a, c, g, or t
tcagactgtacagtcacgaccggtgctcgatttagtgacatctcgcgagttctttgggggggtcacaagaggcagcgctctcgggacgtctccaccgactggcctgggctctggctgctcctcactctcctcactcaggacacagggtcctgggcccagtctgccctgactcacgcctgcctccgtgtctgggtctcctggacagtcgatcaccatctcctgcactggaatcaccactgatcgttgctatttcatgaaccttggtacctccctaggtaccacaacacccgacaaacgccccaactcatgatttagnggacggacacgtaagccggcctcggaggggtttactgtccttcggtccttcgtcgtggtcctaccgtaacgttcctacgggtacctaagtaccccggcccttacccgtaggtaaccctaagttccttacgttacgggttcccttaaccgtacgggccttacggtaacgggtaaccgaggggtccttaacggtaacgtttaacttacgttcgttccgtttaccgtaccgttaaccgtacgtttacgggtacccggtacggtaaacggttaacgacccgttaaacgggttttcggggtacggtttaccgggaaccgtaacgggggttaaacccgggaacccgttaaaaggggttcccgggtaaccccggttttccgggttaccgggtaaccccgtacccgggttaccccggtaagggttccccccgg

SEQ ID NO: 13057 - DNA, 674 bp, Homo sapiens
  misc_feature: GYAE6OF02JNEZD.25.39.D06.1.454.CMB.1.raw
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacaggtcctgggcccagtctgccgtgactcagcctgcctccgtgtctgggtctccgtggacagtcgatcacctatttcctgcactgactcagcactgatgtgctaggttattacttgtctccgtggtaccaacaaccaccgaggacctaaaccgccccctaaattactacctatttagcggacggtacctaacgtaacgccggtccctagaggtacgttctaactcgtcttctctcggtactacgtaagtcgtcgcgacnccgaccgtccctaccgngtactaacttcgtcgtcggtcctacgacggacttggaacggtacggtacgtaccgttagttaactttaacttaccgtcgtaaccgttaccttacgtaacgttaccgtaggtaaccaaccttataccgtaaaacctaacccgtttcccggttaccgtaccggtaaccggttacgggaacccgtaggggtaccccgtacccggtcggttacggggtaccctaccggtaaacccggtaacccggtcccgtaaccccgttacg

SEQ ID NO: 13058 - DNA, 610 bp, Homo sapiens
  misc_feature: GYAE6OF02F6I83.25.39.D06.1.454.CMB.1.raw
  modified_base (361)..(361): a, c, t, g, unknown or other
  misc_feature (361)..(361): n is a, c, g, or t
  modified_base (462)..(462): a, c, t, g, unknown or other
  misc_feature (462)..(462): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctccgtgtctgggtctcctggacggtcaatcaccatttcctgcactggaaccagcactgatgtggctacttgaccttgtctcttggtaccaacaacacccggacaaggctcaaactcataattttgagaccagtaacgcggccctcgtgggttctagtcgattcactggctcaagtctggcaacncggcctcccaacaatctactggctcgaggctgaagacgaggtctgtttatttcagtcttgttcgcttagtgtggtacttaagaaaacctaagttttcgggngtaccgtcgggaccgggtaacgggaccctaaagttcgtaacccgttcgttaaacgtccgtaacgtaccccgaaagggtccctacccggtacccccgttacgggtacctaccgttccttacccggtttacccccaccccgtttaacccc

SEQ ID NO: 13059 - DNA, 611 bp, Homo sapiens
  misc_feature: GYAE6OF02JBL2C.25.39.D06.1.454.CMB.1.raw
  modified_base (283)..(283): a, c, t, g, unknown or other
  misc_feature (283)..(283): n is a, c, g, or t
tcagactgtacagtcacgaccggtgctcgatttagtgacatctcgcagttctttgggggggggtcacaagaggcagcgctctcgggacgtctccaccatggcctgggctctgctgttcctcaccctcctcactcagggcacagggtcctgggcccagtctgccctgactcagcctgcctccgtgtctgggactcctggacagtcggtcaccatctcctgcactggaaccagcactgatgttggctactttgaccttgtctcttggtaccaacaacacccgganaaaggctaccaaactcattaattttgagaccagtaacgcggtccctcgtcggggtttctagtcgtattcacgtgctccaagtctgcaacacgcctcctaacatctcgtcggctcacggtctaggaacgacgaggtcttgtttatttcgtgtcttgttcgcttagtgtgtactaagtaaactagtttggtgtcgtacgggacggaacggtaaccctaagttacgtaccgttacgttaacggtaccaacggtacccgaaggtcccgtacccggtaccccggttcggttaccctaccgttccggtttcccgttcccccgtcccttaccccg

SEQ ID NO: 13060 - DNA, 634 bp, Homo sapiens
  misc_feature: GYAE6OF02HXYEB.25.39.D06.1.454.CMB.1.raw
  modified_base (331)..(331): a, c, t, g, unknown or other
  misc_feature (331)..(331): n is a, c, g, or t
  modified_base (352)..(352): a, c, t, g, unknown or other
  misc_feature (352)..(352): n is a, c, g, or t
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctcgcctccgtgtctgggtcctccgtggactagtcgatcactattctcctagcacgtggaactccaccatcgatgttgcattcaatgtacctcgtcttcctcggttaccaacgtaacaccccgtaacaaacgacccccaaacttacgaactgaactttanacgaggcactaacgcgtaccncgtaagggttctcgtctcgtcttctcgttcggctaccgaagtctacgactaacgacggtccctcctagtacaacgttactcgtcgttacctccgtaaggcgtcgtaacggaacgttcggacgttcgaacgtttaagttaccgttacggtaccttttaccgaccgtaagtaccgttcgtaccggtacgtacgtaacgtcgtacgttacgggtggtttaccggacgttacggacgtaacgtaaacgtcgtacggtaccggtcgacgtacgtaccgtagtacccg

SEQ ID NO: 13061 - DNA, 570 bp, Homo sapiens
  misc_feature: GYAE6OF02I0YJD.25.39.D06.1.454.CMB.1.raw
  modified_base (449)..(449): a, c, t, g, unknown or other
  misc_feature (449)..(449): n is a, c, g, or t
tcagactgtacagtcacgaccggtgctcgatttagtgacatctcgcagttctttggggagctctgggagaggagccccagccgtgagattcccaggagtctccacttggtgatcagcactgaacacagaccaccaaccatggagtttgggcttaactgtcttttccttgttgctgttttaaaaggtgtccaatgtgaggtgcaactggtggagtcgtgggggagcttggtacagccaggcccggtccctgaccactctcctgcacagccttccggactcacctttggtgagcatgctatcgacctgggtccgccgaggcctccggaaggggaacggggtcgtgggagtggtcgtttgggttcagttagaagcgaagcctagtgggtgggacaacacaactaccggccgcgtctaaggtaaacgcaagtattcacgtcctctacgaaganatagaacttaccaaagcatccgacctatctagccacatcgagccagccgtagagagacggacggactacgacggtccgtagttactttacgttacgtttacttatttaccgtcgtaggtag

SEQ ID NO: 13062 - DNA, 783 bp, Homo sapiens
  misc_feature: GYAE6OF02GP6T3.25.39.D06.1.454.CMB.1.raw
  modified_base (294)..(294): a, c, t, g, unknown or other
  misc_feature (294)..(294): n is a, c, g, or t
tcagactgtacagtcacgaccggtgctcgatttagtgacatctcgcagttctttggggagctctgggagaggagccccagccgtgagattcccaggagtctccacttggtgatcagcactgaacacagaccaccaaccatggagtttgggcttaacgtgtcttttccttgttgcttagtttaaaaggtgtcctaatgtgaggtgcaactggtggagtcggtgggggaggcttgggtacagccgaggccgtcctgacactctcctgcacagccttccggactcctaccgtttggngacgcatcgcttatcgaccgttcggggtacccgtccgacggtcctaccggaggggtaacgggtcgtagggaggttcgggtcgtttggggttacaagtttaaggaacggtacggaaagtcccgttaaggtcggggttacggggacctaaaaccgtaacgtaaacgtacccgggtaccccggtacggtttacgtaaacgggttaaaaacgggtcctaaggtaaccgttaccgaaccggtaccccgttacgttaaccgaaaacggtacgtacgttaacggttaacctttaaacccgaaaaacggtccgttaaaccgtcccggtaacccttaacgttacccgtacgtacccgtaacgtaaggtacggtaacgtaccgtacggacccggttaggaacggttaacggcggtaacggtaccgtaccgtacggttaccgttacgttactttacggtttacggtttacctttaacgtttacgttaccgtggttaacgg

SEQ ID NO: 13063 - DNA, 671 bp, Homo sapiens
  misc_feature: GYAE6OF02IX0GO.25.39.D06.1.454.CMB.1.raw
tcagactgtacagtcacgaccggtgctcgatttagtgacatctcgcagttctctggggggggtcacaagaggcagcgctctcgggacgtctccaccatggcctgggctctgctgctcctcactctcctcactcaggacacgagggtcctgggcccagtctgccctgactcagcctgcctcgtgtctggtctctggacagtcgatcaccatctcctgcactggaatcaccactgatgttgctatttctatcgtaccttgtcctcctacggtaaccaaacaaccaacccgaggaccaaaccgaccccctaaacttactactaatttagtagacggacctaacgtaacggccggtaccctacgacggttacttactaacgtccgtactttctacgtcggtcctacctaagtcgtaggccacgccgaccggtccctccgtagaacctacttccgttacgtccgggtcctacccggaggtccgtaggacgggaccggaggtctaggttacttaacgttaccgttacggtacccttaacgtacttaagttacgtacggaacctaactaactacctaacctaaaccgtttcccggttacgttaccgggaccgttacggggaacccgtacgggtaccctaccggttccggtcgggtaccgaccggacccgtaacccggg

SEQ ID NO: 13064 - DNA, 795 bp, Homo sapiens
  misc_feature: GYAE6OF02H8DZL.25.39.D06.1.454.CMB.1.raw
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgcccctgacctcacgcctgcctccgtgtctgggtcctccgtggacagtcgatccaccatcctcctgcacgtggaactccaccactgatgtgctatttcattcgtaccttgtcctaccgtacggtaaccaaccaaacccgaacccccgaaacgtaaaaacccccggaccccccctaaaaactccgtaagttacgtaacgttttaacggacgggaacgggtaaccctaacggtaaaccgggccccggtaccccgtttagggtaccgggggtttctcggtcctttccggtcctttaccgtccgttcggccttaaccgtaacgttcgtacgggacctaaaccggttcccggtacccttacccgtaacgtaaccctaacgttccgtacgtcggtcctaccggacggtcgtacgggacggaccgtaggtccgtaagttactttaactcggttcgtacctttaccgtacgtacgtcggttcggaccgggtaagtacggttcgtaccgggtttggtttccggggttaccggttacgggaaccggttaacgggaaacggggtaaaccgtaaccgggttccgggttaaccccggttcggggttaccgggaaccggtaacccggtaccccggttaacggtcccccgg

SEQ ID NO: 13065 - DNA, 654 bp, Homo sapiens
  misc_feature: GYAE6OF02JNW0M.25.39.D06.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
tcagactgtacagtcacgaccggtgctcgatttagtgacatctcgcagttctttgggggggtcacaagaggcagcgctctcgggacgtctccaccatggcctgggctctgctgctcctcactctcctcactcaggacacagggtcctgggcccagtctgccctgactcagcctgcctccgtgtctgggctcctggacngtcgtcaccntctcctgcactggaaccgctgactnttggntcttataactatcgtctcctcgtaccaacaccaccgagacaccgaccccaatcactctattatgatcgtcatcacgtcgcctgtggtctttcgtgtctcttctcgtcgtctacacgttctcggactaccgtccgtccctccgtcgacctacgtcccggtccgggtcctaccgaggtcgtacggacgggtaccgtacggttaccttacgtttaacttacgttacggtacctttatttaccgtaacgtaaccgaagtaccgtaaaccctaaccgtaaacgttacggttacgttacgggttaccgggttacggggaccgggtacgggtaaccgttaacggttaccggtacccgttaccggtacgggttaccgaccgggtacccggtaacgggtcccgttacccggtaccccgttcccgg

SEQ ID NO: 13066 - DNA, 663 bp, Homo sapiens
  misc_feature: GYAE6OF02J0VDB.25.39.D06.1.454.CMB.1.raw
  modified_base (139)..(139): a, c, t, g, unknown or other
  misc_feature (139)..(139): n is a, c, g, or t
  modified_base (255)..(255): a, c, t, g, unknown or other
  misc_feature (255)..(255): n is a, c, g, or t
  modified_base (558)..(558): a, c, t, g, unknown or other
  misc_feature (558)..(558): n is a, c, g, or t
  modified_base (651)..(651): a, c, t, g, unknown or other
  misc_feature (651)..(651): n is a, c, g, or t
tcagactgtacagtcacgaccggtgctcgatttagtgacatctcgcagttcgtttgggggggtcacaagaggcagcgctctcgggacgtctccaccatggcctgggctctgctgctctcactcctctcactcacggacncgtagggtcctgggcccagtcctgcccttgactccacggccttggcctaccgtgtccgtgggtctccctggactagtcatccacgtatccgtcctagcactggaactccacctacngcttgtgctacttcagtgtaccttgtcctacctggtaaccaacgtaacccacccgaacaaaccgtccccctaaactccgtactacggtaatttacgacgacgggtactaaccgtaacggtcccgtacctcggttacggggtttctcggctttccgcctttagcgttcggacctcgtaagtcgtacgacaacgtaccgcctcccgtaagacttaactccgtacgtccgtaaccgtccgcggtcgtaggaacggttaggacgtcgttacgtacgtttactacgttcgtctttcgactaccggttnttccgacgtccgtaagtcgcgtttcggtagtttcggtcggtaccgtacggaggtaacgttaaggtaccgtacgttccgacggtacggtaaccnccgtacgtcccg

SEQ ID NO: 13067 - DNA, 704 bp, Homo sapiens
  misc_feature: GYAE6OF02JJVMN.25.39.D06.1.454.CMB.1.raw
  modified_base (226)..(226): a, c, t, g, unknown or other
  misc_feature (226)..(226): n is a, c, g, or t
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (299)..(299): a, c, t, g, unknown or other
  misc_feature (299)..(299): n is a, c, g, or t
tcagactgtacagtcacgaccggtgctcgatttagtgacatctcgcagttcgtttgggggggtcacgaagaggcagcgctctcgggacgtctccaccatggcctgggctctgctgctcctcactctcctcactcaggacacgagggtccctgggccccaggtcctggcctggactcaacctgccctccgtgtctgggtcctcctaggaccggttcaatccaccctntttcccngcactcggaaccngcactgactgttcgcttacttgaccttgtctcttgtaaccacaacacccgganaacggcaccaaacctcaatattttagacacagtaacgcggcctacgttgggtttacctagttccgtattccacgtcggcctccgtaagtcgtggtaccaacgaccggaccctaccctaaccaacgtcctctacgggtcctaccgtacggtacctgaaaccgtacgaggtcctttagttacgtttcctagtaccttggttcgtaccgttatcgggttacgcggtaataaaacgttacgtttagggtcgtacggttccgggacggtaaccgggtaacccgttaagttacggtaccccgggttatttaaaccggtcgaaccgtaacccggtaagggtccccgttaccgtacccccgttcggtacccgttaccgttcgtccccggttaccccctaccccgtttaccccg

SEQ ID NO: 13068 - DNA, 581 bp, Homo sapiens
  misc_feature: GYAE6OF02GXH56.25.39.D06.1.454.CMB.1.raw
  modified_base (308)..(308): a, c, t, g, unknown or other
  misc_feature (308)..(308): n is a, c, g, or t
  modified_base (363)..(363): a, c, t, g, unknown or other
  misc_feature (363)..(363): n is a, c, g, or t
  modified_base (396)..(396): a, c, t, g, unknown or other
  misc_feature (396)..(396): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccatgatgttgctatttcatgtaccttgtctcctaggtaccaacaaccacccgacaaacgccccaaatcatgtatttangaggcactacgcgcctgtacgggtttctgctcgtcttctctggcctacgaagtcnggcaagtaccgcctccagactatctcgtcgtcncgaggtctggacggacgaggtctagtactttacttacgtcgtaccttcctactacgtagttcggtcgacgtagtacgtaccgtacggtttgggtcggttcggacgtaacgggtaacgggtaaaccgtaacggttccggtacccggttcggtaccgggtaccgaccggtacccggaaggtccccgg

SEQ ID NO: 13069 - DNA, 649 bp, Homo sapiens
  misc_feature: GYAE6OF02I21R3.25.39.D06.1.454.CMB.1.raw
  modified_base (217)..(217): a, c, t, g, unknown or other
  misc_feature (217)..(217): n is a, c, g, or t
  modified_base (230)..(230): a, c, t, g, unknown or other
  misc_feature (230)..(230): n is a, c, g, or t
  modified_base (278)..(278): a, c, t, g, unknown or other
  misc_feature (278)..(278): n is a, c, g, or t
  modified_base (346)..(346): a, c, t, g, unknown or other
  misc_feature (346)..(346): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccgtgactcagcctgcctcgtgtctgggtctcctggacagtcgatcacctatttccngacactggaaccngcactgatgtggcttacttgacttgtctcttggtacaacaacaccganaaggctacaactcattattttgagacagtaacgcgcctgtgggttctagtctatcactgctcaagtcngtcaacgcgtcctacctaacactctctggcctcaggtctacgaagaccgagtcttggttttactttcgtcgtcttggttagaccgtttatggttacggtaccttaaggtaaaaaaccgtttgttttacggggttacgtaccgtttccggggtaccggttaaaccgggggtaacccttaagtttccggtaacccgttttacggttaaacgttcgtaacccggtaacccgtaacgggttaccttacccggtacccccggtttaccggttacccgtacccgtttaccggtcccgtttcccccccgg

SEQ ID NO: 13070 - DNA, 588 bp, Homo sapiens
  misc_feature: GYAE6OF02G4LVA.25.39.D06.1.454.CMB.1.raw
  modified_base (367)..(367): a, c, t, g, unknown or other
  misc_feature (367)..(367): n is a, c, g, or t
tcagactgtacagtcacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaatcaccactgatgttgctatttcatgtaccttgtctcctggtaccaacaaccacccgacaaacgccccaaactcatgattatgaggcactaacgcggccctcgagggtttctgctcgtctctctgctcagtctggacaacncgtcctcctcacaactctcgtcgtcctccgaggctagacggacgtaggccttagtatttacttactcgtaccttacctataatacgtacggtaccaaactactactaaacctaaccttccccgttaccgttacccggaaccgttaccgggaaccgtacgggttacccgtaacccggtccgtacgggttaccgacccgtacccgaccggacccctaaccccg

SEQ ID NO: 13071 - DNA, 653 bp, Homo sapiens
  misc_feature: GYAE6OF02IDXHP.25.39.D06.1.454.CMB.1.raw
  modified_base (185)..(185): a, c, t, g, unknown or other
  misc_feature (185)..(185): n is a, c, g, or t
  modified_base (331)..(331): a, c, t, g, unknown or other
  misc_feature (331)..(331): n is a, c, g, or t
  modified_base (389)..(389): a, c, t, g, unknown or other
  misc_feature (389)..(389): n is a, c, g, or t
  modified_base (415)..(415): a, c, t, g, unknown or other
  misc_feature (415)..(415): n is a, c, g, or t
  modified_base (427)..(427): a, c, t, g, unknown or other
  misc_feature (427)..(427): n is a, c, g, or t
  modified_base (526)..(526): a, c, t, g, unknown or other
  misc_feature (526)..(526): n is a, c, g, or t
tcagactgtacagtcacgaccggtgctcgatttagtgacatctcgcagttctttggggagctctgggagaggagccccagccgtgagattcccaggagtctccacttggtgatcagcactgaacacagaccacaaccatggagtttgggcttaactgttcttttccttgttgcttagtttaaagngtaccaagtgtgagtgctaactggtggagtcgtgggggagcgttggtacgaagccgaaggtccggtcctaggactacctctccgtgaccaccgacggtccttccggaacttcctaaccgtttcggtagaggctaagtgctaagtcncgtcggtcccgacacgctaccgaggaaggtctaggacgtgcgttggttacgagtaganacgtaagctagtggagggacaacganaactaacgccgngtactagaaaggtcaggaacttccgaagtcctactacgaaacggtaacgtagtaggtaaccttaaaacccgtaaaagcgtaactaccgaccggtttaanacgtacaaccaagtacgtacgaagacacggtaagtacgaacggacgtaacggtacgtaacgttacgacggtaccgtaacgttaaccgttacgttacgtttacgtttattaccgtaccgttaggaacg

SEQ ID NO: 13072 - DNA, 615 bp, Homo sapiens
  misc_feature: GYAE6OF02FFFXF.25.39.D06.1.454.CMB.1.raw
  modified_base (365)..(365): a, c, t, g, unknown or other
  misc_feature (365)..(365): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctggcctgactcaacctgcctcgtgtctgggtctccgtggacgtcaatcacctatttcctgcactcggaaccagcactgatggttgcttactttgaccttgtcttcttggtaccaacaacaccggacaaaggctaccaactcatattttgagaccagtaagcggccctcgtgggtttcagtcgattcgactggctcatctggctaacncggcctacctaacaattctcgtggctccgaggctggaagaccgaggccttgtttaacttcgtgtccttgttgtcgtatcgtaggacctagtaaaactagtttggagtccgttacgggcgggtaacggacccgtaagttcggaacccgttttcgtaaacgtcgtaacggtacccgaacgggtcccttacccggcccccgttcgggtccctaacccgtttcctccccgggttcccccgtacccgtttccccg

SEQ ID NO: 13073 - DNA, 713 bp, Homo sapiens
  misc_feature: GYAE6OF02J0GNP.25.39.D06.1.454.CMB.1.raw
  modified_base (221)..(221): a, c, t, g, unknown or other
  misc_feature (221)..(221): n is a, c, g, or t
  modified_base (293)..(293): a, c, t, g, unknown or other
  misc_feature (293)..(293): n is a, c, g, or t
tcagactgtacagtcacgaccggtgctcgatttagtgacatctcgcagttcgtttgggggggggtcacaagaggcagcgctctcgggacgtctccaccatggcctgggctctgctgctcctcactctcctcactcaggacacgaggtcctgggcccagtctcggcctgactcaacctgcctcgtgtcgtggtctccgtggacgtcaactcacctatttccngcctacgtggaaccagccacgtgattgtgcttacttcgacttgtctcgttcggtactaaccacgacccgganaaggcctacaactacattaatttcgaacgacctagtaacgcggcctgtcgggtttactacgtcgtaattctactcggtctaccgtaagtcgtcggacaaccgtaccggacccttacctaaacgtaacgttccgtacgttacggtacccgtccgaacggtcctaagggtaaccgaccggtaggtacctttaggtttacctttcgtggtctttcgtcgtcttgttaggtacgtaccgttaagtaaaccgtttaggttacggttcggacggttaccgggtaacgggtaccggtaaccgtaacgtttacgaaccggtttacttaacggtccgtaacggtaaccccggtgttcccggttaacccgcccccggtttaacggtaccgtacccgttacgttccccggttacccccgtccgttaccccg

SEQ ID NO: 13074 - DNA, 560 bp, Homo sapiens
  misc_feature: GYAE6OF02HMN88.25.39.D06.1.454.CMB.1.raw
  modified_base (237)..(237): a, c, t, g, unknown or other
  misc_feature (237)..(237): n is a, c, g, or t
  modified_base (244)..(244): a, c, t, g, unknown or other
  misc_feature (244)..(244): n is a, c, g, or t
  modified_base (336)..(336): a, c, t, g, unknown or other
  misc_feature (336)..(336): n is a, c, g, or t
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcacatctcctgcactggaatcaccactgatnttgactntttcatgacttgtctctgtaccaacaacacccgacaacgcccccaaatcatagtattatgaggacacgtaacgccgcctcgtaggggtttcncgctcgtcgttctcgtcgctacaagtctgacaatacggtcctccctgacaattctgtacggtcctacgcggcgtagaggtacggagtcgttagtattaactttacgtcgtccttacgtccacgttatcggttccgataacgtacgtcgtacgttcggggtcgttcggacggtaggacggaaccgtaaaggtcgaccgtcggtacggtcgacgacccgagtcccg

SEQ ID NO: 13075 - DNA, 979 bp, Homo sapiens
  misc_feature: GYAE6OF02IYU86.25.39.D06.1.454.CMB.1.raw
  modified_base (223)..(223): a, c, t, g, unknown or other
  misc_feature (223)..(223): n is a, c, g, or t
tcagactgtacagtcacgaccggtgctcgatttagtgacatctcgcagttctttgggggggggtcacaagaggcagcgctctcgggacgtctccaccatggcctgggctctgctgctcctcactctcctcactcaggacacagggtcctgggcccagtctggcctgactcaacctgcctccgtgtcgtgggtctccgtggacggtacaatccacctatttccngctacgtacggaacccaagcctacgtgtagtgggttcggtcttacttttccggtacctttacgttccgttaccgtttacggttaacccaacctaaaacccggaacccccgggtaacgaaaacggtccctaacccgtaaacccttaacttaacgtttaattttttacgaacggtaacccgtaaacggtaaaggtccccgggtaccccgtttcgggtttacgggggtttttaccgttaaggtccggttaacgttttacccgtaaaccggttcggttacccgtaaccggtttaaaacggttcccgttaccggggtaaaccccgtaaaccggaacccgggttaaccccccgtttaaccccgttaaaacctaaacccggtttacccgttaccggggttaccggggtacccgtttaaccccggaacggtaccgtaacggggtaaacggaaccgggaacggttccgttttaaagggtttttacgtttacccgttaggttccgttggtttacgtaccgtttagttacggggttacgttaaccggttaacgtaaaaaccgtttaaggtttacggggttacgttaaccggggtccgggtaacggggtaacccggttaacccgtaaagttacccgtaccggtttaccgttaacggtaaccgtccgggtaacccggtacccgggtcccgttacccggtccccgtttacccgggttacccgtaccgttacccggtttacccccctttccccgaccccctttaacccccg

SEQ ID NO: 13076 - DNA, 714 bp, Homo sapiens
  misc_feature: GYAE6OF02IZT7J.25.39.D06.1.454.CMB.1.raw
  modified_base (345)..(345): a, c, t, g, unknown or other
  misc_feature (345)..(345): n is a, c, g, or t
  modified_base (409)..(409): a, c, t, g, unknown or other
  misc_feature (409)..(409): n is a, c, g, or t
  modified_base (417)..(417): a, c, t, g, unknown or other
  misc_feature (417)..(417): n is a, c, g, or t
  modified_base (476)..(476): a, c, t, g, unknown or other
  misc_feature (476)..(476): n is a, c, g, or t
  modified_base (688)..(688): a, c, t, g, unknown or other
  misc_feature (688)..(688): n is a, c, g, or t
tcagactgtacagtcacgaccggtgctcgatttagtgacatctcgcagttctttgggggagctacaacaggcaggcaggggcagcagatggtgttgcagacccaggtcttcatttctctgttgctctggatctctggtcgtcccggggacatcatattgaaccagtctccagagtccctgtctgtgtctcgtagggcgggagggccaccgatacgactgacaggtccagcagtagtcgtttgactacgtccgacctaaataaggtaaccttgttacggggttaggtaatcgaacggcgaacggcggaccagggaccagcccttacgtaagttcgcttcgtttacncgggcctaccgtaacccggcaccgtccggccgtcctcgggtccactcctacgcgcgagcgggtntcgggganaggttactttacgcctccgtactaccctactacggaaacccttcgaaccgtaaacccgnggtaacgtaacgtcgggtaccggtacctaagtttttcttaaagtttcgggaactagggaactttaacgtaaacccgttaattacccggtaacttacccggtacttaccgtaaacccgtttgggaccccgggttacgggtaacccagggttaacggtacggggtaaactaacggtaaactaaacccgggtaagtttcggacggtttaaaccgnggtttaacccgaccgttaccggttcg

SEQ ID NO: 13077 - DNA, 720 bp, Homo sapiens
  misc_feature: GYAE6OF02G1I1I.25.39.D06.1.454.CMB.1.raw
  modified_base (161)..(161): a, c, t, g, unknown or other
  misc_feature (161)..(161): n is a, c, g, or t
  modified_base (224)..(224): a, c, t, g, unknown or other
  misc_feature (224)..(224): n is a, c, g, or t
  modified_base (239)..(239): a, c, t, g, unknown or other
  misc_feature (239)..(239): n is a, c, g, or t
  modified_base (511)..(511): a, c, t, g, unknown or other
  misc_feature (511)..(511): n is a, c, g, or t
  modified_base (545)..(545): a, c, t, g, unknown or other
  misc_feature (545)..(545): n is a, c, g, or t
tcagactgtacagtcacgaccggtgctcgatttagtgacatctcgcagttctttggggggggtcacaagaggcagcgctctcgggacgtctccgaccatggcctgggctctgctgctcctcactctcctcactcaggacacgagggtcctgggcccagtcnggtcctgacctcaaccgtgcctccgtgtctgggtctcctggacgtcaatccacctatttccgngctacgtggaacccngctacgtgagttggttggacttactttcgaccttgtcttccgttacggtaaccaaccgtaaccgtaacccggaacgaaacggtctaaccctaaaacttactaacgttaatttttacggaacgtaacccgaaggtaaaccgccgggtcccttacggttcgggggtttacttaggtcggtaacttcgtaccgttgggtaccctaccgtaacggttccgtacggacaaccgtaccgtacctaccctaaacgacttcctacgtcggtctccgagtnacgtacgacgtagtcttgtttactctggtctgtntctagtggtacgactaaggtaaactgtttacgacggtcgtcgggacggtaccggtaactaacggttcggtaccgtacgttaaccgtacggaaccggtaccgaacggttccctacccggtccccgttaccgggtaccttaccggttcccgttcccggtttccccacccgttacccg

SEQ ID NO: 13078 - DNA, 755 bp, Homo sapiens
  misc_feature: GYAE6OF02J0LQQ.25.39.D06.1.454.CMB.1.raw
tcagactgtacagtcacgaccggtgctcgatttagtgacatctcgcagttctttggggggggtcacaagaggcagcgctctcgggacgtctccaccatggcctgggctctgctgctcctcactctcctcactcaggacacagggtcctgggcccagtctgccctgactcagcctgcctccgtgtctgggtctccgtggacagtcgatcaccatctcctgcactggaactcacctactgattgtgctatttccatcgtaccttgtctcctaggtaacccaacaacccaccccgaacaaaccgtacccccaaaactcaattcgtaatttaggtcgacggacaactacggccggtcctaggtacgggttctgcctcgtcctcgtcgtcgcctaccgtaagtcgtacgactaacgtcccggtccctccgtacgtaacctatttccgttcgtccggttaccgtaccgtagggtaccgtgggaacgggtaccgggtacggtacttacgttaaacgtttacgtttaaccgtcggttaaccttacttaacttaacggttaacgtttacccgggaaaacctaccttaaactttaacccgaaacccgtttaaacccgttccccgtttaacggttaacccgggttacccgggttaaacccgggtacccgggttaacggggttaaccccgttacccgggtttacgggttccgggtaaccccgttaaccggtaccccccggaaaaccgggtacccccctaaaccccgg

SEQ ID NO: 13079 - DNA, 651 bp, Homo sapiens
  misc_feature: GYAE6OF02H99WZ.25.39.D06.1.454.CMB.1.raw
  modified_base (184)..(184): a, c, t, g, unknown or other
  misc_feature (184)..(184): n is a, c, g, or t
  modified_base (254)..(254): a, c, t, g, unknown or other
  misc_feature (254)..(254): n is a, c, g, or t
  modified_base (257)..(257): a, c, t, g, unknown or other
  misc_feature (257)..(257): n is a, c, g, or t
tcagactgtacagtcacgaccggtgctcgatttagtgacatctcgcagttctttggggagctctgggagaggagccccagccgtgagattcccaggagtctccacttggtgatcagcactgaacacagaccaccaaccatggagttgggcttaactgtcttttcctgttgctagttttaaaggntccaatgtgaggtgcaactgggtggagtctgggggagtcttgggtacagccaggccgtccctgacactcnccngcacagcttccggactcgtacctttggctagcctagtcggactatcgaccgtgggtcccgacgaggctccgaggggaacggttcgagggagtggactttggggtacctaagttaagacggtcgaacgtcgtagtcgggtagggaccaacgacaaagtacccggcgtacgttcgtaaggtaaaagcgaacgtacgttacgacgtaccttacgtacaaaggagtaagttcgaaacgtttaaccgaaaagtcctaacgtcctaccgtacttctagaccactagtagaactcgagtacccgtagacgaacggtaccgacggaccgtacgtacggaccggtttacgtaacgttttacgttacgttttaccttaagtttaccgttaccgtaggttaacgg

SEQ ID NO: 13080 - DNA, 762 bp, Homo sapiens
  misc_feature: GYAE6OF02FVUJK.25.39.D06.1.454.CMB.1.raw
  modified_base (251)..(251): a, c, t, g, unknown or other
  misc_feature (251)..(251): n is a, c, g, or t
tcagactgtacagtcacgaccggtgctcgatttagtgacatctcgcagttcttggggagctacaacaggcaggcaggggcagcaagatggtgttgcagacccaggtcttcatttctctgttcgctcgtggactctcgtggtcgtccccggggacactacgatattacgaaccacgtctccgacgacgttccccgtggtcttgttcgttacctgtggggaccgggacgggtcccaacaactaccgtaaccgngtacgaaccggtccacaccgacgtaggtttagttttaccgaaccggtcctacccgactaaacgtaacggtaccttacgtttacggttaggtaactcaaggtccagtaccgggaccacggacgacggtacctaaccgtttaggtccggtacttttaaccggttcgttaggggacccccttacggaaacccggtccaaccggtttccggaaccgtttcccgacgggtcctaacgtttcgagttcgggaacgttcgggtccggtacggtacggacgtcgttaacggttccctaaggttccctaccgttacctaacggtcttaaccgtcgtaacctaccgtaacggaacgtttccggaccgttaggttaaccttagggtttacgttaacgtccgttacgacctaataaccttaacgtctaacccttccgtacgcttaaccgtcggaacttcggggctacgaacgtggtaacgtgactaaacccgtagacgttggccgtgtcgtaccattccggtc

SEQ ID NO: 13081 - DNA, 676 bp, Homo sapiens
  misc_feature: GYAE6OF02IEZ8R.25.39.D06.1.454.CMB.1.raw
  modified_base (258)..(258): a, c, t, g, unknown or other
  misc_feature (258)..(258): n is a, c, g, or t
tcagactgtacagtcacgaccggtgctcgatttagtgacatctcgcagttctttggggagctctgggagaggagccccagccgtgagattcccaggagtctccacttggtgatcagcactgaacacagaccaccaaccatggagtttgggcttaacttgtctttttccttgttgcttgttttaaaggtgtccaatgtgaggtgcacgtggtggagtcggtgggggagtcttggtacagccgacgggccgggttccccngaccacgtctccctgccagacgtcgttacccggactccgtaccgttggtcgagtcatgctagtcgaccgtcgggtccgcgacggccgtaccgaggggtacggtctagggaggtcggtcgtttgggttactaaggttaagacggacggtaacgtaccgttcgtaggggtgggacctaaacgaacgtaaacgtacccggcccgtacggtacgtaaggtaaaacggcctaaggtaccttacgacgtcctacacgaagacgtatacgtactttacgaaatctacgtccgtactattccgagtaccacgtagtacgacgtcgacgtcgtaagaaggacgacggacggtaacccgtgtaaccgtccggtttaagtaccgtttacgttttcgtttaacttacctttacggttcgtaaggttacgg

SEQ ID NO: 13082 - DNA, 640 bp, Homo sapiens
  misc_feature: GYAE6OF02JFLH1.25.39.D06.1.454.CMB.1.raw
  modified_base (179)..(180): a, c, t, g, unknown or other
  misc_feature (179)..(180): n is a, c, g, or t
  modified_base (212)..(212): a, c, t, g, unknown or other
  misc_feature (212)..(212): n is a, c, g, or t
tcagactgtacagtcacgaccggtgctcgatttagtgacatctcgcagttctttgggggggtcacaagaggcagcgctctcgggacgtctccaccatcggcctgggctctgctgctcctcactctcctcactcaggacacgaggtcctggcccagtctggactgactcactgcctcgtnntgggtctcgtggacgtcaatcacctatttccngtcacgtacggaaccagtcacttgacgtgtgctacgtttgaccttgtctcttgtaaccaacacgtacccaggaccaaacgtacccccaaatttacgtactacttaatacgacggacctaacgtacgtaccgccttacagggttactttacgtaatcgtactcgttcacggtctacgagtctggactacgccaccggtcctaccgtagactaatccgtaccgtaggcctacggtacgtacgtcgggaacgtacggtacgacgtacgttaacttaggttaactacggtcctaataccgtagttaacgacgaacctacaacgtacctaaactaccgtaccgtaccgttaccgtaccgtacggtaaccgacggggttcctacggtcgtcggtacgcgtaacccggacgtacccacccgtactcggtcctacg

SEQ ID NO: 13083 - DNA, 255 bp, Homo sapiens
  misc_feature: GYAE6OF01CLMBB.19.49.E05.1.454.CMB.1.raw
  modified_base (185)..(185): a, c, t, g, unknown or other
  misc_feature (185)..(185): n is a, c, g, or t
  modified_base (191)..(191): a, c, t, g, unknown or other
  misc_feature (191)..(191): n is a, c, g, or t
  modified_base (193)..(255): a, c, t, g, unknown or other
  misc_feature (193)..(255): n is a, c, g, or t
tcagtactctcgtgcacgaccggtgctcgatttagagcgactagctaacgtacggacaaagggcccatcggtcttcccctggcgcccgtgctccaggagcgacctccgagaggccacagcggccctgggcctggccctggtcaaggctacttcccaggagacgtactgagcgggctggcaaggcncatagncnnnnnnnnnnnnnnnnnnnnnnnnnnnnnnnnnnnnnnnnnnnnnnnnnnnnnnnnnnnnnnn

SEQ ID NO: 13084 - DNA, 183 bp, Homo sapiens
  misc_feature: GYAE6OF02GT24A.19.49.E05.1.454.CMB.1.raw
  modified_base (179)..(183): a, c, t, g, unknown or other
  misc_feature (179)..(183): n is a, c, g, or t
tcagtactctcgtgcacgaccggtgctcgatttagagcgactagcaacacacaaagggcccatcggtcttcccctggcgccctgctccaggagcacctccgagagcacagcggccctgggctgcctggtcaaggactacttcccacgagagtactgagcgggctggcaaggcgcatagnnnnn

SEQ ID NO: 13085 - DNA, 179 bp, Homo sapiens
  misc_feature: GYAE6OF02F0KX2.19.49.E05.1.454.CMB.1.raw
  modified_base (179)..(179): a, c, t, g, unknown or other
  misc_feature (179)..(179): n is a, c, g, or t
tcagtactctcgtgcacgaccggtgctcgatttagagcgactagcaacacacaaagggcccatcggtcttcccctggcgctctgctccaggagcacctccgagagcacagcggccctgggctgcctggtcaaggactacttcccacgagagtactgagcgggctggcaaggcgcatagn

SEQ ID NO: 13086 - DNA, 534 bp, Homo sapiens
  misc_feature: GYAE6OF01D8BBA.3.59.F04.1.454.CMB.1.raw
  modified_base (438)..(438): a, c, t, g, unknown or other
  misc_feature (438)..(438): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgagggaaggggctggagtgggtggtcaacttgaagccagatggaagtgagaaatactatgtggactctgtggagggacgattcacctatttccagagacaacgccaagaactcattgtatctnacaatggaacagcctgacgacccgaggacacggtctgtttattctgtggcggctgggcagtcggaaactcgtacgggccacgggaccctggtaccg

SEQ ID NO: 13087 - DNA, 555 bp, Homo sapiens
  misc_feature: GYAE6OF01CPDO4.3.59.F04.1.454.CMB.1.raw
  modified_base (337)..(337): a, c, t, g, unknown or other
  misc_feature (337)..(337): n is a, c, g, or t
  modified_base (361)..(361): a, c, t, g, unknown or other
  misc_feature (361)..(361): n is a, c, g, or t
  modified_base (380)..(380): a, c, t, g, unknown or other
  misc_feature (380)..(380): n is a, c, g, or t
  modified_base (437)..(437): a, c, t, g, unknown or other
  misc_feature (437)..(437): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccatttagaaggtgcagtgtgaggtgcagctggtggaggtcgggggggagcgtttgggccaggccgtggggggtccctggagactctcctgtgcagcctctggattcacctttagtgctcttggatgaacttgggtccgccagtctccgagggaagggctggagtgggnggccaattgaagccagatggaagngagaaatatatgtggactntgtgagggacattcacatttccagagacaacgccaaagaactcattgtatctagaanaatagacacacgacgacgaccgacgacgacgtcgttgttattgttgtcgtcggtcggtcggtcgtacgtaacgtaaacgtaacggtacgggtaccggaccggtaccggtacggtaccg

SEQ ID NO: 13088 - DNA, 522 bp, Homo sapiens
  misc_feature: GYAE6OF01EEOT2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaacttgaagccagatggaagtgagaaatactatgtggactctgtgagggacgatcaccattccagagacaacgcaagaactcattgtatctgacaatggacagcctgacgaccgagacacggctgttattctgtgcggtctgggcagtcggaaactcgtagggaccagggaccctggtaccg

SEQ ID NO: 13089 - DNA, 528 bp, Homo sapiens
  misc_feature: GYAE6OF01BIH4P.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgccagtctccagggaagggctggagtgggtggccaacttgaagccagatggaagtgagaaatactatgtggactctgtgaggggacgattcaccatttccagagacaacgccaagactcattgtatctgcaaatggacagcctgagacccgaggacacggctgtttattctgtcgcggtcctgggcagtcggaaactcgtggggaccagggaccctggtacccg

SEQ ID NO: 13090 - DNA, 566 bp, Homo sapiens
  misc_feature: GYAE6OF01ANNZD.3.59.F04.1.454.CMB.1.raw
  modified_base (171)..(171): a, c, t, g, unknown or other
  misc_feature (171)..(171): n is a, c, g, or t
  modified_base (179)..(179): a, c, t, g, unknown or other
  misc_feature (179)..(179): n is a, c, g, or t
  modified_base (278)..(278): a, c, t, g, unknown or other
  misc_feature (278)..(278): n is a, c, g, or t
  modified_base (303)..(303): a, c, t, g, unknown or other
  misc_feature (303)..(303): n is a, c, g, or t
  modified_base (450)..(450): a, c, t, g, unknown or other
  misc_feature (450)..(450): n is a, c, g, or t
  modified_base (464)..(464): a, c, t, g, unknown or other
  misc_feature (464)..(464): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
  modified_base (549)..(549): a, c, t, g, unknown or other
  misc_feature (549)..(549): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccnttagaggngcagtgtgagtgcagctggtggagtcggggggagcttggtccaggccgtggggggtccctgagactctcctgtgcagcctctggattcacctttagtanctcgttggatgacgtgggtccgccngtctccgagggagggctggaggtgggtgccgaacttggaagccagagtgggaagtggaagaaagttactattggtgggtacctgtggtaggaggggtacgtattccactacgtttccgaagtacgaacgaaccgcaaagacccttanagtttgtactcgtnactaaacgtgcaacgcctaaggccgacccgagtccaggtcttgttatttcgngtgcgtcgnggctagtacgaaactggtcgggancgggtaacctggtaccg

SEQ ID NO: 13091 - DNA, 541 bp, Homo sapiens
  misc_feature: GYAE6OF01A7SII.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgaggggaaggggctgggagtgggtggccaagttgaagccagatggaagtgagaaatactatggtgactcgtggtgaggggacattcacctatttccagagacaacgccaagaactcattgtatctgacaaatggaacagcctagacgacccgagacacggctgtttattctgtgcggcctgggcagtacggaaactcgacggggaccacgggaccctgggtacccg

SEQ ID NO: 13092 - DNA, 529 bp, Homo sapiens
  misc_feature: GYAE6OF01A6Z9B.3.59.F04.1.454.CMB.1.raw
  modified_base (467)..(467): a, c, t, g, unknown or other
  misc_feature (467)..(467): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcgggggaggcttggtccagcctggggggtccctgagactctcctgtgcagcctctggattcacctttagtagctcttggatgaactgggtccgccagtctccagggaaggggctggagtgggtggccaacttgaagccagatggaagtgagaaatactatgtggactctgtgaggggacgattcaccatttccagtagacaacgccaagactcattgtatctgcaaatggacagcctgagacccgaggacacggntgtttattctgtgcggtctgggcatacggaaactacgcggggaccagggaaccctggtaccg

SEQ ID NO: 13093 - DNA, 533 bp, Homo sapiens
  misc_feature: GYAE6OF01D2QNF.3.59.F04.1.454.CMB.1.raw
  modified_base (305)..(305): a, c, t, g, unknown or other
  misc_feature (305)..(305): n is a, c, g, or t
  modified_base (333)..(333): a, c, t, g, unknown or other
  misc_feature (333)..(333): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagccgtgggggtccctgagactctcctgtgcagcctctggattcacctttagtagctcttggatgaactgggtccncagtctccgagggagggctggagtgggnggccaagttgaagccagatggaagtgagaaatactatgtgactctgtaggagggacattcactattccagacgacaacgccaagactctattgtatctagacaaatggacagcctagacgacccgagaccacggcttgtttattctgtcgtcggctgggctagtacgaaacgtcgagggaccacgggaccctggtacccg

SEQ ID NO: 13094 - DNA, 524 bp, Homo sapiens
  misc_feature: GYAE6OF01C5N5L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaactgggtccgcagtctccagggaggggctggagtgggtggccaacttgaagccagatggaagtgagaaaatctaatgtggactcgtgtgaggggacgattcacctatttccagagacaacgccaagactcattgatctgacaaatggaacagcctagacgacccgagacacggctgtttattctgtgcggctgggcagtacgaaactcgtgggcacgggacctggtacc

SEQ ID NO: 13095 - DNA, 524 bp, Homo sapiens
  misc_feature: GYAE6OF01C2CQI.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaacgttgaagccagatggaagtgaagaaatactatgtggactctgtgaggggacgattcacctattccagagacaacgaccaagactcattgatctgacaatgacagctgagaccgagacgacgctgtttattctgtgcggctggcagtacggaaaactcgtagggaccagggaccctggtacc

SEQ ID NO: 13096 - DNA, 534 bp, Homo sapiens
  misc_feature: GYAE6OF01ADOB7.3.59.F04.1.454.CMB.1.raw
  modified_base (302)..(302): a, c, t, g, unknown or other
  misc_feature (302)..(302): n is a, c, g, or t
  modified_base (344)..(344): a, c, t, g, unknown or other
  misc_feature (344)..(344): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccatttagaaggtggccagtgtgaggtgcagctggtggagtcggggggagcttggtccagcctggggggtccctgagactctcctgtgcagcctctggattcacctttagtagctcttggatgaactgggtccnccagtctccgagggagggctggagtggtgcaactgaagcagntggatgagaaatctatgtgactctggtgagggacagttcaccgatttccagtagacaacgcaagaactcatgtatctgacaatgacagccgtgacgaccgaggacacggtcttagtttatttctgtcgtccggacgtgggcagtaccgaaaacgttcggtacgggaccgacgggtaacccgtggtacccg

SEQ ID NO: 13097 - DNA, 535 bp, Homo sapiens
  misc_feature: GYAE6OF01A87TF.3.59.F04.1.454.CMB.1.raw
  modified_base (510)..(510): a, c, t, g, unknown or other
  misc_feature (510)..(510): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtagctcttggatgaactgggtccgccagtctccagggaaggggctggagtgggtggccaacttgaagccagatggaagtgaagaaatactatgtggactctgtgaggggacgattcaccatttccagagaacaacgccaagaactcattgtatctgcaaatggacagcctgacgacccgaggacacggctgtttattctgtgcggcctgggcagtcggaaactacgnggggaccacgggacccgtggtaccg

SEQ ID NO: 13098 - DNA, 662 bp, Homo sapiens
  misc_feature: GYAE6OF01C5LDY.3.59.F04.1.454.CMB.1.raw
  modified_base (175)..(175): a, c, t, g, unknown or other
  misc_feature (175)..(175): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (206)..(206): a, c, t, g, unknown or other
  misc_feature (206)..(206): n is a, c, g, or t
  modified_base (208)..(208): a, c, t, g, unknown or other
  misc_feature (208)..(208): n is a, c, g, or t
  modified_base (210)..(210): a, c, t, g, unknown or other
  misc_feature (210)..(210): n is a, c, g, or t
  modified_base (216)..(216): a, c, t, g, unknown or other
  misc_feature (216)..(216): n is a, c, g, or t
  modified_base (222)..(222): a, c, t, g, unknown or other
  misc_feature (222)..(222): n is a, c, g, or t
  modified_base (234)..(234): a, c, t, g, unknown or other
  misc_feature (234)..(234): n is a, c, g, or t
  modified_base (236)..(236): a, c, t, g, unknown or other
  misc_feature (236)..(236): n is a, c, g, or t
  modified_base (315)..(315): a, c, t, g, unknown or other
  misc_feature (315)..(315): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctggagcggtgttcgtcgtaaggccgnttaagtaaggngcngtgtgagtgcagctggngngngggagngtgtcngcgtcggtccgngngacgtctctcgtgcacgctcgtgatctacttagtagtctcgtgtgtgtacgtcggtccgcgcgtcgtaccgagggaggnggtggaggtggtcgacgtacgtacgacgacgagtagtaggtagtagaagtaaacgtaacgtagtgtacggtacgtacgtaggtaggtacgggtacgtacgttacctaccgtacgttacgtagaacgaacgaacgaaccgaacgtaacgtactacgttacgtacgtacgtacgaacgtaagtaacgtaacgtacgtaaccgtacggtaaccggaacccggtaaccgtaaccgtacgttacgtttacgtttacgttcgttcggtcggtccggtcggtacggtaccgtaacggtaaaccggtaaccggtaccggtacgggtaccggtaaccggtacccgtccggtacccg

SEQ ID NO: 13099 - DNA, 543 bp, Homo sapiens
  misc_feature: GYAE6OF01ETXLK.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaacttgaagccagatggaagtgaagaaatactatgtggactctgtgaggggacgattcgactatttccagagaacaacgccaaagaactcattgtatctgacaaatggacagcctgacgacccgaggacacggctagtttattcgtagtggcgcgtgggcagtacggaaaactcgtaggggaccacgggaaccctggtacccg

SEQ ID NO: 13100 - DNA, 540 bp, Homo sapiens
  misc_feature: GYAE6OF01BWNEL.3.59.F04.1.454.CMB.1.raw
  modified_base (516)..(516): a, c, t, g, unknown or other
  misc_feature (516)..(516): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctggagactctcctgtgcagcctctggattcacctttagtagctcttggatgaactgggtccgccagtctccgaggggaaggggctggagtgggtggccaattgaagccagatggaagtgagaaatactatgtggactcgtgtggaggggacgattcacctatttccagagacaacgccaagaactcattgtatctgacaaatggacagcctaggacgacccgaggaccacggcttgtttattctgtgcggctgggcagtacggaaactcgnggggaccagggaccctggtacccg

SEQ ID NO: 13101 - DNA, 543 bp, Homo sapiens
  misc_feature: GYAE6OF01AFOXC.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccaggggaaggggctgggagtgggtggccaacttgaagccagatggaagtgagaaatactatgtggactcgtgtggaggggacgattcacctatttccagagacaacgccaaagactcattgtatctgcaaatggacagcctgacgacccgagacacggcttgttatttcgtgtcgccggtcctgggcagtacggaaactcgtcggggaccacgggaccctgggtacccg

SEQ ID NO: 13102 - DNA, 677 bp, Homo sapiens
  misc_feature: GYAE6OF01CYVFQ.3.59.F04.1.454.CMB.1.raw
  modified_base (318)..(318): a, c, t, g, unknown or other
  misc_feature (318)..(318): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttggttttccttgttgcctattttagaaggtggccagtgtgaggtgcagctggtggaggtcggggggaggcgttggtccaggccgtggggggtccctggagactctcctgtgcacgcctcgtggattctacctttagtagtctcttggatgaacgtcgggtccnccagtctccgagggaagggctgggagtgggtgccaacgttgaagccagagtggaagtaggaagaaaatactagtggtagacttcgtggtaggaggggtactattaccaaccgttatttaccgaagtacgaaccaaaccggtacccaaaggaaccttacctaagtttacgtaattcgtaacgacaaaacgttgggaaacctacggacccgttaggaaccggaaccccggagggaacccgtacggtacttaggttttacttcgtggtccggtccgggtaccgttggggacctaacggttaaccggaaaaccgttacgggtaccgggggacccaaaccggggaaccccttggggtaaccccg

SEQ ID NO: 13103 - DNA, 536 bp, Homo sapiens
  misc_feature: GYAE6OF01BPPZJ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccagggaaggggctggagtgggtggccaacttgaagccagatggaagtgagaaatactatgtggactctgtgaggggacgattcaccatttccagagacaacgccaagaactcattgtatctgcaaatggacagcctgagacccgaggaccacggctgtttatttctgtgcggtcctgggcagtcggaaaactcgtacggggccacgggaccctgggtacccg

SEQ ID NO: 13104 - DNA, 543 bp, Homo sapiens
  misc_feature: GYAE6OF01BL0TH.3.59.F04.1.454.CMB.1.raw
  modified_base (415)..(415): a, c, t, g, unknown or other
  misc_feature (415)..(415): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccaggggaaggggctgggagtgggtggccaacgttgaagccagatggaagtgagaaatactatgtgactcgtgtgaggggacagttcacctatttccagtanacaacgccaagaactcattgtatctgacaaagtggacagcctgacgacccgaggacacgctgtttattcgtgtgcggtctgggcagtacggaaactcggtacgggaccgacgggaccctgggtacccg

SEQ ID NO: 13105 - DNA, 547 bp, Homo sapiens
  misc_feature: GYAE6OF01DAPCM.3.59.F04.1.454.CMB.1.raw
  modified_base (310)..(310): a, c, t, g, unknown or other
  misc_feature (310)..(310): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttgggtccaggccgtggggggtccctgagactctcctgtgcagcctctggattcacctttagtagctcttggatgaactgggtccncagtctccgagggaggggctggagtgggtggccaagttgaagccagatggaagtgagaaatactatgtggactctgtggagggacgattcacctatttccagagacaacgccaagaactcattgtatctgacaaatggaacagcctagacgacccgaggacacggcttgtttattcgtgtggcggtcgtgggcacgtacggaaacgtcgacgggaccacgggtacccgtggtacccg

SEQ ID NO: 13106 - DNA, 774 bp, Homo sapiens
  misc_feature: GYAE6OF01EP2K5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctgggtggaggtcggggggaggcttggtccaggccgtggggggtccctggagactctcctgtgcagcctctggacttcacctttagtagctcttggatgaacgtcgggtccgcctagtcctccgaaggggaaggggctgggagtggggtcggaccctaaacgttggaacgtccgaaggtagtagggaaagtggaaagtaaaagtacgtaagtggtacggtacttcgtaggtgggaacggggtacgtaagtttacccaaccgtaacgtttccccgaaggtaacgaaaccgaaaccggtaacccgaaaacggtaaccttaccgtaaatttacggttaacgttaccgttaacgtaacgtaaaagtacgggtaaacctaacgggtaccccgttacgggaaaccgtaaccccgggaacgggaacccgaaccggggtccgtttaacggtttttaacttttccggttagggttcggtccgggtcccgttacggggtccgtaacggtaacccgggtaaaaaccgttcccgggtaccgggggacccgaaacccggggttaaccccgtcgggtacccccgg

SEQ ID NO: 13107 - DNA, 532 bp, Homo sapiens
  misc_feature: GYAE6OF01A98P5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctgggattcaccttttagtagctcttggatgaactgggtccgccagtctccagggaggggctggagtggtgccaattgaagccagatggaagtgagaaatactatgtggactctgtgaggggacgattcacctatttccagtagacacgccaagaactcattgtatctgcaaatggacagcctgacgacccgaggacacgggctgtttattctgtgcggtctgggcagtacggaaactcgtgggaccacgggaccctgggtacccg

SEQ ID NO: 13108 - DNA, 762 bp, Homo sapiens
  misc_feature: GYAE6OF01DRKHU.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggagtcggggggaggcttggtccaggccgtggggggtccctgagactctcctgtgcagcctctggattcacctttagagctcttggatgaactgggtccgccagtctccgagggaagggctggaggtgggtggaccgaacgttggaagccaagacgtaggaagtgaagaaatacgtatggtaggactacgtggtggaacgggggtacgtaacttcgtaacctacgttttacccgaaaggtaacgtaaaccgaaaccggtaccccgaaaaggaaaccttaccgtaaagtttcggttaaattacccgtaggtaacctaaaagttacgggaaccctaacggacccgttacgggaaaccggtaaacccccgggaagggaaccccgtaacggggtcctttacggtttttaaactttccggttacggtttcgggcccggggttaccgttacgggggtaccctaacgggttaaacccggggtaaaaaacccgttacccggggtacggggggtaaaccccgaaccggggggttaaaccccccgttggggttaaaccccccgg

SEQ ID NO: 13109 - DNA, 583 bp, Homo sapiens
  misc_feature: GYAE6OF01EL1LW.3.59.F04.1.454.CMB.1.raw
  modified_base (194)..(194): a, c, t, g, unknown or other
  misc_feature (194)..(194): n is a, c, g, or t
  modified_base (205)..(205): a, c, t, g, unknown or other
  misc_feature (205)..(205): n is a, c, g, or t
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgngttttttaggngcaggctggtgggaggtcggggggaggcgttgggtcccaggcccgttgggggggtcccctggagacctctcctgtgcagccctctggattcacctttagtagctcttggatgaacttgggtccgccagtcctccgagggaaggggctgggagtgggtggccaacgttgaagtccagatggaagtgaagaaatactatgtggactcgtgtggaggggacattcactattccagagacaacgccaagaactcaattcgtatcgtagacaaagtcggaacagcctaggacgacccgaggacacggtctgtttattcgtgttggccggtacgtgggcacgtacggaaacctcgtacggggaccacgggtaccctggtacccg

SEQ ID NO: 13110 - DNA, 579 bp, Homo sapiens
  misc_feature: GYAE6OF01A749D.3.59.F04.1.454.CMB.1.raw
  modified_base (321)..(321): a, c, t, g, unknown or other
  misc_feature (321)..(321): n is a, c, g, or t
  modified_base (341)..(341): a, c, t, g, unknown or other
  misc_feature (341)..(341): n is a, c, g, or t
  modified_base (417)..(417): a, c, t, g, unknown or other
  misc_feature (417)..(417): n is a, c, g, or t
tcagagacgcactccacgaccggtgctcgatttagtacacacacttagggaggttggggaggtctacaggagagggagccggttagccctggaactccaagggcctttccacttggtcgagtctagctactgagtcacagaggactcaccagtggaacttggggccgtgtagtctcgggtttccttgttcgcctacttttaggaaggtggcctagtgtggacggtgcgagctggtggagtcggggggagcttggtccagcctgggggttccctgacgactactacctgtgtcagccttcgtcggatcaaacctttaggtanctctggatgaactgggtccncagtctcgaggacgggctggagtgggtcgcaacgttgaagccaggagtgggaacgtgaagaaatctatgtgactcngtgagggcatcacattcagagacaacgcaagactctattgtatctagacaaatggactagtcctagtacgtacccggtaggacgacgggctggtttattcgtaggtcgacggtctggggcagtacggaaactcgtacgggaccacgggtaccctggtacccg

SEQ ID NO: 13111 - DNA, 685 bp, Homo sapiens
  misc_feature: GYAE6OF01B3144.3.59.F04.1.454.CMB.1.raw
  modified_base (173)..(173): a, c, t, g, unknown or other
  misc_feature (173)..(173): n is a, c, g, or t
  modified_base (239)..(239): a, c, t, g, unknown or other
  misc_feature (239)..(239): n is a, c, g, or t
  modified_base (258)..(258): a, c, t, g, unknown or other
  misc_feature (258)..(258): n is a, c, g, or t
  modified_base (308)..(308): a, c, t, g, unknown or other
  misc_feature (308)..(308): n is a, c, g, or t
  modified_base (317)..(317): a, c, t, g, unknown or other
  misc_feature (317)..(317): n is a, c, g, or t
  modified_base (335)..(335): a, c, t, g, unknown or other
  misc_feature (335)..(335): n is a, c, g, or t
  modified_base (384)..(384): a, c, t, g, unknown or other
  misc_feature (384)..(384): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcggtgtttcgtcgtaggccnttagagtgcagtgtgagtgctgctggtggagtcgggggagcgttggccagccgtgggggtccctgngctctctgtgccagtcctntggactttcaaccgttttgactcctcgtttggattggacgttcggggccncaggttccncgaggggacggctagggngtgggtcgacctaagttgaacgcaggagtaggagttgaagtaatatagngtcgtacgtgtaggtaggacgggtactattccaaccctgtttaccgagacggacaccgacgaacgtactactaagtttcgacttagttcgaagtaagtacggacttaacggtccctaggtacccgtaaaccgggaacggccggtacccgttaggtttaccgttttaagtttttcccgggacgggttccggtccggtacccggtacgggtcccgttaacgggttaaacgggaaaccccggttttacggtacccgggggaacccggtaaacccggggtaaccccgtttggggttaacccccgg

SEQ ID NO: 13112 - DNA, 549 bp, Homo sapiens
  misc_feature: GYAE6OF01EIZXG.3.59.F04.1.454.CMB.1.raw
  modified_base (446)..(446): a, c, t, g, unknown or other
  misc_feature (446)..(446): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgagggaaggggctggagtgggtggccaacttgaacgccaagagtggaagtggaagaaatacgtatggtggactcgtgtggaggggacattcacctatttccgagacgacaacgcaaagactcattgtatcngacaatgacagcctgacgacccgagacacggtcttgtttattctgtcgcggtcctgggcagtacggaaaactcggagggacccagggtaccccgtggtacccg

SEQ ID NO: 13113 - DNA, 593 bp, Homo sapiens
  misc_feature: GYAE6OF01BZGNB.3.59.F04.1.454.CMB.1.raw
  modified_base (187)..(187): a, c, t, g, unknown or other
  misc_feature (187)..(187): n is a, c, g, or t
  modified_base (296)..(296): a, c, t, g, unknown or other
  misc_feature (296)..(296): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcggtggttcgtgtagcattagaggtgcagtgtgngtgcagctggtggagtcgggggagcttggtccagccgtggggggtcccctgagctctcctgtgcagcctctggattcacctttagtagctcttggatgaactgggtccnccagtctcgagggagggctggagtgggtggccacgttgaacgccaagagtggaagtgaagaaatactagtggtaggactcgtggtggagggggtactagttcaaccctatttccgaggacgaacaaccgaccaaagaacctactaattgtaatcgtagactaaagtcggaacagtccgtaggaaccgacccggaacggacgacggtcttagtttatttcgtggtcgcggtcgtcgggtctacgtaccggaaacgttcgggtacggggacccgtaacggggtacccgtgggtaccccg

SEQ ID NO: 13114 - DNA, 553 bp, Homo sapiens
  misc_feature: GYAE6OF01EOC2K.3.59.F04.1.454.CMB.1.raw
  modified_base (508)..(508): a, c, t, g, unknown or other
  misc_feature (508)..(508): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtgggttttcctgttgccattttagaaggtggccagtgtgaggtgcagctggtggagtcggggggaggcttggtccagccgtggggggtccctgagactctcctgtgcagcctctggatttcacctttagtagctcttggatggaactgggtccgccagtcgtccgagggagggctgggagtgggtggccaagttgaagccagatggaagtgaagaaatactatgtaggacttgtgtaggagggacgtagttcacctattccgagtagaacgaacgaccaagaactcattagtatctagacaatgacagctagacgacccgagacgacggtcttgtttattcgtgtcgcgtcgnggcacgtcggaaacgtcgagggaccagggtaacccgtggtacccg

SEQ ID NO: 13115 - DNA, 558 bp, Homo sapiens
  misc_feature: GYAE6OF01BQNX0.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgagggaggggctggagtgggtggccaacttgaagccagatggaagtgaagaaatactatgtggactctggtggaggggacgtattcacctatttccaagacgaacaacgaccaaagaactcagttgtatctgacaaatggaacagcctagacgacccgaggaccacggtctgtttattctgtcgcggtcgtgggcacgtacggaaaacttcggcggggaccaacggggtacccgtggtacccg

SEQ ID NO: 13116 - DNA, 575 bp, Homo sapiens
  misc_feature: GYAE6OF01BKO9B.3.59.F04.1.454.CMB.1.raw
  modified_base (307)..(307): a, c, t, g, unknown or other
  misc_feature (307)..(307): n is a, c, g, or t
tcagagacgcactccacgaccggtgctcgatttagtacacacacttagggattggggaggtctcagagaggagccttagccctggactccaaggcctttccacttggtgatcagcactgagcacagaggactctaccatggaattggggctgagctgggttttccttgttgccattttagaaggtggccagtgtgaggtgcagctggtggagtcggggggagcttggtccagcctggggggtccctggagactctcctgtgcagcctctggattcacctttagtagctcttggatgaactgggtccnccagtctccgagggaaggggctgggagtggggtggcctaacttggaagccagatgggaagtgagaaatctatgtggactcgtggtgaggggacattcacctatttccagacgacaacgaccaagaactctattgtatcgtgacaagtggaacagcctaggacgacccggaggacgacggcttgtttactttcgtgttggccggtccgtggggccagtaccggaaacgtaccgtcgggggacccgaggggtaaccccgttgggtacccg

SEQ ID NO: 13117 - DNA, 819 bp, Homo sapiens
  misc_feature: GYAE6OF01BJK92.3.59.F04.1.454.CMB.1.raw
  modified_base (309)..(309): a, c, t, g, unknown or other
  misc_feature (309)..(309): n is a, c, g, or t
tcagagacgcactccacgaccggtgctcgatttagtacacacacttagggattggggagggtctcagagaggagccttagccctggactccaaggcctttccacttggtgatcagcactgagcacagaggactcaccatggaattgggctgagctggtttcctgtgcctatttagaggtggccagtgtgaggtgcagctggtggaggtcggggggagcgttggtccaggccgtggggggtccctggagactctcctgtgcagcctctggattctacctttagtagctcttggatgtaacgtcgggtccnccacgtctaccggaggggaagggctgggacgtgggtcggacctaaacgttgaaacgccgaaggagtagggaaaggtagaaaggtaaaactacgttaagtcggttacggaaccttcggtagggttacgggaacgggggtaaccgtacgtttacccgaaccgttaaccgttttaccccggaaggtaacggaaacccgaaacggtaacccctaaaacggtaacccttacgtaacgtttaggttaactaccggttaggaacgttaaaacgtacgggtaaacccgtaagggtaccccgtttaaggggaaacccggtaaccccggggaacgggtaaacccgtaccggggtaccgttttacggtttttaacgttttccggttaagggttccggggtacccgggttcccggtaagggggtacccttaaaccggttaaacccgggtaaaacgttacccgggttccggggggaaacccccggttaacggggtaaaccccccggttcggggttaacccccg

SEQ ID NO: 13118 - DNA, 615 bp, Homo sapiens
  misc_feature: GYAE6OF01A1HLY.3.59.F04.1.454.CMB.1.raw
  modified_base (260)..(260): a, c, t, g, unknown or other
  misc_feature (260)..(260): n is a, c, g, or t
  modified_base (266)..(266): a, c, t, g, unknown or other
  misc_feature (266)..(266): n is a, c, g, or t
  modified_base (305)..(305): a, c, t, g, unknown or other
  misc_feature (305)..(305): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcggtggtttcgtgtaggccgatttagaaggtgccagtgtgaggtgcagctggtggagtggggggaggcttggtccagccgtggggggtccctgagctctcctgtgcngccctntggattcacctttaagtgctcttggatgaactgggtccncagtctccgagggagggctggagtgggtgccaacgttgaacgccagagtggaagtgagaaatactaagtggtgactgtagtggaggggacctattccgaccgttattaccgaaggtacgaaccgtaaccgaccaaagtaactactaagttgtacttcctagactaagtacgaactacgcgtacgacgaccggagaccgtaccggtagttgtttaacctttgtggtcggtccggcggtgggtacccaggtaacccggtaaaacgtccgggttacgggaccgtaaccggggtaaccccgttgggtaaccccg

SEQ ID NO: 13119 - DNA, 558 bp, Homo sapiens
  misc_feature: GYAE6OF01D2YT5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagccgtggggggtccctgagactctcctgtgcagcctctggattcaccttttagtagctcttggatgaacgtgggtccgccagtctccgaggggaggggctggagtgggtgccaacttgaagccagatggaagtgagaaatactatgtggactcgtgtggaaggggacgattcacctatttccgagagacaacgaccaaagactcattgtatctgacaatcggaacacgcctagacgacccgaggacacggcttgtttatttcgtgtcggcggtccgtgggcagtacggaaaactcggtacggggacccgaacgggaccctggtacccg

SEQ ID NO: 13120 - DNA, 591 bp, Homo sapiens
  misc_feature: GYAE6OF01BUNEP.3.59.F04.1.454.CMB.1.raw
  modified_base (311)..(311): a, c, t, g, unknown or other
  misc_feature (311)..(311): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttccttgttgcctattttagaaggtggccagtgtgaggtgcagctgggtggaggtcggggggaggcgttggtccaggccgtggggggtccctggagactcgtcctgtgcagcctctggattcacctttagagctcttggatgaactgggtccncagtctccgagggaagggctggaggtgggtcggacctaacgttggaagccaaggagtagggaaagtgaagtaaatactagtgtgaacttcgtaggtggaggggactattcaactatttccagtagacaacgaccaaagaactacaattgtatctagtacaaagttcggaacacgtcccgtagaacgaacccgaggaccacggtcttagtttattcgtgtgccgtcgtggcacgtaacggaaaactcggtacgggaccgaacgggtacccgtgggtacccg

SEQ ID NO: 13121 - DNA, 566 bp, Homo sapiens
  misc_feature: GYAE6OF01AO3GV.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtcccctggagactctcctgtgcagcctctggattcacctttagtagctcttggatgaactgggtccgccagtctccgagggaaggggctgggagtgggtggccaacttgaagccagatggaagtgaagaaatactatgtggactctgtggagggacgattcacctatttccagacgacaacgaccaagaactcattgtatctgacaaagtggaacagccgtagacgacccgaggaccgacggcttagtttatttcgtgtgccgggtccgtgggcaagtccggaaaacgtccggacggggacccgacggggaccctgggtacccg

SEQ ID NO: 13122 - DNA, 734 bp, Homo sapiens
  misc_feature: GYAE6OF01CWED2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttccttgttgcctattttagaaggtgccagtgtgaggtgcagctggtggaggtcggggggagcgttggtccaggccgtggggggtcccctggacgactctccgtgtgcagcctcgtggtacttcgtacctttagtagtctcttggatgtaacgtcgggtccgtccagtcgtccgagggaaggggcgtaggaggtgggtcggaccgtaacgttcgaacgccgaagtagtagggaagtagaaagtaaactaacgttaagtggtacgtaacgttcgtaggtagggaagggggtaacgtacgttaccgaaccttaacgtttaccgaaacgaacgaaaccgaaaccgtaacccgaaaacggaaccttaccgtaaagtttaggtaacttacgtacgaacgtaaaagtcggaacgaacgtacccgtacggaaaccggaacccggaaggaacccgtacgggtacttacgttttaacgtttccgttggtacgggccggttccggtcggtacgtaaacggtaaccggtaaaaccgttaccgggtaccggggacccggtaaccgggtaaccccgtggttaaccccgg

SEQ ID NO: 13123 - DNA, 641 bp, Homo sapiens
  misc_feature: GYAE6OF01A2IOY.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtgggaggtcggggggaggcgttggtccgaggccgtggggggtccctggagactctcctgtgcagcctctggattccacctttagtagctcttggatgaactgggtccgccagtctccgaggggaaggggctgggaggtgggtggcctaacttgaacgccgaagatgggaagtgaagaaatactagtgtaggactgtgtggagggactatcacctattcagacgacaacgccaagaactcaattgtatctgacaaagtcggaactacgtccgtacggaaccgtacccggaggaaccgacgggttcgtttacgttttaacgttttccgtggttacggtccgggtaccggttggggacctaaacggtaaccggtaaaaaccggttccgggtacggggaccccggtaacggggtaaccccgtgggttaacccccgg

SEQ ID NO: 13124 - DNA, 570 bp, Homo sapiens
  misc_feature: GYAE6OF01ACPWN.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcgaccatggaattggggctgagctgggtttcctgttgccatttagaaggtggccagtgtgaggtgcaggctggtggaggtcgggggaggcgttggtccgagcctggggggtccctggacgactcgtcctgtcgcagcctctggattcgacctttagtagctcgttggatgaactggggtccgaccgggctccgaggcgaaggggctgggagttggggtggctagttatacgtccatcgatggagcaagtaactcctacgcagctcgtagacggcattcacctatcctaccagaacgactaattccaagaaccacgactagtactcgtgacaaattcgaacagccgtaggaagcgtactagaacggtacgacggtacgtggtagtattacgtggtgaccggagaacgtattacggagtcgggtcgtaagttaaccggg

SEQ ID NO: 13125 - DNA, 585 bp, Homo sapiens
  misc_feature: GYAE6OF01CW2EH.3.59.F04.1.454.CMB.1.raw
  modified_base (314)..(314): a, c, t, g, unknown or other
  misc_feature (314)..(314): n is a, c, g, or t
  modified_base (447)..(447): a, c, t, g, unknown or other
  misc_feature (447)..(447): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggaggtcggggggaggcttgggtccagccgtggggggtccctggagactctcctgtgcagccctctggattcaccttttagtagctctttggatgaactgggtccnccagtctccgagggaaggggctgggagtgggtgccaacgttgaagccagatggaagtgaagaaatactagtgtggactcgtgtggaggggcgaattcgacctatttccagacgaacgaacgaccaagaacctnattagtactctagactaaagtggaacagcctagacgaacccggaggaccgacggcgttgtttaactttctgtcggtccggcgtgggaccagtacggaaaacgtcgtacggggaccgaacgggaacccgtcggtacccg

SEQ ID NO: 13126 - DNA, 697 bp, Homo sapiens
  misc_feature: GYAE6OF01DSKLC.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcgttggtccagccgtggggggtccctggagactctcctgtgcagcctctggattcacccttttagtagctcttggatagactgggtccgccagtctccgagggaagggctgggagtgggtcggccaacgttgaagccagatgggaagtgaagtaaatactatggtggacttcgtggtggaagggggtacgtactttaccgaacccttacttttacccgaaggtaacgaaccgaaaccgacccaaaacggaacctcctaatttagtaacttaccttaggaacctaaagtcgggaaccaggaccctaggtaacggaaccccggaagggaacccgaccgggtactttaggtttttacgttttccgtgggttacggtcccgggtcccgttagggggccttaacggtaaccgggaaaaacccgttaccgggtacggggggacccccgaacgggggtaacccccgttggggttacccccg

SEQ ID NO: 13127 - DNA, 733 bp, Homo sapiens
  misc_feature: GYAE6OF01DUM5O.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtgccagtgtgaggtgcagctgggtggaggtcggggggaggcttgggtccaggccgtggggggtccctggagactcgtcctgtgcagtcctgtggacttctaaccgtttagtagcttcgttggatggaactcgggtccaccgacgtcctaccggaggggaacgggccgtagggtacgtgggtcggtaccctaagttagaacgccgtaaggagtagggaaagtgaaaggtaaatacgtaagtggtacgtacttcgtaggtggaacggggtaaccgtagttacccaaccgttactttaccgaaggtaacgaaaccgaaccggaaccaaagtaacctcttaacgttacgtactacgtaggaacctaaagtacggaacgtaaccgtcccgtacgggtaacggaaccccggaagggaaccgtacggttaccgttagttttacttaccgttggttccgggtcggtacccggtgggtaccgtaacggttaaaccgggaaaacgttaaccgggtacggggaacccggaaccggggtaaaccccgttgggtaacccccg

SEQ ID NO: 13128 - DNA, 579 bp, Homo sapiens
  misc_feature: GYAE6OF01AU1O6.3.59.F04.1.454.CMB.1.raw
  modified_base (447)..(447): a, c, t, g, unknown or other
  misc_feature (447)..(447): n is a, c, g, or t
  modified_base (513)..(513): a, c, t, g, unknown or other
  misc_feature (513)..(513): n is a, c, g, or t
  modified_base (526)..(526): a, c, t, g, unknown or other
  misc_feature (526)..(526): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggaggcgttgggtccaggccgtggggggtccctgagactctcctgtgcagcctctggattcacctttagtagcttcttggatgaacgtgggtccgcagtcctccgaggggacggggcgtgggaggtgggtggcctaagttggaacgccagagtaggaagtgaagaatactagtgtgactcgtggtggagggactattcacctattccagacgacaacgccaagaactntattgtatctagacaaagtcggaacagccgtagaccgaccgaggaccacggtcttagtttattcgnggtcgcggtccgngggtccagtaaccggaaactcgggacgggaccgacgggtacccgtggtacccg

SEQ ID NO: 13129 - DNA, 597 bp, Homo sapiens
  misc_feature: GYAE6OF01BI7FS.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagccgtggggggtccctgagactctcctgtgcagcctctggattcacctttagtagctcttggatgaactgggtccgccagtcctccgaggggagggctgggagtgggtggccaacgttgaacgccagatggaagtgaagaaatactagtgtagacttcgtggtggaggggacgtattacacctatttccgagagaaccaacgaccaaagaactcattgtatctgactaaatcggaacacgtccgtagacgacccgaggaccgacggtcttgtttacgtttcgtggttcggccgggtccgtcgggcacgtaccggtaaaacgttaccggtacggggacccgaacgggtaacccgttcgggtacccg

SEQ ID NO: 13130 - DNA, 562 bp, Homo sapiens
  misc_feature: GYAE6OF01ENH3L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtcccctgagactctcctgtgcagcctctggattcacctttagtagctcttggatgaactgggtccgccagtctccgaggggaagggcgtgggagtgggtggccaacgttgaagccagatggaagtgaagaaatactatgtggtactttggaggaggggacgtattcacctatttccgagtagacaacgccaagaactcattgtatctagctaatgggacagcctagacgacccgaggacacggtcttgtttacttcgtgtgccggcgtgggctagtaccggaaactacggtcggggaccagggaccctggtcctacccgg

SEQ ID NO: 13131 - DNA, 571 bp, Homo sapiens
  misc_feature: GYAE6OF01BJHM2.3.59.F04.1.454.CMB.1.raw
  modified_base (263)..(263): a, c, t, g, unknown or other
  misc_feature (263)..(263): n is a, c, g, or t
  modified_base (338)..(338): a, c, t, g, unknown or other
  misc_feature (338)..(338): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagccgtggggggtccctggagactctcctgtgcngcctctggattcacctttagtagcttcttggatgaactgggtccgccagtctccgagggagggctgggagtgggngccaacgttgaacgccagatggaagtgaagaaatactatgtggacttcgtgtgggacggggactattccacctatttcccagacgacaacgccaaagaactcattgatctagacaagtcgaacacgctagacgacccgaggacacggcttgtttactttcgtgtcggccggtcgtgggccagttaaccgggaaactcggtacggggaccgaacgggtacccgtgggtaccccg

SEQ ID NO: 13132 - DNA, 551 bp, Homo sapiens
  misc_feature: GYAE6OF01ATOJ3.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttgggtccaggccgtggggggtccctggagactctcctgtgcagcctctggattcacctttagtagctcttggatgaactgggtccgccagtctccgagggaacggggctgggagtggggtggccaacgttgaagccagatggaagtgagaaatactatgtggactctgtggaggggactatcactacttccagagacaacgccaagaactcatgtatctagacaagtggacagcctagacgacccggagacacggcttgttattcgtgtgccggcgtggcacgtacggaaacgtacgtcgggaccgacgggtacccgtggtacccg

SEQ ID NO: 13133 - DNA, 821 bp, Homo sapiens
  misc_feature: GYAE6OF01BB44R.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtggtgggaggtcggggggagtcgttggtccaggccgtggggggtccctggagactctcctgtgcagcctctggacttccacctttagtacgtcttcgttggatcggaacgttggggtcccgccgagttcctccggaaggggacggggcgtagggaggttggggtcggacccgtaaacgtttcggaacgccgaagagtagggaaagtaggaaagtaaaattacgttagtaggtacgggtacttcggtaggtagggaacgggggtacgtacgtttaccaacccttaacgttttacccgaagtaacgtaaaccgaaacccggaacccgaaaacggtaaccctactaacgtttacgttaacttacgtaacggtaactaaaaggttcgggaaacctaacgggtacccgttaaccgggaacccggtaaccccggggaaacgggtaacccggtaccgggttaccgttttaacggtttttaccgtttttaccggttacgggttaccgggtcccgggttcccgggtacggggtacccgtaacggttaaacccgggtaaaaccgttccggggtacgggggtaaccccggtaaccggggtaaaccccggttcgggtaaccccccgg

SEQ ID NO: 13134 - DNA, 556 bp, Homo sapiens
  misc_feature: GYAE6OF01CRSOM.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactgggtccgccagtctccgagggaggggctgggagtgggtgccaacttgaagccagatggaagtgagaaatactatgtggactctgtgagggacgattcaccatttccagagacaacgaccaagactacattgtatctgacaaagtgaacagcctagacgacccgaggaccgacggtcgttgtttattcgtgtcggtccggtccgtgggcctagtacggaaaacctacgtcggggaccaacggggaccctgggtacccg

SEQ ID NO: 13135 - DNA, 734 bp, Homo sapiens
  misc_feature: GYAE6OF01DUWRE.3.59.F04.1.454.CMB.1.raw
  modified_base (307)..(307): a, c, t, g, unknown or other
  misc_feature (307)..(307): n is a, c, g, or t
  modified_base (377)..(377): a, c, t, g, unknown or other
  misc_feature (377)..(377): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttcctgttgcctattttagaggtgccagtgtgaggtgcagcgtggtggaggtcggggggagcgttggtccaggccgtgggggtccctgagactctccgtgtgcacgcctctggtattctacctttagagctctggatgaactggtccnctagtctcgagggaggctggagtgggtgcctaagttgaacgccaagagtggaagtgaagtaaatacgtanggtagactcgtgtggaagggtacgtacgttaccgaaccttacgtttaccgaagtacgaaccgaaaccgaccaaacggtaaccttactaagtttagtaattcgtacgaactaaacgttaggaaccgtaacgtacccgttagggaacccggtaacccggaacgggtaaccgtaccgggttacgtttacggtttttaaccgttttccggttacgggttccgggtaccgggttcccgggttacgggggtaaccgttaaccgggtaaacccggggttaaaaaacccggttccggggttaacccggggggaaccccggttaaacccgggggttaaacccccgttaccggggttaaccccccgg

SEQ ID NO: 13136 - DNA, 825 bp, Homo sapiens
  misc_feature: GYAE6OF01B0CW7.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttcctgttgcctattttagaaggtggccagtgtgaggtgcagcgtggtggaggtcggggggagtcgttgggtccgaggtccggtggggggtcccctggacgtactctcctgtcgcacgtcctcgtggtacttctaacctttagtacgtccgtcgttggatggtaacgtcgggtcccgccgtacggtccgtcccgaagggggtaacggggcgtagggtagggttcggggtcggtacccgtaaacgttcggaaacggtcccgaaggtaagtagggaaagtagaaagtaaaagttacgtaagtggtacggtacgttcgtggtagggaaggggtaacgtacgttaccgacctaacgtttaccccgaaggtaacgaacccgaaacggaacccgaaaggtaaaccctacgtaaagttttacgtaacttccgtaacgtaactaaaggtacggtaaccaacggtaccccgtaacggggtaacccggaacccgggtaacgggaacccggtaccggttaccggttttacggtttttaacgtttcccggttacggttccgggtacccggtaccgggttcgggtaacccgtacggtaaaaccggtaaacccggttaccggggtaccgggggtaaccccggtaaaccggggttaaacccccgtcgggttaaacccccgg

SEQ ID NO: 13137 - DNA, 554 bp, Homo sapiens
  misc_feature: GYAE6OF01DULGC.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagtagctcttggatgaacgtggtccgcagtctcgagggagggctggagtgggtgcaacgttgaagccagatgggaagtgaagaaatacgtagtgtaggtactcgtggtggaggggtacgtattcacctatttccgaagtacgaacaacgaccaagactcattgtatctgacaaagtgacagcgtgacgacccgagacacggtctgtttattcgtgtggtcggtccgtgggcagtacggaaactcgtacggggaccacgggaacccgtggtacccg

SEQ ID NO: 13138 - DNA, 1040 bp, Homo sapiens
  misc_feature: GYAE6OF01D0FPU.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagtcgttgggttttccttgttgcctattttagaggtggcagtgtgaggtgcagcgtgggtgggaggtcggggggagtcgttgggtccgaggtcccggtggggggtccctggacgtaccttccgtcctggtcgaccgtacggtcccttcgtcgggttaactttaccttaacccgtttttagggtacgttcccgtttaccgttttaggggaattcggggtaaacccggtttcggggggttcccccgtacccgttaacgggtttccccgttaacccggggaaaggggggtaaaccggggggttccgttaggggggtaaacggggtttcggggggtaccgggtaaccccgttaaaacgggtttacgggaaaacggttaccccggaaagggttaacgggttaaagggggtaaaacgggttaacggttaaaaaggggtaaaaaaccgtttaccggttaaaaggttaggggtttaacggggtaaccccgttttagggttacggggttaagggggtaaacccgggggggtaactttaaaccgtttaacccggtaacccgtttaaccgttttaaccccggaaacgggtaaacccggttaaaacccggaaacccggtaaccccgtaaaacgggtaaacctttacgttaaacgttttacggtttaaacctcgtttaaaccggaacttaaacgggtacgggtaaaccgtacggtaccccgtaacgggaacccggaaacccgggaggtaaaccggttaccgggttagtttaccggttttacgttccgtttcgggtccgtccgggggttacgttaccggggacttaccgggttaaaccggaaaaccggtttccgggaacgggggtaccctaaaccgggggtacccggttaccggtaacccggg

SEQ ID NO: 13139 - DNA, 554 bp, Homo sapiens
  misc_feature: GYAE6OF01EI351.3.59.F04.1.454.CMB.1.raw
  modified_base (333)..(333): a, c, t, g, unknown or other
  misc_feature (333)..(333): n is a, c, g, or t
  modified_base (486)..(486): a, c, t, g, unknown or other
  misc_feature (486)..(486): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagccgtggggggtccctgagactctcctgtgcagcctcgtggattcacctttagtagtctcttggatgaacgtgggtccgcagtctccgagggagggctggngtggtgccacgtgagcagatggaagtgaagaaatacgtatgtagactcgtggtggagggacgtattaccacctagtttccaaggtacgaactaaccgaccaaacgtactactattgtatctagacaagtgacagccgtagacgaccgaggacncgtcttgtttattcgtgtcgcggtcgtggcagtacgaaactcgacgggacacggacccgtggtacccg

SEQ ID NO: 13140 - DNA, 560 bp, Homo sapiens
  misc_feature: GYAE6OF01CJ2G6.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtagctcttggatgaactgggtccgcagtctccagggaaggggctggagtgggtgccaacttgaagccagatggaagtgagaaatactatgtgactctgtgagggacattcacctatttccagagacaacgaccaagaactcattgatctgacaaatggacagcctagacgacccgaggacacggcttagtttactttcgtgtcggcggtaccgtggggcctaagtaccggaaaactcggtacgggggccctaacggggtaaccccgtggtaaccccg

SEQ ID NO: 13141 - DNA, 698 bp, Homo sapiens
  misc_feature: GYAE6OF01B3PUD.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctgggtggaggtcgggggaggcgttggtccagccgtggggggtccctgagactctcctgtgcagcctcgtggattcacctttagtagtctcgttggatgaactgggtccgcagtctccgagggacgggctggagtgggtgacctaagttgaagccaagagtaggaagtagaagtaaattactaagtggtacggtactcgtaggtagggaacggggtacgtaactttaccgaaccgttaacgttttaccgaaggaacgtaaaccgaaaccggacccgaaaaggtaacccttactaacgtttagttaaccttacgtaacgtaactaaaacgttacgggaactaaccgtcccgtacgggaacggtaaccccgggaagggaacccgtacggtcgtttacgttttaacgtttcgttagggtcggtaccggtcggtcgggtactaacgtaaccggaaaacgtcggtacgggacccgaacgggtaacccgtcggtaaccccg

SEQ ID NO: 13142 - DNA, 598 bp, Homo sapiens
  misc_feature: GYAE6OF01DTW13.3.59.F04.1.454.CMB.1.raw
  modified_base (316)..(316): a, c, t, g, unknown or other
  misc_feature (316)..(316): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtggaggtcgggggggaggcgttgggtcccaggccgtgggggggtccctgagactctcctgtgcagcctctggattcacctttagtagctctggatgaactgggtccncagtctccgagggagggctggagtgggtggccaattgaagcagagtggaagtgaagaaatactatgtggactctgtggagggacgattacacctatttccagagacaacgaccaagaactacattagtatctgactaaagtggaacacgcctaggacgacccggaggaaccacgggtcttagtttactttcgtggttcggccggtccgttcgggccaaaggtaccggaaaaaccgttccgggacgggggtacccggaacggggtaaccccgtgggtaccccg

SEQ ID NO: 13143 - DNA, 617 bp, Homo sapiens
  misc_feature: GYAE6OF01BEO8C.3.59.F04.1.454.CMB.1.raw
tcagagacgcactccacgaccggtgctcgatttagtacacacacttagggattggggaggtctcagagaggagccttagccctggactacaaggcctttccacttggtgatcagcactgagcacagaggactcaccatggaattggggctgagcttgggttttccttgttgcctattttagaaggtggccagtgtgaggtgcagcgtgggtgggaggtcgggggggaggcgttgggtccaggccgtgggggggtcccctggacgactctccgtgtgcagcctctggattcacctttagtagcttcttggatgaactgggtccgccagtctccgagggaaggggctgggaggtgggtcggcctaacgttgaagccgaagtacgtggaagtgaagaaatactagtgtggactcgtgtggaggggacgtattccaacctactttccaagaacgacaacgaccaaagtaactactattgtatctagacaaagttcggaacagaccgtagaacgacccgaaggaccacggcttacgttttattcgtagtcgcgggtctgggtcaaggtaccggtaaaacgtcgggtacgggaccggtaacgggtaccccgtggttaccccgg

SEQ ID NO: 13144 - DNA, 841 bp, Homo sapiens
  misc_feature: GYAE6OF01DG6QE.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttgtcgcctattttagaaggtcgcagtgtgaggtgcagcgtgggtggagggtcggggggaggtcgttcggtccacgccggtcgggggtcctggacgactctccgtgtcgcacgcctcgtggtattcctaaccttttagacgtcttcgttggatcgaacgtcgggtcccgacgtacgttcctaccggaagggggaacggggtcgtgggtacgggttggggtacggacccgtaaaacgtttaggaaacggtaccgaaggtaacggttaggggaaaagttggaaaaggtaaaaacgtttaacgttaagttcgggtacgggtaacttccggtttagggtacggggaacgggggtaacggttaagtttacccgtaacccgttaacgttttaccccgaaaggtaaccgtaaaccgaaacccggtaaccgaaaacggtaaacccttaccttaagtttacgtttaacgttccgttacgaaccgttaaaagttacgggaaaccgtaacggtacccgtacgggaaccggaaccccgggaacgggaaccgaccgggtcgttttacggttttaacttttccgttaggttcggcccgggtaccgttcggggacctaacggttaaccgggtaaaaaccgttcgggtaccggggtacccgaaaccggggtaccccgttgggtaacccccg

SEQ ID NO: 13145 - DNA, 597 bp, Homo sapiens
  misc_feature: GYAE6OF01BPNBC.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttcctgttgccattttagaaggtggccagtgtgaggtgcagctggtggagtcggggggaggcttggtccaggcctggggggtccctggagctctcctgtgcagcctctggattcacctttagtagctcttggatgaactgggtccgccagtcctccgagggaaggggctggaggtgggtggccaacgttgaagccagatggaagtgaagaaatactagtgtaggactcgtgtgaggggacgagttcactatttccgagtacgaacaacgaccgaaagaactactagttgtaactctagtacaaagtcggaacagaccctagacggaccccgaggaccacgggtactgttttatttccgtgtcggccggtccgtcgggctacgtaacggtaaaacgtaccggttagggacccgtaacggggaccccgtgggtaccccg

SEQ ID NO: 13146 - DNA, 585 bp, Homo sapiens
  misc_feature: GYAE6OF01DNJ8H.3.59.F04.1.454.CMB.1.raw
  modified_base (315)..(315): a, c, t, g, unknown or other
  misc_feature (315)..(315): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagcgtggtggaggtcggggggaggcttggtccagccgtggggggtccctgagactctcctgtgcagcctctggattcacctttagtagctcttggatgaactgggtccgcagtcnccgagggagggttgagtggtgcatgaagcagatggaagtgaagaaatactatgtggactcgtgtgaggggtacattccgactatttaccagaagaccaaacgacccaaagaactctaagtttgtaacttcgtagacaaattcgggaacacgtccgtagacgacccggaggaccacgggtcttagtttattcgtggtacgcgggtccgtgggactacgtacggtaaactacggtcggggaccgacgggtaaccccgtgggtccctacccgg

SEQ ID NO: 13147 - DNA, 705 bp, Homo sapiens
  misc_feature: GYAE6OF01DOSS8.3.59.F04.1.454.CMB.1.raw
  modified_base (321)..(321): a, c, t, g, unknown or other
  misc_feature (321)..(321): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtgggttttccttgttgccattttagaaggtggccagtgtgaggtgcagctgggtgggaggtcgggggggaggcgttggtccaggcccgtggggggtccctggacgactctcctgtgcagcctctggattcctacctttagtagtctcttggatgaacgtgggtccncagtcctaccgaggggaaggggctgggaggtggggtcggacctaacgttgaaacgccaaggagtagggaaagtggaagtaaaattacgtaagttggtacggacttcgtggtagggaagggggtactagttaccaacccttagttttaccgaagtacgtaaccgaaaccggaccgaaacgaacctacgtaactttaggtaactcgttacgaaccaaagttcggaacctaacggtcccgtaggaaccggaacccccgggaggtaaccgacggtacgtttacggtttttactttcgttaggttcggcccggtaccggttcgggctaacgtaacgggtaaaaccgttacgggtacgggacccggaacgggtaacccgtcgggtacccg

SEQ ID NO: 13148 - DNA, 628 bp, Homo sapiens
  misc_feature: GYAE6OF01EGV15.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgccattttagaaggtggccagtgtgaggtgcagcgtggtggaggtcggggggaggcgttgggtccaggccgtggggggtcccctggacgactctcctgtgcagcctcgtggtattcctaccttttagtagtcttcgttggatgaacgtcgggtccgccagtcctccgaggggaggggctgggaggtgggtggacctaacgttggaagccgaagagtgggaagtgaagtaaatactagtgtggactcgtgtaggagggtactattccacctatttccagacgacaacgaccaagactctattgtatcgtagactaatggaacacgacctggaaccggacccggaggaccgacggtcgtttagttttacgtttcgtgtacgggccgggtacgtcgggcctaacggtaaccgggaaaaccttcgggtacggggaccgaacgggtacccgtcgggtaacccg

SEQ ID NO: 13149 - DNA, 546 bp, Homo sapiens
  misc_feature: GYAE6OF01EKLBF.3.59.F04.1.454.CMB.1.raw
  modified_base (486)..(486): a, c, t, g, unknown or other
  misc_feature (486)..(486): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagccgtggggggtccctggagactctcctgtgcagcctctggattcacctttagtagctctggatgaactgggtccgccagtctcgagggagggctggagtgggtggccaattgaagccagatggaagtgaagaaatactatgtaggactcgtggtggaggggacgtagttcaacctagtttccaaggtacgaacgaacgaccgaaagaactcattgtatctgacaatggaacagacgtgacgaccgagacacggtntgtttattctgtcgcgtctgggcagtacgaaactcgagggaccacggaccctggtacccg

SEQ ID NO: 13150 - DNA, 561 bp, Homo sapiens
  misc_feature: GYAE6OF01DE2Z4.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagcctggggggtccctgagactctcctgtgcagcctctggattcacctttagagctcttggatgaactgggtccgcagtctccgagggagggctggagtgggtgccaacttgaagccagatggaatgaagtaaatactatgtggactcgtggtgaggggcaattcacctatttccagacacaacgaccaagaactcattgtatctgacaagtggaacacgacctaggacgtacccgaggaccacggtcttgtttattcgtgtcggccggtcgtcgggctaacgtacggaaacttacggtacggggaccacggggtaacccctgggtaacccg

SEQ ID NO: 13151 - DNA, 555 bp, Homo sapiens
  misc_feature: GYAE6OF01CBHZI.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtgccagtgtgaggtgcagctggtggaggtcggggggaggcttggtccagccgtggggggtccctgagactctcctgtgcagcctctggattcacctttagtagctcttggatgaactgggtccgccagtctccgagggaaggggctgggagtgggtggccaacgttgaagccagagtgggaagtgagaaatactagtgtggactcgtggtgaggggacgattccacctatttccgaagacgaacaacgccaaagactacgtattgtatctgactaaatgacagcctgacgaccgaggacacggctgtttattcgtgtgtcggtctgggcagtcggaaacgtcgtacgggaccacgggtaccctgggtacccg

SEQ ID NO: 13152 - DNA, 896 bp, Homo sapiens
  misc_feature: GYAE6OF01AQQI8.3.59.F04.1.454.CMB.1.raw
tcagagacgcactccacgaccggtgctcgatttagtacacacacttagggattgggggggtctcagagaggaggccttacgtccctcggacgtccaacggaccgtttccctaccttggttggatcagcactgagcacagaggactcaccatggaagttggggtcgtgaggcgttgggtttttccgtttcgttgtcccgtattttttaaggtaaagggtcggccgtagttggtggagggttggcgaggcgtgggttgggaaggggtcgggggggtagggtctttcgggtccgacggtccggttcggggggggttccccgtcgaaggtaccttccgttcccgtggtcgcgaccgccttccgttggtactttccgtaccgttttagtagtccttcgtttaggacgtacgtaaccgttcggggtccccgtccgaggttcccgtccggaagggggaacggggccgtggggaagggttcggggttacgggacctaaaccgtttggaaacggcccgaaggtaagtgggtaaacgtagaacgtaaatacgtagtggtacggtacgtcgtgggtaggaacggggtacgtaactttaccgaacccgttacgttttaccgaggtaaacggaacccgtaaaccggaaccctaaaaggttaaacccgtcttaacggttttagttaacctacggttacgtaaccgtaaaacggttcggaaccgtaacgacccgttacggaaacccgggtaccccggaacgggtaacctaccgggttacgtttagtttttacggttcgttcgggtccggtccgggttacccggtgggtactaaccggttaaaccggaaaaccgtttaccgggcggggtacccggtaaaccggtaccccggttacgggtcccgtaaccccgg

SEQ ID NO: 13153 - DNA, 571 bp, Homo sapiens
  misc_feature: GYAE6OF01AW81V.3.59.F04.1.454.CMB.1.raw
  modified_base (301)..(301): a, c, t, g, unknown or other
  misc_feature (301)..(301): n is a, c, g, or t
  modified_base (412)..(412): a, c, t, g, unknown or other
  misc_feature (412)..(412): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcgtgtagccatttagaaggtgcagtgtgaggtgcagctggtggagtcggggggagcttggtccagccgtggggggtccctgagactctctgtgcagcctcgtggattcacctttagtagctcttggatgaacgtggtccncagtctccgagggagggctggagtgggtgaccaacttgaagccagagtggaagtgaagaaatacagtcgtagacttgtggtggagggacgattacgacctatttccagtanaaccgaacgaccaaggactcgattgtatctgacaagtcgacacgcgtagacgacccgagaccgacggtcttgtttacttcgttggtcggtccggtacgtacgggctacggtaacggaaacgttccggtacgggaccgaccgggtacccgtggtaccccg

SEQ ID NO: 13154 - DNA, 742 bp, Homo sapiens
  misc_feature: GYAE6OF01BZYBZ.3.59.F04.1.454.CMB.1.raw
  modified_base (262)..(262): a, c, t, g, unknown or other
  misc_feature (262)..(262): n is a, c, g, or t
  modified_base (329)..(329): a, c, t, g, unknown or other
  misc_feature (329)..(329): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttcctgtgccatttagaaggtggccagtgtgaggtgcagctggtggagtcgggggagcttggtccagccgtgggggtccctggagactctcctgtgcagcctntggattcacctttagtagctcttggatgaacgtgggtccgcctagtcctccgagggaagggcgtggngtggggtgaccaagttggaacgccgagagtaggaaggtgaagtaaatacgtagtggtggactcgtaggtaggacggggtacgtacgttaccgaccttaactttccgaaggtaacgtaaaccgaaccggaccaaaacggaacccttacgtaatttacggttaaacttccgtacgtaaccgtaaacgttacgggaaacctaacgggtccccgttaagggaacccgggtaaccccggaagggtaacccgtaccgggttaccgtttaccggttttttaaacgttttcccgtaacggggttccggtacccggggtacccggttacggggtaccttaaacgggttacccgggtaaaaacggttcccggtaaccgggggacccgtaaacccggggtaaccccgttcggggttaacccccg

SEQ ID NO: 13155 - DNA, 608 bp, Homo sapiens
  misc_feature: GYAE6OF01DMIXM.3.59.F04.1.454.CMB.1.raw
  modified_base (315)..(315): a, c, t, g, unknown or other
  misc_feature (315)..(315): n is a, c, g, or t
  modified_base (431)..(431): a, c, t, g, unknown or other
  misc_feature (431)..(431): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtggaggtcggggggagcgttggtccagccgtggggggtccctgagactctcctgtgcagtcctctggattccaccttttagagtctcttggatgaactcgggtccnccgagtctccgagggagggctggagtgggtgccaacttgaagcagatgggaagtgagtaaatctatgtggtactcgtgtaggagggactattccactacttcagagacaacgcaanactnattnatctagacaaagtcggaacacgtcccgtaggaaccgtacccgacggtaccgacggttcgttagttttacgttaccgtggttcggtccgggtccgttggggactaacggtaccggtaaaaccgtcggtaccggggacccgtaaaccgggtaccccggtggttaaccccgg

SEQ ID NO: 13156 - DNA, 796 bp, Homo sapiens
  misc_feature: GYAE6OF01A1FS2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttgttgcctattttagaaggtggccagtgtgaggtgcagcgtgggtgggagggtcggggggaggtcgttcgggtccaggtcccggtcgggggggtcccctggacgtaccttccgttccgtggtcgccgacgtcccttcgtggtactttcctaaccgttttaggtacgtcttcgttggtatcggtaacgtcggggtcccgccgtacggttcccgtaccggaagggggaacggggtccggtgggtagggttcggggtacgggtaccccgtaacgtttaggaaaccggccgaaggtaacgtagggtaaaggtaggaaagtaaacgttaacgttaaggtaggtacggtacttcggtaggtacggggaggggtaactacgtttaccaacccgttacgtttaacccgaagggtaaccgaaaccgaaacccgtaaccgtaaacgtaaccttacgttaatttacgtaattaccgttagaacctaaagtcgggtaaccaacgccgtaacgggaaccggaacccgtaagggaccctacggttactttgttttacgttcgttaggtcggccgggtcgtcgggactaacggtaacgaaccgtacgggtacgggacccggtaacggtacccgtcggtaacccg

SEQ ID NO: 13157 - DNA, 562 bp, Homo sapiens
  misc_feature: GYAE6OF01D54E1.3.59.F04.1.454.CMB.1.raw
  modified_base (342)..(342): a, c, t, g, unknown or other
  misc_feature (342)..(342): n is a, c, g, or t
  modified_base (489)..(489): a, c, t, g, unknown or other
  misc_feature (489)..(489): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccatttttagaaggtggccagtgtgaggtgcagctggtggaggtcggggggagcttggtccagccgtggggggtccctgagactctcctgtgcagcctctggattcaccctttagtagtctcttggatgaacgtgggtccgccagtcctccgagggaggggctggagtgggngcaacgttgaagccagagtggaagtgagaaatactatgtggactctggtggaggggacgtattccacctatttccaagagacaacgcgaaagaacctcaagtttgtatctgacaaagtggaacagcctgacgacccgagaccacggnttcgtttattcgtgtggtccggccgtggcagtacggaaacgtcgacgggacccgacgggtaccctggtacccg

SEQ ID NO: 13158 - DNA, 587 bp, Homo sapiens
  misc_feature: GYAE6OF01CQ3DF.3.59.F04.1.454.CMB.1.raw
  modified_base (271)..(271): a, c, t, g, unknown or other
  misc_feature (271)..(271): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtgggaggtcggggggaggcttggtccagccgtggggggtccctggagactctcctgtgcagcctntggattcacctttagtagctcttggatgaactgggtccgcagtctccgagggagggctggagtgggtgccaattgaagccagatggaagtgaagaaatactaagtgtggacttcgtgtggaagggacgattcacctatttccagacgacaacgaccaagaactcattgtatctagactaaagtggaacacgacctaggtacgacccggaggaccgacggtacgttgttttacttcttggtcggtccgggtccgtgggtcctacgtaacggaaaaccgttcggacggggccgaaaccggggacccgtgggtaccccg

SEQ ID NO: 13159 - DNA, 904 bp, Homo sapiens
  misc_feature: GYAE6OF01BUNNZ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaagttggggctgagtcgttgggttttccttgtgcctattttagaggtgcagtgtgaggtgcagcgtgggtgggagggtcggggggagtcgtttgggtccgacggtccgggttcggggggtcccctaggacgtaccttccgtccgtggtcgccacgtcccttcgtggtacttcctaaccgttttagtacgtccttcgttggatggtaaccgtcgggtccgactacgtccgtaccggaaggggaacgggtcgtagggtagggtcggggtcggacctaaggttacgaacggaccgaaggagtaggtaagtaggtaacgtaaatacgtagttggtacgtacttcggtaggtagggtacggggtacgtaacttccgtaacgttaacgtttacccgaaaggtaccgaaaccgtaaacccggaaccgtaaaacggttaaccttaaccgttaagtttacgtttaacgttaccgttaacggtaaactaaaacggttacggaaaccgttaaccgggttacccggttaacgggtaaaccccgggtaacccggggaaacggggtaaccccgttaccggggttaacccgtttttaaggtttttaacccgtttttccggttacggggtttaaccccggggtccgggttacccggggttacggggttaaaccgtaacccgggtttaaaacccgggtaaaacccggttacccgggggtttaccggggaaaccccgggtaaacccggggttaaccccgggttccgggtttaaacccccccgg

SEQ ID NO: 13160 - DNA, 936 bp, Homo sapiens
  misc_feature: GYAE6OF01DUWGB.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcgttggtttccttgttgcctattttagaaggtgcagtgtgaggtgcagctgggtgggaggtcggggggagtcgttggtccagccggtggggggtccctggacgtactcctccgtgtgacacggtcctcgtggtactttcctaacccgttttaggtacgtccgttccgtttgggaactaggttaaaccgttcgggggttaccccgtacccgtaacggttcccgttaccggaaacgggggtaaacgggggtccgtaggggttaacggggttcgggggttaccgggtacccgtaaacgtttagggaaaaccggttcccgaaaggtaacgttagggaaaacgggttaggaaaacggtaaaacgttaacgttaagttcgggtacggtaccgtttacgtagggttagggaacggggggtactaacgtttaccgtaaacccgttaacgttttaacccgaaacgtaacgggtaaacccaaacccggacccgtaaaaaggtaaacccttacgtaaacgttttacgtaaacgtttaccgtacggtaaaccgtaaacgttacgggtaacctaaccggtacccgtaacggtaaaccccggaaaccccgggtaacggggtaaccgtacccgggttaccgttttagggttttttaactttccgggtaacgtttaccgggtcccggtacccggttcggggtaaccgtaaccggtttaaaccgggaaaacccggttaacccgggtttaccgggggaacccggtaaacccggggttaaccccgtttacgggtaacccccgg

SEQ ID NO: 13161 - DNA, 795 bp, Homo sapiens
  misc_feature: GYAE6OF01BCVS9.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggtttctgttgctatttagaggtgcagtgtgagtgcagctggtggaggtcgggggagcttggtccaggccggtggggggtccctggacgacttctcctggtgcagtcccgtctgggtactttacctaaccgttttaggtacgtcgttccgtttagggtaataggtaaaccgttgggggttccccgaccgtaacggtttccgtaccccggagggggtaaacgggggccgttaggggtagggttcgggggtaccgggtaccgtaaaaccgtttgggaaaaccgtccgaaggtagttacggggaaagttaggaaaggtaaaattaccgtaagtgggttacggacttcggtaggtagggtacggggacgtacttacgaaccgttattccgaagacgaaaccgaacgacgaaacgactactaagttactacgtactacgaacgtaaagtacggaacgaaccggtaccgtaacggaaccggtaaccccggggaggtaacccgaccgggttaacgttcggttttaacgtttcggtaggtttccggccgggtcccggttgggggtaccctaagggttaacccccggttaaaaaggtccggtaccgggggaaccccgaacggggttaaccccgtgggttaaacccccg

SEQ ID NO: 13162 - DNA, 810 bp, Homo sapiens
  misc_feature: GYAE6OF01B0GC6.3.59.F04.1.454.CMB.1.raw
  modified_base (334)..(334): a, c, t, g, unknown or other
  misc_feature (334)..(334): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtgggtgggagggtcggggggaggtcgttgggtccaggccggtggggggtccctgacgtactctcctgtgcacgtcctctggtacttctaccgtttagacgtctcgttggatggaaccgttcgggtccnccgtacgtccgtaccggaggggtaacgggcgtagggaggttggggtcggtaacctaacggttcgaaacgtccgaagtagtagggaaagtggaaagaaaacgttacgtaagttgggtacggtaccttcgttaggtacggggaacggggtaacgtacgttacccgtaaccgttacgttttaccgaacggtaacgaaaccgaaaccgtaccgtaaaagtaaccgttactaacgtttagttaacctacgttaacggaacgtaaacgttacgggaacctaacggaccgttaacgggaacccggtaacccgggaacggtacccgtacggttacgtttacggttttaacgtttaccggttggtaccgggtcccggttacccgggtacgggtacccgttaaacgggttaaacccggaaaaccggttccgggtaaccggggtaacccggtaaacccggggtaccccggttacgggtaacccccgg

SEQ ID NO: 13163 - DNA, 785 bp, Homo sapiens
  misc_feature: GYAE6OF01EHRI5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcgtggtttctgtgctatttagagtgcagtgtgagtgcagctggtggaggtcggggggagtcgttggtccgaggtccgtcggggggtccctggacgtacctctcctgtgcagtcctcgtggtattcctaaccgtttagtacgtcttcgttggatcggtaacgtcggggtccgccgtaggtcctaccggagggggaacggggtcgtagggaggtggggtcgacccgtaaagttggaacgaccaaggtagtagggtaagtaggaaagtaaaagttaaccgttaggttggtaggtacgttcggtagggttagggaacgggggtaactacgtttaccgaaccgttagtttacccgaaaggaacgtaaaccgaaaccggacgtaaaacgtaacgttcgtaatttacggtacttcgtacgaactaaacgtggtaaccgacgtcccgtaagggtaacccggaccccggagggaccggtaccggttcgttttaacgttttaccgtttcgtacgggttcgggtcccgggtaccgggttacggggtaccctaaacgggtaaacccgggtaaaacccggtttccgggggtaccgggggaaacccggtaccggggggtaaacccccttcgggggttaaaccccccg

SEQ ID NO: 13164 - DNA, 822 bp, Homo sapiens
  misc_feature: GYAE6OF01DBFLJ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttccttgttgcctattttagaaggtggcagtgtgaggtgcagctggtggaggtcggggggagcgttggtccgaggccgtggggggtccctggacgaccttccgtccgtggtcgacgtccgtccgttcgtacggttacttaccgtttaaccgttttaaggtaccgtttccgttaccggtttaggtacgttaacggtaacggttcccggggtccctaccgtaccgttccgtaccgggaagggggacggggttcggtaggggtagggttcggggtccggtaacctaacggttacggaacgacgaaggtaggtaagggtaaggtaggtaaaagttaaaacgttacttaaggttagggtacgttaccgttaggttagggttaacgggggacggggttaacttaccgttaaccccgtaacgtttaacccttaacggaaaagtaacccggaaaccaaacccgggtaaaccaaacggtaacccttacttaaggtttacgtacttcgaacgtaaagtaagtccggaaactacgtccgtaagggacccgaaccgggtacgaacgtccggttgttttaacgtttcgttacgtcggtcggtccgtagggcgaccgttaggaaaaccgtaacggttcgggaccgggtaaccggtacccggtacgtccggttaacccg

SEQ ID NO: 13165 - DNA, 587 bp, Homo sapiens
  misc_feature: GYAE6OF01BBXDR.3.59.F04.1.454.CMB.1.raw
  modified_base (343)..(343): a, c, t, g, unknown or other
  misc_feature (343)..(343): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagcgtgggtgggaggtcggggggaggcgttgggtccaggccgtggggggtccctggagactctcctgtgcagcctctggattcacctttagtagtcttcttggatggaactgggtccgccagtctccgaggggagggctgggngtgggtgccaacttgaagccagataggaagtgaagaaatactatgtggactcgtgtggagggacgattcacctatttccagtacgacaacgaccaagaactcattcgtatctagacaaagtgacacgccgtggaacgacccggtaggaccgacggtcttgtttactttcgtagttgtccggtcgtgggcgtaacgtacggaaaccgtcggtacggggaccggtaacgggaacccgtggtacccg

SEQ ID NO: 13166 - DNA, 659 bp, Homo sapiens
  misc_feature: GYAE6OF01BTHG7.3.59.F04.1.454.CMB.1.raw
  modified_base (398)..(398): a, c, t, g, unknown or other
  misc_feature (398)..(398): n is a, c, g, or t
  modified_base (443)..(443): a, c, t, g, unknown or other
  misc_feature (443)..(443): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggagcttggtccagccgtggggggtccctgagactctcctgtgcagcctctggattctacctttagtagcttcttggatgaacgtgggtccgcagtctccgaggggagggctgggagtgggtcggccaacgttgaacgccaagagtagggaagtgaagaaatactagtgtggactgtgnggaggggacagttacacctattccgagtagacaacgcaaagactntattgtatctagactaaagtcgaacacggtaccgagaaccggacccggaaggaacccggtcggtacgtttacggttttactttacgttacggttcgggccggtacccgggttacggggtcctaaaccggttaaacccggggaaaaaccctttacggggtaaccccggggtacccgggaaacccgggggttaaacccccgttcggggttaacccccg

SEQ ID NO: 13167 - DNA, 676 bp, Homo sapiens
  misc_feature: GYAE6OF01B4GXM.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtgggaggtcggggggaggcgttggtccagccgtggggggtccctgagactctccgtgtgcagcctcgtggacttctacctttagtacgtctcgttggatggaacgtcggggtccgccagtccgtccgaaggggaacggggcgtgggagggtggggtcggacccgtaacgttggaaacgccaggagtagggaagtagaagtaaatacgtagtggtagactcgtggtggaggggtacgattccgacctactttccgaagtacgaaccaaccgaccaaagaactctaattacgtatcgtagactaaagtggaactagccgtaggacgaacccggacgaccgtacggtcgtttagtttacgtttccgttaggtcggtccgggtccgttacggggtaccgtaacgttaaccgggaaaacgttaccgggtaccgggggaacccgaaccggggttaaccccgtcggggttaccccgg

SEQ ID NO: 13168 - DNA, 693 bp, Homo sapiens
  misc_feature: GYAE6OF01DQ5WW.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggaggtcggggggagcttggtccaggccgtggggggtccctgagactctcctgtgcagccctctggtacttcaacctttagtacgcttcgttggatcgaacgtcggggtcccgccgtagtcctaccgaggggaacggggctgggagtggggtagcccaagttgaacgccaggagtagggaagtagaagaaatactagtggtagactcgtggtaggacgggtactacttccgaacctagtttacccgaagacgaaccgaaaccgaccgaaagtaacctctaagtttcgtaacttcgtacgaactaaaagtcggaaccaacgtcccgtagggaaccggaacccccggtaagggaccctaaccgggtctttaaggtttttacgttccgtgggttcggcccggggtccgttggggaacctaacggtaaccgggaaaaacgttccgggtacgggggaccccgtaaacggggaccccgttgggtaccccc

SEQ ID NO: 13169 - DNA, 779 bp, Homo sapiens
  misc_feature: GYAE6OF01CDB57.3.59.F04.1.454.CMB.1.raw
tcagagacgcactccacgaccggtgctcgatttagtacacacacttagggattgggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggaggtcgggggggaggtcttggtccaggcccgttggggggtcccctgagactcctcctgtgcagcctctggattcacctttagtagctcttggatgaacgtgggtccgcctagtctccgagggaacggggtctgggaggtggggtaggcctaacgttcggaagccgagagtagggaagtaggaagtaaattacgtagtggtggaaccttcgtggtagggaagggggtacgtagtttaccgacccgttatttaccccgaaggaacgtaaccgaaaccggaacccgtaaaggtaaacccttacgtaagtttacgttaacttccgttagacccgtaaaaggtcggaaaccgtaacggtacccgtagggtaacccggaacccccgggaacgggtaaccccgtacccggggttaccttttacgggttttttaaccgttttccggttacgggttccggggtcccgggttacccggttaccgggggtacctaaccggttaaacccggtaaaacccggttacgggtaccgggggtaccccggaaccgggggtaaccccgttcggggttaacccccgg

SEQ ID NO: 13170 - DNA, 577 bp, Homo sapiens
  misc_feature: GYAE6OF01EDHW6.3.59.F04.1.454.CMB.1.raw
  modified_base (308)..(308): a, c, t, g, unknown or other
  misc_feature (308)..(308): n is a, c, g, or t
  modified_base (450)..(450): a, c, t, g, unknown or other
  misc_feature (450)..(450): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctgagactctcctgtgcagcctctggattcacctttagtacgctcttggatgaactgggtccnccagtctccgagggagggctggagtgggtgccaacttgacgccagagtggaagtgagaaatacgtatggtgactgtgtggagggacgtattcacctatttccaagtacgaacgaacgaccaacgaactcattgtactcgtanactaaatcggaacagcctagacgacccgaggacacggtcttggttttacttcgtgtcggccggtccgtgggccaagtaccgggaaaactcggtacgggacccgaacgggtacccgtcgggtaccccg

SEQ ID NO: 13171 - DNA, 599 bp, Homo sapiens
  misc_feature: GYAE6OF01DV57X.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggaggtcggggggaggcgttggtccaggccgtggggggtccctggagactctcctgtgcgagcctctggtattcacctttagtagtctcttggatgactgggtccgcctagtctccgagggagggctggagtgggtgccaactgagccgagagtggaagtggaagaaactaacgtagtggtaggtacttcgtaggtggaagggggacgtacgttaccacctactttccaagtacgaacgaaccgaccaaagactactattagtatctagactaatgacacgccgtagacgacccgagacgacggtcttacgtttacgttctgtcggccggtccgtgggtcacgtaaccggaaacgtcggtacggggcaacccgggacccgtcggtaccccg

SEQ ID NO: 13172 - DNA, 1027 bp, Homo sapiens
  misc_feature: GYAE6OF01CAWFR.3.59.F04.1.454.CMB.1.raw
tcagagacgcactccacgaccggtgctcgatttagtacacacacttagggattggggaggtctcagagaggagccttagccctggactccaaggccttccacttggtgatcagcactgagcacagaggactcaccatggaattggggctgagctgggttttcctgttgccattttagaaggtgccagtgtgaggtgcagcgtggtggaggtcgggggagcttgggtccagccgtggggggtccctggagactcgtccgtgtcgcacgcctcgtggattcctaccttttaggacgtccttgtttacggaattcggtaaacggttcggggtacccgtcccgtaacggttcccgttaccggaaggggggtaacgggggtccgttagggggaaaggggtttcgggggtacgggtaacccccgttaaaggtttaccggaaaacgggtccccgtaaagggaacgttaagggggtaaaacgggttagggaaaaacggtaaaaacgtttaaccgtaaacggtttaggggttaacggggttaaaccccttcgggttagggttaacggggtaaacggggggtaccgttaacgttaccgtaaaccccgttagttttacccccggaaaaggtaaacccggtaaacccgtaaaaccgggaacccgtaaaacggtaaacccttacgtaaacgttttacgggtaacttaccggtacgtaaccgtaaaaggttccgggaaccgtaacgggtaccccgttaacggggtaaaccccgggaaaccccgggtaaacgggtaacccggtaaccgggtttacccgttttaagggttttttaaacccgtttttcccgggtttaaacggggttcccgggttaaccccggggggtacccgtttacccgggggggtaaacccgtttaaaaccgggttaaaacccccggggttaaaaaacccgggtttacccgggggtaaccccggggggggttaaaccccgttaaacccgggggggttaaaccccccgtttacgggggttaaaccccccccgg

SEQ ID NO: 13173 - DNA, 1008 bp, Homo sapiens
  misc_feature: GYAE6OF01DW3MZ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaagttgggctgagtcgtttcgtttcttgtcacttagttaaggaggtcgacgtaggtgaggtaggtcgacgtcgtgggtggggtaggggtacggggggtacgggggtcgttcgggtttaccggaccggtaccgggttccggggggttccggggttacccgtaacggtaaccggttccttcccggttccggttcggtaccgaccgtccgttcccgttcggttaacggttacctttaacccgttttaacggtttaacgtaccgtttccgtttggttaacggtacggttaaaccgggttacccgggttcccgggtccccgtaaaccggtttccggttaccccggtaaacgggggaaaacggggggtacccggggttgggttaagggtttcgggggttccgggtaacccggttaaacccgttaacggtaacgggaacccgaaacggtaaaggttaacggggtaaacgggtaaaggttaaagtaaaaacggtttaaaccgtttaacgttaggggtttaacggttaacgttcccggttaagggttaccggggaaagggggttaaccgtaacgtttaccctaaccgttaaccgttaaccgtaacggaaaccgtaaccgaaaacccgtaaccggaacgtaaaacgtcttaacgttaagttacgttctaacggtacctaaagtacggtaaccgtagacccggttaccgaacgggtaccccggaacggaaccgggtaccgttaacggtttccgtttttaacgttcgttacgggtcggtacccgggtccggttaggacggttaaacgtaaccggtaaaccgggtaacccggttcgggggacccggaaaccgggtaacccggttccggcccgggttacccg

SEQ ID NO: 13174 - DNA, 909 bp, Homo sapiens
  misc_feature: GYAE6OF01B263P.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtgcctagtgtgaggtgcagcgtgggtgggagggtcggggggagcgttgggtcccaggtcccggtcggggggtccctgacggtacctccgtccgtggtgccacgtcccttcgtggtactttacctaccgttttagtacgtcttcgttaggtactacgtaacgttcgggtcccgaccgtaggtcctaccgggaagggggtaacggggtcgtaggggtacgggttgggggtacggtacccgtaaacgttacggaaacggacccggtaaggtaacggtaggggtaaaggtaaggtaaaggtaaaacgttaacgttaaggttcgggttacggtaccgttcggttagggtagggggtaacggggtaccgttaacgttcccgtaaccgttaacgtttacccggaaaggtaaaccgaaaccgaaaccggaacccgtaaaacgtaaccttaaacgttaacgtttacggttaaccttacgtacgtaaacgtaaacggtacgggtaaacctaaccgggtacccgttaaccgggaaccccggaaacccggacgggtaacccgtacgggtttaccgttttacggtttttaccgtttcggttaccgggttcgggttaccccgggtcccggttagggggtaacccttaacgggttaaaacccgggtaaaacccgtttccgggggtaacggggtaaccccgggtaacccggggttaaaccccgttcgggttaacccccgg

SEQ ID NO: 13175 - DNA, 585 bp, Homo sapiens
  misc_feature: GYAE6OF01BJA37.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctggagactctcctgtgcagcctctggattcaccttttagtagctcttggatgaactgggtccgccagtcctccgaggggaaggggctgggagtggggtggccaacgttgaagccagatgggaagtgaagaaatactatgtggactctgtggaggggacgtattccaaccctatttcccaagtagacaacgccaaagaactcattgtacttctagacaaagtcggaacagccgtagacggaacccgaggacacggtcttgtttactttcgtgtggccggtcgttcgggctagtaccggaaaactcggtcggggacccacggggtacccctgggtaccccg

SEQ ID NO: 13176 - DNA, 764 bp, Homo sapiens
  misc_feature: GYAE6OF01CF6UB.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtgccagtgtgaggtgcagcgtgggtggaggtcggggggagtcgttgggtccaggccgtggggggtcccctggagaccttcgtcctggtgcagccctctggattcaccgtttagtacgtctcttggatggaaccgtgggtcccgcctaggtcctaccggaaggggtaacggggcgtagggacggtggggtacggcccgtaaacgttggaacgtccgaggacgtagggaagtaggaagtaaagtactagtggtaggtactcgtaggtggaaggggtacgtagttaccgaccttatttacccgagtaacgaaccgaaaccgaccgaaacgaacgtacctaagtttacgtactaccgttagaaccgttaaagtgggaaaccaacggtaccctaggaacccggtaaccccggaacgggtaaccggtaccggtagttacggttttttaacgttccggttggttaccggtccgggttaccggttacggggtaccctaacgggttaaaccgggtaaaacccgtttaccggggtacccggggtaccccggtaaaccggggttaacccccggttcgggtaacccccggg

SEQ ID NO: 13177 - DNA, 568 bp, Homo sapiens
  misc_feature: GYAE6OF01D822N.3.59.F04.1.454.CMB.1.raw
  modified_base (467)..(467): a, c, t, g, unknown or other
  misc_feature (467)..(467): n is a, c, g, or t
tcagagacgcactccacgaccggtgctcgatttagtacacacacttagggagttggggaggtctcagagaggagccttagccctggactccaacggcctttccacttggtgatcagcactgagcacagaggactcaccatggaattggggctggagctgggttttccttgttgccattttagaaggtgccagtgtgaggtgctagctggtggaggtcgggggagcgttggtccagccgtcgggggtccctgagactcttcctgtgcagtcctcgtggtattcaccctttagtacgcttcttggatgaacgtgggtccgccgagtcctccgagggaagggctggagtgggtgaccgaacttgaacgccagagtggaagtgaagtaatactatgtggactcgtagtgagggacgtatcacctatttccgagacgacaacgccaagactactattagtatctgactaagngaacagcctgacgacccgagaccgacggcttagtttacttcgtgtcgccggtcgtggcagtaccggaaacgtcgacgggaccacgggacccgtggtacccg

SEQ ID NO: 13178 - DNA, 692 bp, Homo sapiens
  misc_feature: GYAE6OF01CEF3B.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgaactgggttttccttgttgccattttagaaggtggccagtgtgaggtgcagctgggtggaggtcggggggaggctttgggtccagccgtggggggtccctgagactctcctgtgcagcctctggattcacctttagtacgcttcttggatgaactgggtccgcagtctccgagggaagggctgggaggtgggtcgccaacgttgaacgccgagagtaggaagtgaagaaaatacgttagtggtaggcttcgtggtggaggggtacagttccaacgttactttacccgaaggaacgaaccgaaacgacccgaaaacgacctactaactttaggtacttcttaggaactaaagtacgggaactacgtaccgtacggaacggaccccggtaagggacctaaccgggtctttaagttttacgttttccgttagggtccgtaccgggttcccggttggggaccttaacggttaaacccgggaaaacttccgggtagggggtacccccgaaagggggtaaccccttggggtccccgttaaccccggg

SEQ ID NO: 13179 - DNA, 845 bp, Homo sapiens
  misc_feature: GYAE6OF01DOB21.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaggtggccagtgtgaggtgcagctggtggaggtcgggggagcgttggtccagccgtgggggtccctggagtactcgtcctggtgcagtcccgtcgtggtattcctaccgttttagtacgtcttcgttggataggtaaccgttcggggtcccgacctacggtccgtacccggaagggggaacgggggtcttaggggtaggtcggggtacggtacccgtaaacgttggaacgccgaaggtagtagggaaagtggaaagtaaaactacgttagtcggtagtacccgttgttggtagggagggggtaacgtacgttaccgaaccttaacgttttaccgaaggtaaccgaaacaaacccggtaccgaaaacggtaacccttacgtaacgtttacggttaacttaccgttaacggaacttaaaacgtgggtaaacccgtaaccggtacccgttacgggaaacccgggtaaaccccgggaacggtaacccggtaaccgggttccgttttacggttttttaccgtttaccgttcgggttaccgggtcccggggttacccggttacggggttacccggttaacgttaaaccggggttaaaaacccgttacggggttaccggggggaaacccggttaaccggggttaacccccggttacggggttaaccccccgg

SEQ ID NO: 13180 - DNA, 891 bp, Homo sapiens
  misc_feature: GYAE6OF01AZ0WS.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggtttcctgtgcatttagaaggtgccagtgtgagtgcagctggtggagtcgggggagcgttggtccaggccgtcggggggtccctggagaccttcgtccgtgtcgcgagtccctcgtgggtattccgacctttagtacgcttcgttggatggaacttggggtccctaccgtacgtccgttcccgaaggggtaaacggggtctcgggtaagttcggggtacggacccgtaacgtttggaaacggttccccgaaggtacttaggggtaacgtaggaacgtaaaacgttaacgtaagttacggtaggtaaccgttacgtacgggttacggaaggggggtaccgtaacgtttacccgaacccgttaacggttttacccgaacggtaacggaacccgtaaaaccgggaccccgtaaaagggtaaacccttacgtaacgtttacgtaaaccttccggttaaacggtacctaaaacgttaggggaaacccctaaacgggtaccccgttaacgggtaacccgggtaaacccccggtaacggggtaacccgtaaaccccgggtcggttttaaccgtttttaaaccggttttccgtttaacgggtaccgggttaccgggtacccggttacgggggttaaccctaaaccgggttaacccggggtaaaaaaccgttcccggggttaaacccgggggtaccccgtaaacccgggggttaaaccccgttccggggttaaacccccccggg

SEQ ID NO: 13181 - DNA, 798 bp, Homo sapiens
  misc_feature: GYAE6OF01BJA75.3.59.F04.1.454.CMB.1.raw
tcagagacgcactccacgaccggtgctcgatttagtacacacacttagggtagtttgggggaggtctcacgagaggagccttagccctggactccgaaggcctttccgacgttccggtgatcacgccacgtcgacgcacagacggtactcgaccactaggaacttggggctggagctgggttttccttagttgccctattttagaacggtcggtccctacgttggtcgagggtgctagtcgttgggtagggacggtcggggggagtccgttcggcctacgtcccggttggggggtcccctggacgtacctcgtccctgtcgcgacgtccttcgttaggtactttcgtaccgtttagtagccttacgttacggagtcgaaccgtcgggtccgacgtacgtccgtaccgaggggtacgggtcgtgggacgtcgggtacgaccgtaacgtttggaaccggccggtaaggtacgtagggtaacggtaggtaagtaaacgttcgtagtggtcggactcgtggtagggacgggtacgtacttaccaccttactttaccgagtaacgaaccaaccggtaccaaacggtacctacgtaacttcgtactcgtacgtaactaagtcgtaacgtacgtaccgtaggaaccgaaccgtaacggtaccgtaccggttacgtttaccgttttacgtttccggtacgggttccgggcccgggttacgggtacggtaacggtaaccggtaaaccggtaaacccggttaccggggacgggttacccggaaccggggtacccgttcgggtaccccg

SEQ ID NO: 13182 - DNA, 579 bp, Homo sapiens
  misc_feature: GYAE6OF01E39OU.3.59.F04.1.454.CMB.1.raw
  modified_base (309)..(309): a, c, t, g, unknown or other
  misc_feature (309)..(309): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggagtcggggggagcttggtccagccgtggggggtccctgagctctcctgtgcagcctctggattcacctttagtagctcgttggatgaacgtcgggtccnccagtcctccgaggggaaggggctgggagtgggtggaccaagttggaagccaaggagtgggaagtgaagaaatctagtgtggactcgtggtggagggactatccacctattccagacgaacaacgacaaacgaactcattgtatctagacaaagtcggacagccgtagacgacccggagaccgacggtcttgtttacttcgagtcggcggtcgtcgggcacgtaacggaaacgtcggtacggggacccgacgggtaacccgtggtacccg

SEQ ID NO: 13183 - DNA, 729 bp, Homo sapiens
  misc_feature: GYAE6OF01BU8DV.3.59.F04.1.454.CMB.1.raw
tcagagacgcactccacgaccggtgctcgatttagtacacacacttagggagttggggaggtctcagagaggagccttagccctggactccaaggcctttccacttgtgatcagcactgagcacagaggactcaccatggaattggggctgagctgggttttcctgttgccattttagaaggtggccagtgtgaggtgcagctggtggagtcgggggagcttggtccagcctgggggtccctgagactctcctgtgcagcctctggacttcacctttagtagcttcttggatgaactggggtcccgccgagtcctccgaggggaacggggcctgggaggtgggtaggcctaaacgttggaaacgccgaggaacgttagggaaagtgaacgtaaaattacctaagtgtaggaaccttcgtggtagggaggggtacgtagttcaacctaattttcccgaaggtacgaaccgaaaccgaccaaacggtaactaccgtaagtttacgtaacttcgtacgtaaccgtaaaagttcgggaacctaacgggtacccgttaggaaaccggaaccccgggaagggtaacccgaaccgggttacgtttacggttttaacgttttccgtaagggttccggcccgggtccgttacgggggcccttaacgtaacccgggtaaaacccttacgggtacccgggggtaacccgaacgggggtaacccccgttgggtaacccccg

SEQ ID NO: 13184 - DNA, 571 bp, Homo sapiens
  misc_feature: GYAE6OF01BY9DZ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggaggtcggggggaggcttggtccaggccgtggggggtccctggagactctcctgtgcagcctctggattcacctttagtagctcttggatgaactgggtccgccagtcctccgaggggagggctggagtgggtgccaattgaagccagagtaggaagtgaagaatactagtgtggactcgtgtaggaggggactattcaccgtatttaccgagtacgaacgaacgaccaaagactcaagttgtatctgacaagtggaacacgccgtagacgacccgagacgacgtcttagtttattcgtgtcgcggtcgagggcacggtacggaaactcggtacgggaccaacgggtacccgtcggtacccg

SEQ ID NO: 13185 - DNA, 706 bp, Homo sapiens
  misc_feature: GYAE6OF01D1PZD.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctggtggagtcggggggagcttggtccaggccgtggggggtcccctggacgactctcctgtgcagcctctggattcaccttttagagcttcgttggatgaacgtggggtccgcctagtctccggaaggggacggggtctgggagttggggtcggcctaaacgttggaacgtccgaggtagtagggaaagttgaagtaaaattacgtaagtggtagggacttacgtgggtagggaacgggggtacgtagtttccaacccgtacttttccgaaaggtacgaaccgaaaccggacccaaaacggtaaccttctaagtttcgtaacttccgttaggactaaagtcggaacagtccgtagggacgtaaccccggaggtaccgacgggtctttaggttttaacgtttcgtaggttcggtccgggtccggtcggggacgtacgttaacgggtaaaacccgttacgggtacccggggaaccgtaaccgggggtaaccctcgggtaccccg

SEQ ID NO: 13186 - DNA, 588 bp, Homo sapiens
  misc_feature: GYAE6OF01AXPW7.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagccgtggggggtccctggagactctcctgtgcagcctctggattcacctttagagctcttggatgaactgggtccgccagtctccgaggggaaggggctgggagtggggtggcccaacgtttgaagccgaagtagtgggaaagtggaagaaaattactaattggtacggacttcgtggtgggaggggacgagttaccacctatttccagagacaacgccaaagacctcaattgtatctgacaaagtggaacagcctagacgacccgagacacggcttagtttacttcgtgtcggcggcctggggcacgtaccggaaaacttcggacggggacccacggggtaacccctgggtacccg

SEQ ID NO: 13187 - DNA, 776 bp, Homo sapiens
  misc_feature: GYAE6OF01BSW3X.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctatttagaaggtggccagtgtgaggtgcagcgtgggtgggagggtcggggggaggtcgttggtccaggtccggtggggggtcccctggacgacctctcctggtgccacgtcctcgtggtacttctaaccgtttagtacgtcgttcgttggtataggaactgaccgtcccgccgtacgtcgtaccggaggggaacggggcgtggggtagggtcggggtcgggtacctaacggttacggaaacggtccgaaggtaggtaggggtaaagtagggtaaaacgtaaaattaccgttaagttcgggtaggtaaccgttcgtagggtagggaacgggggtacgttacggttaccctaaccgtttacgtttacccgaaggaaaccgtaaccgaacccggtaaccgtaaacgtaaccttacgtaaagtttacgttagtcccgttaagaacctaaaggtccgaactacgacccgtaggaaccggaacccggaaggaccgtacggtcgtttattttacgttcgtcgtcgggtcccggtacggtggtacctaacggtaacccggtaaacggtaccgggtaccggggtaccgtaacccgggtacccgttacccggg

SEQ ID NO: 13188 - DNA, 923 bp, Homo sapiens
  misc_feature: GYAE6OF01EVSVT.3.59.F04.1.454.CMB.1.raw
tcagagacgcactccacgaccggtgctcgatttagtacacacacttagggattggggaggtctcagagaggagccttagccctggactccaaggccctttccacttggtgatcagcactgagcacagaggactcaccatggaattgggctgagcgttggtttccttgttgctattttagaggtggccagtgtgaggtgcagcgtggtgggagggtcggggggaggtcgttggtccgacggccggttcggggggtcccctggacggtacctcgttccgtggtcgccgtagcccttcgtggtactttccgtacccgttttagtacgtccttcggtttggacttacggtaacgtcgggtacccgccgtacggtcctaccggaaggggacgggtcgtggggtacgtcggggtcggacccgtaacgttggaacgtccgaagtacgtagggtaaaggtaggaaagtaaaacgttacgtaaggttacgggttacggaaccgtttcggtagggttacggggtaacgggggtaaccttaagttaccccgtaacccgttacgtttacccgaaaagggaccggtaaaaccctaaaccggtaccctaaaaaggtacccttacgttaaagtttcggttaaaccttcggaaacgtaacccggtaaaagtttaccgggaacgttaaccggtaacccggttacggggaaaccccggtacccccgggtaaagggtaaccccggtacccgggttttacgttttaccgggttttttacgtttaccccgggttaggggtacccggttacccggggtaccccgttacggggggtaaaccccaaccgggggttttaaaaccccgtaaaaccccgtttcgggggttaccccggggaaacccccggtacgggggtttaaaccccccgttcggggtttaaaccccccg

SEQ ID NO: 13189 - DNA, 548 bp, Homo sapiens
  misc_feature: GYAE6OF01AUWUR.3.59.F04.1.454.CMB.1.raw
  modified_base (307)..(307): a, c, t, g, unknown or other
  misc_feature (307)..(307): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcttggtccagcctggggggtccctgagactctcctgtgcagcctctggattcacctttagtagctcttggatgaactggggtccnccagtctccgagggaaggggctggagtgggtgccaacttgaagccagatggagtgaagaaatactatgtggactcgtgtaggaggggacgattcacctatttccagagacaacgccaagaactcaattgtatctgacaaatggaacacgcctgacgacccgaggaccgacggtcttgttatttctggtcgcggctgggcagtacggaaactacgtcgggaccacgggacccgtggtacccg

SEQ ID NO: 13190 - DNA, 819 bp, Homo sapiens
  misc_feature: GYAE6OF01DALWS.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtgccagtgtgaggtgcagcgtgggtgggagggtcggggggaggcgtttgggtcccaggccggttcgggggggtccctggacgacttctccgtgtgcagcctcgtggtattctaccttttagacgtcttcgttggatacggtaacgtcggggtcccgccgtacgttccgtccggaacggggggaacggggtcgtaggggtagggttcgggggtacggacccgtaaacgttaggaacgtacccgaaggtaacgttaggggaaagtaggtaaagtaaaacttaacgtagttagggttacggtacttacggttgggtaagggtacgggggtacttaacgttacccgtaaccgttaacttttacccgaaaggaaccgtaaccgaaaccggaaccgtaaacgtaaacctcgtaagtttacgtacttacgtagaacctaaagtcggaacctaacgtacccgtacggtaaccggaacccgggaacggtaacccggtacggttacgttttaccgtttttacgtttccgttaggttccggtccgggtacccggttaggggccgttaaacgttaaaccggggtaaaaccgttcggggtaccggggaccccggtaaacggggtaaccccgttggggttaaccccccg

SEQ ID NO: 13191 - DNA, 810 bp, Homo sapiens
  misc_feature: GYAE6OF01DZ4FN.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtggtggaggtcggggggagtcgttgggtccaggccgtggggggtccctggacgactctccgtgtgcagcctcgtggtacttcctaccttttagtacgtcttcgttggatcgaacgtcggggtccgccgtagtccgtccggaagggggaacggggtcgtgggacggttggggtcggacccgtaaacgtttggaacgtccgaaggtacgtagggaaagtcggaaagtaaaacgttacgtaagttacgggtagggtaccttcggtagggtacgggtaacgggggtaccgtacgtttacccaaccgttaacgttttacccgaaaggtaaccgaaaccgaaacccggaacccgtaaaacgtaaccttacgtaacgtttacgttacttccgtaggaacctaaagtcggaaacgtacgtaccgtacggaaccggtaccccggaagggtaacccgaccggttactttacggttttaacttttccggttggttaccgggtcccgggtacccggttacggggtacccgttaaacgggttaaacccgggtaaaaaccgttccgggtaccgggggacccggtaaacccggggtaccccgttcgggttaacccccgg

SEQ ID NO: 13192 - DNA, 938 bp, Homo sapiens
  misc_feature: GYAE6OF01CXQXK.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgctattttagaaggtggcagtgtgaggtgcagctgggtggaggtcggggggagcgttggtccaggccgtggggggtccctggacgtactctccgtgtcgcacgtcctcgtggtacttccgtacctttagacgtcctacgttggatgtaacgttcggggtacccgccgtacgtccgtaccggaaggggtaacggggtctaggggtaacgggtggggtacggacccgtaaacgttaggaaacggtaccgaaggtacgttaggggaaaaggttaggaaacgtaaaaacttacgtaagttacgggttacggtaaccttcggttagggtggggtaacgggggtaaccttaacgttttacccgaacccgtttaatttacccggaaacgggtaaccggtaaaccgtaaaaccggacccgtaaaaaggtaaaccctttcggtaaattttacgggtaactttaccggttaacgaaacccgtaaaaggttcgggtaaacccgtaacgggttaccccggttaagggaaacccccgggtaaaccccggggtaagggtaaaccccggttaccgggtttaaccgtttttaacgggttttttaaccgtttcccggttaggggtttacccgggtaccccggggttaccccggtttacggggtaacccgtaaaacccgggtttaaaaccccgggggtaaaaccgtttaccccggggggttaccgggggaaacccccggtttaaacccgggggtaaacccccgtttcgggggttaaacccccccgg

SEQ ID NO: 13193 - DNA, 579 bp, Homo sapiens
  misc_feature: GYAE6OF01BVKB7.3.59.F04.1.454.CMB.1.raw
  modified_base (386)..(386): a, c, t, g, unknown or other
  misc_feature (386)..(386): n is a, c, g, or t
  modified_base (507)..(507): a, c, t, g, unknown or other
  misc_feature (507)..(507): n is a, c, g, or t
  modified_base (534)..(534): a, c, t, g, unknown or other
  misc_feature (534)..(534): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgtcattttagaaggtggccagtgtgaggtgcagctggtggaggtcggggggagcttggtccagccgtggggggtccctggagactctcctgtgcagcctctggattcacctttagtagctcttggatgaactgggtccgccagtctccgaggggagggctggagtgggtggccaattgaagccagagtggaagtgaagtaaatactaatgtagactntgtggagggactattccaactagtttccaaggtagaacctaacgaccaaagaactcgtaattagtaactcgtagactaaagtcggaacaggtccctaggacgaacccgaggtacaccggtnttaggtttacttcgtgtcgcggtccgnggccagtacggaaactcggtcgggaccagggtaccctggtacccg

SEQ ID NO: 13194 - DNA, 632 bp, Homo sapiens
  misc_feature: GYAE6OF01D4LVC.3.59.F04.1.454.CMB.1.raw
tcagagacgcactccacgaccggtgctcgatttagtacacacacttagggagttggggaggtctcagagaggagccttagccctggactccaaggccttccacttggtgatcagcactgagcacagaggactcaccatggaattggggctgagcgtgggttttccttgttgccattttagaaggtggccagtgtgaggtgcagctggtggaggtcggggggagcttggtccagccgtggggggtccctgagactctcctgtgcagcctctggattcacctttagtagctcttggatgaactgggtccgccagtctccgagggaaggggctggagtgggtggccaacttgaagccagagtggaagtgaagaaatactatgtggactcgtgtggaggggacgtattacacctatttacccaaggtaacgacaaacgaccaaagaactactaattgtatctagactaaagtcggaacacgcctaggaaccgacccggaagggaccgaacgggtccttagttttaacgtttcgtaggttcggtccgggtaccgtggggacctaacggttaccggaaaaaccgttccgggtaacggggacccggtaaaccggggtaaacccgtcgggttaacccccg

SEQ ID NO: 13195 - DNA, 598 bp, Homo sapiens
  misc_feature: GYAE6OF01B2DC5.3.59.F04.1.454.CMB.1.raw
  modified_base (367)..(367): a, c, t, g, unknown or other
  misc_feature (367)..(367): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaggtggccagtgtgaggtgcagctggtggaggtcgggggggaggcttggtccaggccgtgggggggtccctggagacctctcctgtgcagcctctggattcacctttagagctgttggatgaactgggtccgccagtctccgagggagggctggagtgggtgccaattgacgccagatggaagtgaanaaatctagtgtggactcgtggtaggaggggacgattccacctactttccgaagagaaccaacgaccaagaactctagttgtatctgactaagcggacacgcctagacgacccgacggacgacggtcgttcgtttactttcgtggttcggccggtccgttcgggcctacgtaacccgggaaaacgttccggtacgggggacccgtaacggggtaacccccgtggtaccccgg

SEQ ID NO: 13196 - DNA, 846 bp, Homo sapiens
  misc_feature: GYAE6OF01AMTAI.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggaggcgttggtccagccgtgggggtccctgagactcctcctggtgcagccctcgtggtacttccacccgttttagtacgtcttcgttaggtatcggtaacgtcggggttcccgccgtacgtcctccggaaggggtaaggggtcctaggggtaggtggggtcggtaccctaacgttaggaacgccgaagtagtacgggaagttaggaaataaaacgttacgtaagtgggtacggtaacctttccggtagggtagggacggggggtaaccgtacgttaccgaacccgttacttttaccccgaaggtaaaccgtaaccgaaccgtaacccgtaaacgtaacccgtacgtaacgtttacggtaacgtttccgtacgtaactaaacggttacgggaaccgtaacggcccttaacgggaaccggtaaccccgggtaacggaacccggtaccgggttaccgtttacggttttacgtttttcccggtcgggttaccgggtcccgggttccccggttacggggtacccgttaaaccgggttaaacccgggttaaaacccggttaacccggggttaacccgggggtaaccccgggaacccggggtttaaaccccggttcccgggttaaccccccgg

SEQ ID NO: 13197 - DNA, 921 bp, Homo sapiens
  misc_feature: GYAE6OF01BZJ3O.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcttgggttttccttgttgcctattttagaaggtggccagtgtgaggtgcagcgtggtgggaggtcggggggagtcttggtccaggccggtcggggggtccctggagactcgtcctgtgcagcctcgtggtacttcctacctttagtacgtcttcgttggattaggtaaccgttcggggtcccgaccgtacggtccgttaccggaagggggaacggggtcgttaggggaggttcgggggtacgggtaccctaaacgtttacggaaacgtaccggaaggtaacggtagggaaggtaaggaaacgtaaaattaacgttaagttacgggtaaggtactttacggtagggttacggggtaacggggaacgtaacgtttacccaacccgtttaacgtttacccgaaaggtaaacgtaaaacccgaaaccggacccgaaaaacgttaacccgttacgttaaacgttttacggttaaccttaccggtaacgaaaccgttaaaacggtaccgggtaaaaccgaccggttaacccggtaaacggggtaaccccggtaaaccccgggaaaccgggtaacccggtaaccgggttacctttttaacgggtttttaaccggttttccgttaacgggttcccgggtacccgggttaccccgggttacgggggaaacccttaaaccggggtaaaccccggttaaaaaccgggtttcccggggtaacccggggggtaaccccggtaaacccgggggtaccccggtttacggggttaaaccccccgg

SEQ ID NO: 13198 - DNA, 779 bp, Homo sapiens
  misc_feature: GYAE6OF01BO1J5.3.59.F04.1.454.CMB.1.raw
  modified_base (263)..(263): a, c, t, g, unknown or other
  misc_feature (263)..(263): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaagttgggctgagtcgttgggttttccttgttgcctagttttagaaggtgcctagtgtgaggtgcagcgtgggtgggagggtcggggggagtcgttggtccgaggtccggtcggggggtcccnggacgactcgtccgtgtgcacgtcctcgtggacttctaacccgttttagtacgtcttcgttggtatacggtaacggttcggtaccgtccgtagttcccgtaccggaaggggaacggggtctagggtaggtcggggtacgacccctaaaggttacgaaccggccgtaaggtacgtaaggggaagtaggaaagtaaaacgtacttaaggtacggtacggtaacccgtttggtacgggttaggggaacgggtacgttacgttaccgtaacctacgttttaaccgaagaacgtaaaccgaaccgtaaaccgaaacggtaacctacgtaagtttagtaacgttctagtaacaagtacggaactacggacgtacggaaccgtaccggacgaacggaccgttacgtttgtttacgttcggtacggttcggtccgggtacgttacgggacgtaaccggtaaacgggtaaaccgttacgggtaccccgggaaccggtaaccgggtacccgttccgggtaaccccg

SEQ ID NO: 13199 - DNA, 948 bp, Homo sapiens
  misc_feature: GYAE6OF01AURQ8.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgcctattttagaaggtggccagtgtgaggtgcagcgtggtgggaggtcggggggaggcttgggtccaggtcccggttggggggtcccctggacggactccgtcctgtgaccagccctcgtggtacttcctacccgttttaggtacgtccttcgttaggtatcggtaaaccggttcgggggtccccgtaccgtaacggttccgttacccgggtaagggggtaacgggggtaccggttgggggtaacggggttcggggggttaccgggtaccccgttaaaacggtttagggaaaaccggtcccgtaaaggtaacggtaaggggtaaacggttaggtaaaaggtaaaaacgtttaacgtttaacggttacgggttaacgggtacctttaccgggttagggttaggggtaaaccggggggtaccgttaacgtttacccgtaaacccgttaaccgttttacccggaaacggttaaccggaaacccgaaacccggtaacccgtaaaacgttaaccgtacgttaacgtttacgtttaacgttaccgttaacgaactaaaacggtacggtaacctaccgtacccgtaacgggtaacccggaacccggtaacggaaccggtaccggttacgtttacgttttacccgtttcgtacgggttccggtacccgggttccggttacggggtacccgttaaacccggttaaaccgggttaaaacccggttaccggggtaacccgggggtaaccccggaacccggggttaaccccggtcccgggttaaccccccgg

SEQ ID NO: 13200 - DNA, 806 bp, Homo sapiens
  misc_feature: GYAE6OF01CV34Q.3.59.F04.1.454.CMB.1.raw
  modified_base (328)..(328): a, c, t, g, unknown or other
  misc_feature (328)..(328): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttgttgcctattttagaaggtggccagtgtgaggtgcagctggtggaggtcggggggagcgttggtccaggccgtggggggtccctggacgactcctccgtgtgcagcctctggtacttcctaccgttttagtacgtcttcttggatgaacgtcgggtcccncacgtcctccggaaggggaacggggtcgtggggaggttcggggtcggcccgtaaacgttggaacgccgaaggtacgtagggaaaggtgaaaggtaaaattacgtagttggtagggtacttcggttaggtagggtaacggggtacgtaacgtttaccgtaacccttacgtttacccgaaggtaacgtaaaccgaaaccggaaccgaaaacggtaacccttaccgttaaagttttacggtaacttaccgttaggaacctaaaaggtttacggggaacctaaccggtaccggttaacgggaacccggtaaaccccgggaaacgggtaacccggtaccgggttaccgttttaggtttttaaccgtttccggttaggttcgggttaccgggtccggttacggggtaccgtaaccggtaaaccgggtaaaaaccgttccgggtaacggggacccgtaaacggggtaccccgtagggttaccccg

SEQ ID NO: 13201 - DNA, 1060 bp, Homo sapiens
  misc_feature: GYAE6OF01DBHUD.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtgggtggaggtcggggggagtcgttgggtccaggccgtggggggtccctgacgctctcgtgtcgcagcctcgtggtacttcacctttagtagcttcgttggatacggtaacgttcgggtccccgaccgtacggttccgtcccggaagggggtaacggggtccggttgggagggttcggggtcgggaccctaaacgtttcggaaacggtccaaggtacgttaggggaaacgttaggaaagtaaaaatttaccgtaagttaggggttacgggtaacctttacggttaggggtacgggtaacgggggggttaaccgtaacgtttaacccgtaaaccccggtttaactttttaaccccggaaagggttaaaccggaaaaccccggtaaaacccggtaaaaccccgtaaaaaccggttaaaccccgtttaaaccgttaaacggtttttcggtttaaaccttacccggttttaaacgggtaaaccccgttaaaaagggttaccggggtaaaacccgtaacccgggttaaccccggtttaaccggggaaacccgggtaaacccccgggggtaaaacgggaaccccggggttaacccgggtttacccggttttttaaacgggttttttttaaacgtttttccccgggtttagggggttttacccggggtaccccgggggtttaccccgggttaacccggggggttaacctaaaaaccccggggttttaaaacccgggggttaaaaaaaccccccggtttaacccggggggttacccgggggggtaaaacccccccggggtttaaaaccggggggtttaacccccccggggtttacgggggttttaaaaccccccccccgggg

SEQ ID NO: 13202 - DNA, 970 bp, Homo sapiens
  misc_feature: GYAE6OF01C3H78.3.59.F04.1.454.CMB.1.raw
tcagagacgcactccacgaccggtgctcgatttagtacacacacttagggattgggaggtacgtcagagaggagccttagtccctggactccaaggcctttccacttggtggatcagcactgagcacagaggactcaccatggattgggctgacgtcgttcgggttttccttgttcgcctattttagaaggtcgccagtgtgaggtgacagtcgtgggtggaggtcgggggagtcgttcggtcccgaggtcccggttcggggggttcccctggtacgtaccttccgtccggtaggtacgccgacgtccccttcgtacgggtactttcccgtaacccgtttttaaggtaacggtcctttacgtttagggtaacttacggtaaccggttcgggggtacccccgtaccgtacggtttccgttacccgggaaacggggggaacggggtaccgttaggggtacgggttcgggggaccggtacccctaaacggtttacggaaccgtcccgaagtacgttaggggtaaaggtcggaaaacgtaaaacgttccgttaaggttcgggtacgggtaccctttacggtagggtaacggggaacgggggtaacctaccgtttacccgacccgtttaaccgtttaccggaacgggtaacggaaccgtaaaccggaacccgtaaaacggttaacctaccttaagtttccggtaatttacccgtaacgtaacctaaagggtccggaaacctaccggtacccgtacgggtaaaccggaaccccgggtaaggtaacccggttacgggttctttttaaacgggttttttactttacccgggttgggtttacccgggtacccgggttccggttacggggtaaccctaaacgggtttaaaccccgggttaaaaccgttaccggggttaacccgggggtaacccggttaaacccggggttaacccccgggtttgggttaaacccccccggg

SEQ ID NO: 13203 - DNA, 665 bp, Homo sapiens
  misc_feature: GYAE6OF01CAONA.3.59.F04.1.454.CMB.1.raw
  modified_base (273)..(273): a, c, t, g, unknown or other
  misc_feature (273)..(273): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtgccagtgtgaggtgcagctggtggaggtcggggggagcttggtccaggccgtggggggtcccctggagacctctcctgtgcagccctntggacttcacctttagtagcttcttggatggaacgttggggtccgccagtcctaccggaggggaacggggctagggaggtggggtggacccgtaacgttaggaacgccgaaggtacgtagggaaagtgaagaaattactagttggagtactcgtggtaggacggggtacattccaccgtatttcccaaggtacgaaccgaaccgaccgaagaacctactagttacgtactcgtagaactaaagtcggaacacggtaccacggaacggtacccggaggaccgtacggtacttggttttaacttcgtggttcggccggtccgtcggggtacacggttaaccggaaaccgttcgggtaccggggaccgtaacggggtaacccgttgggtaccccg

SEQ ID NO: 13204 - DNA, 708 bp, Homo sapiens
  misc_feature: GYAE6OF01C06IG.3.59.F04.1.454.CMB.1.raw
  modified_base (311)..(311): a, c, t, g, unknown or other
  misc_feature (311)..(311): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggagcttggtccagccgtgggggtccctgagactctcctgtgcacgcctctggattcctacctttagtacgcttcttggatgaacgtgggtccncctagtctccgaggggaagggctgggaggttgggtcggcctaacgttggaagaccgaagacgtggaaagtgaagaaaacttcgtataggtaggtctacgtggtaggaggggtactactttacgacctagtttcccaaggtaacgaaccgtaaccggacctaaaggtaaccttactaagtttacgtactacgtacgaactaaagtcggaactaaggtacccgtaggacccggtaacccggaggaacccgtacgggtacctttgtttttaacgttccggttggtaccgggtccgggtaccccggttaggggtaccctaaacggttaaaccggtaaaacgttaaccccggggtttacggggaaccccgaaccgggggtaaccccgttcggggtacccccg

SEQ ID NO: 13205 - DNA, 699 bp, Homo sapiens
  misc_feature: GYAE6OF01BZ74P.3.59.F04.1.454.CMB.1.raw
tcagagacgcactccacgaccggtgctcgatttagtacacacacttagggagttggggaggtctcagagaggagccttagccctggactccaaggcctttccacttggtgatcagcactgagcacagaggactcaccatggaattggggctgagcgtggttttccttgtgccattttagaaggtggccagtgtgaggtgcagctggtggaggtcggggggaggcgttggtccagtccgtggggggtccctggagactctcctgtgcagcctcgtggtacttcctacctttagtagcttcgttggatgaacgtgggtcccgccagtcctccgaggggaagggtctgggaggtgggtggacccaattggaacgccgaagagtagggaagtgaaagtaaatactagtgtgtactcgtggtggaggggtactacttaccgacctatttacccaaggtaacgaaccgaaaccgaccaaaacgtaccttacgtaatttacggtaattcctagactaaaaagttcggaaccacggtacccgtaggaacccggtaacccgggaggacccgtaacgggtcttttacggttttaactttcgttacggtacggtccggttacccggtgggtaccctaacggttaaacccgggaaaaacgttaccgggtcggggaaccccgaaaccggggtaccccgtgggttaacccccg

SEQ ID NO: 13206 - DNA, 590 bp, Homo sapiens
  misc_feature: GYAE6OF01B4GFZ.3.59.F04.1.454.CMB.1.raw
  modified_base (314)..(314): a, c, t, g, unknown or other
  misc_feature (314)..(314): n is a, c, g, or t
  modified_base (341)..(341): a, c, t, g, unknown or other
  misc_feature (341)..(341): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagccgtgggggtccctgagctctcctgtgcagcctctggattcaccctttagtagctcttggatgactgggtccgccagtccnccgagggaaggggctgggagtggggtntccaagttggaacgccagatgggaagtgaagaaatactatgtggactcgtggtggaggggactattccacctatttacccgaagtacgaaccaaccgaccaaagaacctctaattgtaatcctagacctaaagtcggaacacgccgtagaccggacccgaggaccgacggtcttgtttacttcgtgtcggcggtccgtgggcgagtacggaaactcggtacgggaccgaaccgggtccgtcgggtaccc

SEQ ID NO: 13207 - DNA, 818 bp, Homo sapiens
  misc_feature: GYAE6OF01C5G4Y.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagtcgttgggtttttccttgttcgcctattttagaaggtggccagtgtgaggtgcagcgtgggtgggaggtcggggggaggcttggtccgaggtccggtggggggtcccctggacgtaccttcctccgtgtcggaccacgtccctcgttggtactttcctaaccgttttagtacggtctccgtttgggaacttggaaaccgttcgggggttccccgaccgtaacggttcccgtacccggaagggggtaacgggggtcgtaggggtagttcgggggtcggaccctaaaccggtttagaacggtaccgaggtaagtagggtaaaaggttggaaaggtaaaaactacgttaaggtacggttggaaccgttgtggttaggaacgggggtacgtatttccgaaccttagtttaccgaagtacgaaaccgaacgacccaaacggtaacttacgtaactttagtacttacgtacgtaactaaagtaggaacgtaaccgccgtaggaaccggaaccccgaagggtacccgacggttacgttagtttttacgttacgttggtcgggtaccggtcccggttagggacccgttaaacggtaaccgggtaaaaccgtttacccgggtacggggtaaccccggtaaccggggtaaccccggtttcgggttaaacccccgg

SEQ ID NO: 13208 - DNA, 1048 bp, Homo sapiens
  misc_feature: GYAE6OF01DZ897.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacaggagactcacagtaggaagttgggctgagtcgttgggttttccttgttcgctattttagaggtcgcagtgtgaggtgcagtcgtgggtgggtaggggtcggggggagtcggttcgggtccgacggtcccgggttcgggggggttccctaggacgtaccgttccgtccgttggtcgcgtacgtccgttcggtaggttacttacccgttaaccgttttaaggtaccgttccgttttaccggttagggtacgttaacggtaaccgggtttccgggggtacccccgtaccgttaacgggtttccccgaaaccggggttaaaccgggggggaaacgggggttcccggtttaagggggtacggggtttcggggggtacccggttaaccccgttaaaacgggttacgggaaaccgggtacccgtaaagggtaacggtaaggggttaaaacgggttaaggtaaaacgtaaaacgttaaccgttaaggttacgggttacggttaaactcggttaggggttaacggggaacgggggtaaccgttacgttaacccgtaaccgtttaaccggttttaacccggaaggtaaaccgggtaaacccgtaaaacccggaaacccgtaaaaaccggttaaacccgttaacgttaaacggtttttaacggtaaaccgttttaccggtaacgtaaaccgtaaaacggttaccgggtaaaccgtaaccggtacccggtaacggggtaaacccggaacccggggtaaacggaacccggttaacgggttccgttttaaggtttttaacccgtttcggtacggtttaccggggtcccggttaccggttacgggtaaccgtaacgggttaaaaccccggttaaacggttaccggggtaccggggaaaccccggtaaccggggttaacccggtcggttaaacccccgg

SEQ ID NO: 13209 - DNA, 858 bp, Homo sapiens
  misc_feature: GYAE6OF01AU8I3.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtggaggtcggggggaggcgttgggtccaggccgtcgggggggtccctgagactctcctggtgcagcctcgtggattcctaccttttaggtacgtcttcgttggtatcgaacgttgggtcccgcctagtcctaccggaggggaacggggcgtgggaggtggggtcggaccctaacgttggaaacggtccgaaggaagtacgggaaaggttaggaaagtaaaacgttaactaaggttcggttacggtaacgttcggttagggtaggggaacgggggtaaccgtattacccgtaaccttactttacccgaaaggtacgtaaaccgaaaccggaaccctaaaacggtaaccctttaactaaacgttttagttaaccgtttacgttaacgtaaccgtaaaacggttacgggaaacgtaaccggtacccgtaacggggtaacccgggaaacccccgggtaagggaacccgtaccgggttacccgttttacgggtttttaacttttcgggttaccgggttccgggttacccggggtacccggtttacgggggtacccttaaacgggttaaaccccgggttaaaaaccgttccggggttaacccggggggaccccggtaaaacccgggggttacccccggtacgggttaacccccgg

SEQ ID NO: 13210 - DNA, 936 bp, Homo sapiens
  misc_feature: GYAE6OF01D8KNB.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctggtggaggtcgggggagtcgttggtccaggccgtcgggggtccctggacgacctctcctgtgcagcctcgtggtacttcctaaccgttttagacgtcttcgttggattcgtaacgtcgggtcccgaccgtaggtccgtaccggaagggggtaacgggggtcgtaggggtaagggttcgggggtcggaacccgtaaacgtttggaaacgaccgtaaggtacgtagggaaaggtcggaaagaaaacttacgtaagttcggtacggtaacctttcggttagggtaggggtaaacgggggtaacgttacggtttaaccctaaccccgttaacgttttacccgaaacgggtaaaccgaaacccgaaaacccggtaaccccgtaaaacgtaaccttacgttaacgttttacgtaaacgtttacccgtaaggtaaacccgaaaacggttaccggggaaaaccgtacgggttaaccccgttaaaccggggaaacccggtaacccccggggtaaacgggtaaacccgggtacccggggtttaaccgttttaacggtttttttaccggttttacccggttcggggtttacccgggccccggggttacccgggttcggggtaaaccgttaaaccgggttaaacccggggtaaaaaacccgggtttacccggggtaaccggggggttaaaccccggtaaacccggggggttaaacccccgttccgggggttaaaccccccgg

SEQ ID NO: 13211 - DNA, 800 bp, Homo sapiens
  misc_feature: GYAE6OF01BHFCN.3.59.F04.1.454.CMB.1.raw
  modified_base (675)..(675): a, c, t, g, unknown or other
  misc_feature (675)..(675): n is a, c, g, or t
tcagagacgcactccacgaccggtgctcgatttagtacacacacttagggagttggggaggtctcagagaggagccttagccctggactccaaggcctttccacttggtgatcagcactgagcacagaggactcaccatggaagttgggctgagtcgttgggttttccttgttgcctagttttaggaaggtggccaggtgtggaggtgcagtcgtggtagggagggtcgggggagtcgttcggtccaggtcccgggttcggggggtccctaggacgtaccgttccgtccgtgtcgccgacgtcccttcgtggtaacttcctaacccgttttagtacgtccttacgttaggtatcggtaacggttcggggtcccgaccgtacggttccgtacccggaagggggtaacggggtccgttaggggacgggttcggggtacggtacctaaacgttacggaacgtaccgtaaggtacgtacgggaaaggtacgaaagtaaactacgttagtagggtacggtaccttacggttagggtagggaacgggtaactacgttacccgtaaccgttacgtttaaccgaacgggtaacgaaacccggtaaaccgaccgaaaacggtacttactaagttacgtactacgtagactaaagtgaccgacgtcgtacgaaccgaccgggaanaccgtaccgttagtttacgtttattccggagttacgggcccggttacgtggaacccttaacggtaaaccggttaaacctcgggggtacggaacccggtaacggttaccccggtggttaaccccgg

SEQ ID NO: 13212 - DNA, 801 bp, Homo sapiens
  misc_feature: GYAE6OF01CRXYS.3.59.F04.1.454.CMB.1.raw
  modified_base (193)..(193): a, c, t, g, unknown or other
  misc_feature (193)..(193): n is a, c, g, or t
  modified_base (342)..(342): a, c, t, g, unknown or other
  misc_feature (342)..(342): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaagttggggctgagcgttggttttcgtgtagcctatttagaggtgcagtgtgnggtgcagcgtggtagggacggttcggggggagtcgtttggtccgaggtccggtggggggtccctggacgccttccgtcctgtcgcacgtccctcgtaggtactttcctaccgttttagtcgtcttcgttggatcgtaacgtcgggtccnccgtagtccgaccggaggggacggcgtgggaggtcgggtacggacctagttacggagaccgaagtagtacgggtaaagtagaaacggtaaaattacgttaagttacggtacgtacgttacggtagggtacgggtaacggggtaccttaacgtttacccaaccgtttacgtttaaccgaaacggaacggtaaacccaaccgtaaccccgaaaagtaaccgttactaaagtttcggtaattacccgttaaggaactaaacgtcgggtaaacccacgggtaccgtaacggaacccggaacccggaggtaacccgttacggtctttttaacggtttcttccggttgggtccggtaccgggtcccggttacgggaccgtttaaacccgggtaaaccggtaaccggtttcccgggtaccggggtaaccccggaaaccgggttaaccccgttcggggttaaccccc

SEQ ID NO: 13213 - DNA, 797 bp, Homo sapiens
  misc_feature: GYAE6OF01D3HQ5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgccattttagaaggtggccagtgtgaggtgcagctggtggaggtcggggggagcttggtccaggccgtggggggtccctgacgactctcctgtgcagcctctggtattctaccttttagtagctcgttggatgtaacgtcgggtccgaccacgtccgtaccggaaggggaacgggtcgtagggaggttcggggtcggaccctaaacgttaggaacgccgaagacgtaggaaaggtgaagtaaaatacgtagtggtggacttcgtaggtaggaacggggtacgtagttaccgaaccttagtttacccgaaggtacgaaccgaaaccgaacccaaagtacctacgtatttagtacttacgttacgaacgtaaagttacgggaactaaccggtaccgtacggaaccggtaaccccgggaaggtaacccggaaccgggttcgttttaacggtttttacgttttacccgttagggttacccgggtacccgggttaccggttacgggggtaacccgttaaacgggttaaaaccccggggttaaaaaaacccgtttacccgggggttaacggggggaaccccccggtaaaaccggggggttaaaccccccgtttcgggggttaaaaccccccgg

SEQ ID NO: 13214 - DNA, 745 bp, Homo sapiens
  misc_feature: GYAE6OF01BE2KG.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggtttccttgttgccatttagaagtggcagtgtgaggtgcagctggtggagtcgggggaggcgttggtccagccgtggggggtccctggagactctcctgtgcagcctcgtggacttcctacctttagtagcttcttggatgaacgtcgggtccgccgagtcctccggaggggaacggggctagggagtggggtcggacctaacgttaggaacgtccaaggtagtagggaacgtaggaagtaaatacgtagtaggtaggtacctcgtaggtagggaggggtacgtacgttaccaaccgtacgtttaccgaagtacggaaccgaaaccgaacccgaaacggtaaccttactaagtttacgtacttaccgtacgaacctaaaacgtcggaaaccgtaccgtaccgtacgggaaacccgggtaacccggaacgggaaccgtaaccgggttctttacggtttttaacgttttccgttagggttaccgggcccgggttaccggtacggggtaacctacggttaaaccgggtaaaaaccgttaccgggtaccgggggaacccggtaaccggggaccccggttcggtaaccccggg

SEQ ID NO: 13215 - DNA, 1009 bp, Homo sapiens
  misc_feature: GYAE6OF01CIV5B.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaagttggggctgagtcgttgggttttccttgttgcctagttttagaaggtggccagtgtaggaggtgcagtcgtgggtagggagggtcgggggggaggtcgtttcgggtccgacgggtccggttcggggggtccctaggacgtaccttccgtccgttggtcggtccacggtcccttacgtacgggtactttaccgtaacccgttttaaggttacgtccgttttacggttagggtacttacggtaaccggttccgggggtaccccgtaccggtacgttcccggtaaccggaacggggggaacggggtccggttaggggtaggttcgggggtccggtaaccgttaaacggttacggaacggacccggaaggtaacggtaggggtaaacggtaaggtaaaacggtaaaagttaccgttaaggtttacgggtaaggtaaccgttttacggtagggtacggggtagggggtaacgttaacgttaccccgtaaccgtttaaccgtttaccgaaacgggtaaaccgtaaaccgtaaacccggggtaaacccctaaaaggtaaacccgtttacccgttaaagggtttaccgtttaacgttaacccggttaacggtaaacgttaaaaccgggtaccgggtaaaacgtaccgggtaccccgtaagggggaaaccccgttaacccggggaaacgggtaaccccggttacccgggtttaccttttaacggtttttaaccgtttccgggttacggtacccggggttaccgggtcccgggttacggggtaaactacccggggttaaacccggtaaaacggttacccggggtaaacgggggaccccggttaaaccgggggtaccccgtttccgggtaacccccg

SEQ ID NO: 13216 - DNA, 850 bp, Homo sapiens
  misc_feature: GYAE6OF01CJAO5.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctggttttccttgttgcctattttagaaggtggccagtgtgaggtgcagctggtgggaggtcgggggggaggcgttgggtccaggccgttgggggggtcccctggacgactctccgtgtgcagcctctaggattcacctttagagtctcttggatgaacgtcgggtccgccgagtccgtccgaaggggaacggggtctgggaggtggggtcgggaccctaacgtttcggaaacggccgaaggtacgttagggaaaggtaggaaagtaaaagttaccgttaagtaggtacggtaaacttcgttagggttcggaacggggggtacgtacgtttaccgtaacccgttactttttaccccgaaggtaaccgaaccgaaaccggaccctaaaacggaaccttaccgtaacgtttacggttaagttaccgttacgtaacgaaacgtacgggtaaaccgtaacggaccccgttagggaacccgggtaaacccccgggaacggggtaaacccggaccggggttaccgttttacggtttttaacgttttccgtttaccggggttacgggttccccggggttccccgggttacgggggacccgttaacggttaaacccgggaaaaacccggtttaaccggggttaacccggggggaaccccggttaaaccgggggtaaacccccggtttcggggttaaaccccccgg

SEQ ID NO: 13217 - DNA, 646 bp, Homo sapiens
  misc_feature: GYAE6OF01BILIS.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccagccgtggggggtccctgagactctcctgtgcagactctggattcacctttagtagctcttggatgaacgtcgggtccgctacgtcctccggaaggggacggggtcgtgggaggttggggtcggacccgtaacgttggaacgccgaaggtagtacgggaagtgaagtaaactactagtgtaggacttcgtggtaggacggggacgtacttcacctatttaccgaaggacgaaccgaaccgaccaaacgtaacctacgtaattgtacttcgtagactaaatggacagccgtagaacgacccggagaccgacggtcttagtttactttcgtcggtcggccggttccgtgggtactacggtaaccggtaaaacgtcggtacgggggaccctaaccggggtacccgtcgggtaaccccg

SEQ ID NO: 13218 - DNA, 605 bp, Homo sapiens
  misc_feature: GYAE6OF01BR5ZN.3.59.F04.1.454.CMB.1.raw
  modified_base (522)..(522): a, c, t, g, unknown or other
  misc_feature (522)..(522): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggaggcttggtccaggccgtggggggtccctggagactctcctgtgcagcctctggattcacctttagtacgcttcttggatgaactgggtccgcagtctccgagggaagggctggagtgggtcggccaacgttcgaagccaagactaggaagtgaagaaatactatgtggactcgtggtaggaggggacgtattaccacgtatttaccagaacgaactaaccgccaaacgactcagttgtatctagacaaagtcgaacagccgtaggacgacccggagaccgacggtcttacgtttatttcgnggttcgccggttccgtcgggctaacggtaccggtaaaactacgggtacggggaacccgaaccggggtacccgtgggtaccccg

SEQ ID NO: 13219 - DNA, 772 bp, Homo sapiens
  misc_feature: GYAE6OF01C82UF.3.59.F04.1.454.CMB.1.raw
  modified_base (309)..(309): a, c, t, g, unknown or other
  misc_feature (309)..(309): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctgggtggagtcggggggaggcttggtccagccgtggggggtccctgagactctcctgtgcagcctctggattcacctttagtagctcttggatgaacgtgggtccncgtgtcctcgagggagggctgggagtgggtcggccgaacgttgaacgccagagtaggaagtgaagaaagtactaagtggtggtactcgtggtgggaaggggtactagttccaaccgttaacgtttccgaaggaacgtaaacccgaaaccgtaacccgaaacggtaaccttacgtaagttttacgtagttaccgttagtaaccgtaaaagttcgggtaaaccgacggtaccccgttaagggacccgggtaaacccggacgggtaaacccgtaccgggttaacctttagggtttttaacgtttcccggttgggttaccgggtacccggggttacccggttaccgggggtaaccgtaaaccggtttaaacccggggtaaaaaacccgtttacccggggtaaccggggggtaacccccggttaaaaccggggggtaaccccccgttcgggggtttaaacccccccgg

SEQ ID NO: 13220 - DNA, 767 bp, Homo sapiens
  misc_feature: GYAE6OF01CBILX.3.59.F04.1.454.CMB.1.raw
  modified_base (217)..(217): a, c, t, g, unknown or other
  misc_feature (217)..(217): n is a, c, g, or t
tcagagacgcactccacgaccggtgctcgatttagtacacacacttagggagttggggaggtctcagagaggagcccttagccctggactccaaggcctttccacttggtgatcagcactgagcacagaggactcaccatggtaagttgggctgagtcgttgggttttccttgttcgacctagttttagaaggtgtcagtgtgaggtgcagcgtggnggagggtcggggagtcgttggccgacgccggttcgggggtccctggacgtccttcgtccgtggtcgcgtacgtcctcgtggtacttacgtaccgtttaggtcgtcgttcggttacggattacggtaacggttccgggtcccgaccgtaacggtccgtaccggtaagggggaacgggtcggtagggtaacgggtcgggtacggtaaccccgtaagttacggaacgtccgaaggtagtagggtaagagaagtaaattactagtgtgtactgtggtaggaggtactacttactactacgttacgaagtaccgaaactaaccgaacaacgaaccttatagttaaccgtattaccgtacgaagtaaacgtcgaaccttaacggccgtaaccgggaccggacccggaagaccccggtagttccgtttagtttaccgttcggtggtaccggttccgggaacgtacggggtaccctaaacgggtaaacccggtaaaacgggtttcccgggacggggtaaccccgttaaaccgggaccccggttaaggtaccccccggg

SEQ ID NO: 13221 - DNA, 759 bp, Homo sapiens
  misc_feature: GYAE6OF01B37H6.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagcttgggttttccttgttgcctattttagaaggtggccagtgtgaggtgcagctggtggaggtcggggggagtcgttggtccaggccgtcggggggtccctgagactcctccgtgtgcgacgcctcgtggtattcctaaccttttagtacgtcttcgttggtatacggaacgttcgggtccgccgtacgtccgtaccggaaggggacgggtcggtagggtaggtggggtacggaccgtaacgttggaacgaccgagtagtagggaaagtaggaaagtaaaacttacgtagtggtacggtacttcgtaggtagggaacggggtacgtacgttacccgaaccgttactttaccgaaggtaacgaaaccgaaaccgacccgtaaagtaacctacttaagtttacgtacttacgtacgaactaaagtacggaaccaacggtccgtaacggtaccgggaaccccggaaggtacccgtacgggttacctttaggtttttactttcggtcggttcggtccgggttccggtacggggtacctaaggttaaacccgggtaaaaccgttcggggacgggggaaccccgtaaccggggtaaacccgttcgggtaccccg

SEQ ID NO: 13222 - DNA, 635 bp, Homo sapiens
  misc_feature: GYAE6OF01B7FSX.3.59.F04.1.454.CMB.1.raw
  modified_base (325)..(325): a, c, t, g, unknown or other
  misc_feature (325)..(325): n is a, c, g, or t
  modified_base (351)..(351): a, c, t, g, unknown or other
  misc_feature (351)..(351): n is a, c, g, or t
  modified_base (491)..(491): a, c, t, g, unknown or other
  misc_feature (491)..(491): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagcgtgggtgggagggtcggggggaggcgttggtccaggccgtggggggtcccctggagactctcctgtgcagcctcgtggatttcacccttttagtacgcttcttggatgaactggggtccnccgtagtctccgagggaggggctggngtggggtgacctaacgttgaagccgagagtaggaagtgaagaaatactagtgtggactcgtgtgaggggactattcactatttcaagacgaacgaacgacaaagaactactattacgtatcgtagactaaagttcggaanacgacctggaacgacccggaggacctacggtctttacggttttaagtttccgttggtcggccggtcccggtacggggtcaacggttaaccggaaaacgttaccgggtcggggaacccgtacgggtaaccccgttggtaccccgg

SEQ ID NO: 13223 - DNA, 894 bp, Homo sapiens
  misc_feature: GYAE6OF01C2MYV.3.59.F04.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (337)..(337): a, c, t, g, unknown or other
  misc_feature (337)..(337): n is a, c, g, or t
tcagagacgcactccacgaccggtgctcgatttagtacacacacttagggagttggggaggtctcagagaggagccttagccctggactccaaggcctttccacttggtgatcagcactgacgcacagaggactcacatggagtgggctgagtctggtttctgtgctagtttagaggtgcagtgtgagtncgagcgtggnggaggtcgggggagtcgtggtccgaggtcggttgggggtccctgtaacgtctcgtccgtagtcgcagtcctacgtggtacttacgtaaccgttttagacgtccgttacgttggagtaacggtaacgtcggggtaccnccgtaacgttccgtacggaacggggaagggtcctacgggtaggttcggggccgtaaccgttaagttacggaaacgtcccgtaaaggaacggttaaggggtaaaggttacgaaaacggtaaaaactttccggtaaagtttcgggttaagaccggttcggttagggaacgggtacgggtaacgtacttaaccggtaaacctagtttaccgaaaggggtaaaccaacgaaaacccgggacctaaaagggtaaaccttagtaacggtttaagtaacttaccgttaaaggtaaccgaaaaaggttcccggggtaaacaccgggtttaacccgaaggggtaaaccccaaccccgggggaagtaaaccccggttacgggttaccgttttttaagggtttaaccgtttcggttacccggggtacggggtaaccccgggtaccggtttcggggtaaacccttaaaaccggggtttaaaaccccgggaaaaacggttcccgggggttaacgggggaacccccgtttaaaacccggggggttaaacccccttccgggggtaaaccccg

SEQ ID NO: 13224 - DNA, 876 bp, Homo sapiens
  misc_feature: GYAE6OF01DNWKL.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagtcttgggttttccttgttgcctattttagaggtgccagtgtgaggtgcagctgggtggaggtcgggggagcgttggtccaggccgtcggggggtccctgacgtactcctcctgtgctagccctctggtactttctaccgttttagtacgtccttcgttggatggtaaccttcggggtcccgaccgtacgtccgtacccggaggggaacggggtctagggtaggttggggtcggtcctaaacgttggaaacgtccgaacgtagtagggaaaggtaggaaacgtaaaatcgtaagttggtacggtactttcgtagggttagggaaccgggggttaacgaacgtttaccgaaacccgttacgttttaccgaacggtaaccgtaaaccgtaaccggaccaaaacgtaacccgtaaccgttaagtttaacggtaacttacgttacggtaacccgtaaaggttggaaaccctaacgggtaccccttaaggggaaccccgtaaacccggggtaacggtaacccgggttacggtaacccgttttaacgggttttttaacgttttccgggttaaggttttcccgggtcccgggttacccgggttaacgggggttacccgtaaacccgggttaaaaccggggttaaaaacccggtttaccccggggttacggggggtaaaaccccccggtaccgggggttaaaaccccccgttggggtttaaacccccccggg

SEQ ID NO: 13225 - DNA, 920 bp, Homo sapiens
  misc_feature: GYAE6OF01ED2F2.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagtcgttgggttttccttgttcgacctattttagaaggtggcctagtgtgaggtgcagctgggtgggagggtcggggggaggtcgttggtccgaggtccggtcggggggtccctgacgtacgtccttccgtgtcgcctacgtcccgtcgttggtactttaccgttaacccgtttttaaggtacgtcccttttcggtttagggtaacttacggtaacccggttcgggggtaccccgtcccggtaaccggttcccgttacccgggaacggggggtaacgggggtccggttggggtaacgggttcggggtaccggtaacccgtaacgtttacggaacgccgaaggtaggtagggtaaaggtaggaaagtaaacgttaacgttagtacgggtaggtacgttacgttagggtacgggtaacgggtaacgttacgtttaccctaaccgtttacgttaccggaaagaacggtaaaacccgtaaaccgtacccgtaaaacgttaacccttacgtaagtttaccggttaacttaccgtaacgtaaactaaaccgggtggtaaacccgaacgggttccctaaggggaaccccggtaaacccgggaacggttaacccgggtaggtttcccgtttttaaggttttaaccgtttcgggtacggtttcccgggaccgggtttaccggcgggttaacgaacggtttaaaacccggaaaacccggttccgggggtacccgggaacccgggttaaacccggggtaccccggttccggtaacccccgg

SEQ ID NO: 13226 - DNA, 577 bp, Homo sapiens
  misc_feature: GYAE6OF01B19CH.3.59.F04.1.454.CMB.1.raw
  modified_base (455)..(455): a, c, t, g, unknown or other
  misc_feature (455)..(455): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtgggaggtcggggggaggcttggtccagccgtggggggtccctgagactctcctgtgcagcctctggattcacctttagtagctcttggatgaacgtgggtccgccagtcctccgagggaggggctgggagtgggtcggccaacgttgaagccgagagtggaagtgaataaatactagtgtggactcgtgtggaggggacgattcacctatttccagacacaacgaccaagaactcattgtatctaganaagtgacacgctagacgacccgaagccacggctgtttatttcgtgtcggccggtcgtgggtccagttaacccggaaaaccttcgggtacggggaccgtaaccgggtacccgtggtaccccgg

SEQ ID NO: 13227 - DNA, 889 bp, Homo sapiens
  misc_feature: GYAE6OF01APEKS.3.59.F04.1.454.CMB.1.raw
tcagagacgcactccacgaccggtgctcgatttagtacacacacttaggattgggaggtctcagagaggagccttagccctggactccaaggcctttccacttgtgatcagcactgagcacagaggactcaccatggaattgggctgagctgggttttccttgttgcctattttagaaggtggccaggtgtgtaggtgcgagcgtgggtgggaggtcgggggggagtcgttgggtccgaggcccgtggggggtcccctggagccttccgtcctgtgcacgtcctcgtaggtacttccgtaccgttttagtacgtccttcgtttagggtactaggtaacccgttcggggtaccccgtccgtagttcccgttacccggaagggggtacggggccttggggaaggttcggggtacggccctaaacggttcggaaacggtccgtaaggtaaggttagggaaacggtaggaaagtaaaacttacgttaaggttagtaggggacctttacggttagggtagggaacggggtaactactttacccgaacctttacgtttaccgaagggaactaaaccgtaaacggtacccaaagttaacctaccgtttagttacgtacttacgtacgaaacgttaacggtacggaaacgtaccggtaccttaacgggaaacccggtaacccccgggtaaggtaacccccgtaacccgggttatttttaaccgggttttagtttacccggtccggttaacggggtcccccgggtttaacccgggttggggtaaaccccctaaaggggtttaaaacccccgggttaaaactttaccccggggggccggggtaaaacccccccgggttaaccgggggtaaacccccgggttttcggggtaaaccccccg

SEQ ID NO: 13228 - DNA, 788 bp, Homo sapiens
  misc_feature: GYAE6OF01ELMXB.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagctgggttttccttgttgccattttagaaggtgccagtgtgaggtgcagcgtgggtgggaggtcggggggaggtcgttgggtccgaggccgtggggggtcccctggacgactcctcctgtgccagccctcgtggtattcctaccttttagtacgtcttcgtttggattcggtaacgtcggggtcccgccgtacggtccgtacccggaaggggaacggggtcgtgggtagggtgggtcggaccctaacgttgaacgccgtaagacgtagggaagtagaagaaattacgttaagtcggtagggtaaccttcggtaggtagggacgggggtaacgtacgtttacccaaccgttaacgtttaccgaaaggtacgaaacccgtaaaccggaacccgtaaaagaaccgttaccgtaacgtttacgttaacttacgttagtaacgtaaagtacgggaacctaacggtcccgtaggtaaccggacccggaacggaccggaccggttacgtttacgtttttacgtttaccgttcggttcgggtcccggttacccgggtcgggtaccgtacggtaaaccgggtaaaacccgttaccgggtaccggggacccggtaacccggggtaaccccgttcgggtaacccccgg

SEQ ID NO: 13229 - DNA, 783 bp, Homo sapiens
  misc_feature: GYAE6OF01EITDK.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaagttggggctgagcgttgggttttccttgttgcctattttagaaggtggccaggtgtgaggtgcagcgtgggtgggagggtcggggggaggtcgtttcgggtccacggtcccggttgggggggtcccctggacgtacttcctcgtgtcgccacgcctcgtggtacttaccgtacctttagtacgtccttcgttaggtattacggtaacgtcggggtcccgccgtacgtccgtacccggaagggggaacggggtcgtagggtagggttcggggtacggcccgtaaacggttaggaacggccgtaaggagtagggaaacggttaggaaaggtaaaacttaacgtaagttaggtacgggttacttacggtaggtacgggtaacggggaacgttacgtttaaccgtaacccgttaacgtttacccgaaaggttaacgaaaccgtaaacccggaaccgaaaacgtaacctacgtaagttattacgtacctacgtactaaacggagaccgtaagccgtaggaaccgacccggacggaaccgtaccggtcgttacgtttacgttcgtcgtcgggtccgtcggtcggtacgacgtaaaccggtaaacgttaccggtcggggaacccgacggtaaccgtcgggtaaccccg

SEQ ID NO: 13230 - DNA, 778 bp, Homo sapiens
  misc_feature: GYAE6OF01AL402.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgtgcctattttagaggtgccagtgtgaggtgcagcgtggtgggaggtcggggggaggtcgttgggtcccaggtcccgttggggggtcccctggacgtacttccgtcctgtcgcgtacggccttcgtcggtacttcctaaccgtttagtacgtcttcgttggattggtaaccgttcgggtcccgtacccgtacggttccgtccggaagggggtaacggggtccgttagggtagggttcggggtcgggtacccgtaaacggttggaaaccgccgaaggtaaggtagggtaaaggtaggaaacgttaaaactaacgttagttagggttacggtaacgttcgtagggtagggtaacgggggtacgtagttcccgtaacctacgtttaccgaaggaacgtaaccaacggacccgtaaaagacccttagtaattacgtaagtcgtacgaactaagtacggaactaccgtacccgtaaggacccggaacccggtaacggacgtaccggttacttgtttaacgttcgttcggtacggtccggtcccggttacggtacggtaacgtaaaccggaaaccgttcgggaccgggtaacccgaacgggtccccgtgggtaccccg

SEQ ID NO: 13231 - DNA, 937 bp, Homo sapiens
  misc_feature: GYAE6OF01D2M6I.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattgggctgagtcgttgggttttccttgttgcctattttagaaggtggccagtgtgaggtgcagcgtgggtggaggtcgggggagtcgttggtccgaggccgtggggggtccctggacgacctctccgtgtcgcgacgccttcgtggtacttccgtaccgttttagacgtcttcgtttggacttggtaacgttcggggtccgtaccgtaacggttcccgtaccggaagggggtaaacgggggtccgttggggaacgttggggggtaccggtacccgtaaaacggtttcgaaacggcccgtaaggaagttaggggaaagtaggtaaaggtaaaagttaaccgttagttacgggttaggtaacctttccggtagggttacggggaaacgggggtaccgtaagtttacccgaaacccgttacttttaccccgaaaggtaacggaaacccgtaaaaccggaacccgaaaacgtaaaccgttaccgtaagtttacgttaacgtttccgtaacggtaacctaaaaggttacgggtaaacgtaaccggtaacccggttaacggaaaccgggtaaacccccggaagggtaaaccccggtaaccgggtttaccggtttacggtttttaaccgtttttccggtacgggtttaccgggtcccgggttacccgggttacggggtacccggttaaccgggttaaaaccccggggttaaaaaacccgtttcccgggggttaaccccgggggtaaccccgggtaaacccgggggttaaaacccccggtttcccggggttaaaccccccggg

SEQ ID NO: 13232 - DNA, 796 bp, Homo sapiens
  misc_feature: GYAE6OF01COX0C.3.59.F04.1.454.CMB.1.raw
  modified_base (263)..(263): a, c, t, g, unknown or other
  misc_feature (263)..(263): n is a, c, g, or t
  modified_base (377)..(377): a, c, t, g, unknown or other
  misc_feature (377)..(377): n is a, c, g, or t
  modified_base (653)..(653): a, c, t, g, unknown or other
  misc_feature (653)..(653): n is a, c, g, or t
tcagagacgcactccacgaccggtgctcgatttagtacacacacttagggattgggggaggtctcagagaggagccttagccctggactccaaggtcctttccacttggtgatcagcactgagcacagaggactcaccatggtaagttggggctggagtcgttgggtttttccttggttcgtcctagtttttaggaagggttggcctaggtgtggaggtgcgagtcgtgggtgggagggtcggggggagtcgtttgggtccgnggtccggtcggggggtccctggacgctccgtccgtgtcgcgacgcccttcgtaggtacttaccgtaacttttaggtacggtcttacgttggagtaggtaaccgttcggggtccnccgtacggtcctccggaaggggacggggtcgtaggggacggttggggttacggacccgtaacgttacgaacgccgtaaggagtaagggaacggtagaacgtaaatacgtatggttagacgtcgtaggtaggaggggtactcgttaccgactactttcggaagaacgaaccgaaccggaaccaaaggtaaacccttgtaacggttatacgttacgcgtaaacgtaaagtaggtaaccacgtacccgtacgggaaccgaacccggtaacggaacccgnggttaacccgttttaggtttactttccggacgggtttcggcccgggttaccgggcggacccggtaacggttaaaccgggtaaccttaacgggggtacccggaacccggttaaacgggggtaaccccgttcgggtaacccccgg

SEQ ID NO: 13233 - DNA, 589 bp, Homo sapiens
  misc_feature: GYAE6OF01CIQ5O.3.59.F04.1.454.CMB.1.raw
  modified_base (502)..(502): a, c, t, g, unknown or other
  misc_feature (502)..(502): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggagtcggggggaggcgttggtccagccgtggggggtccctggagactctcctgtgcagcctctggattcaccttttagtagctcgttggatgaactgggtccgccagtctccgagggaagggctggagtgggtggccaacttgaagccagatggaagtgaagaaatactagtgtaggactgtgtggaggggtacgtattacacctaagtttccaagacgaacaaccgaccaaagaacctactagttacgtatctagacaaatggtaacagtccctagacgaacccggaggaccncggtacttgtttattcgtggttgccggtccgtgggcagttaccggaaaactcggtacggggacccgacgggtaacccgtggtacccg

SEQ ID NO: 13234 - DNA, 624 bp, Homo sapiens
  misc_feature: GYAE6OF01BZVAL.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagcgtgggtgggaggtcggggggaggcttgggtccaggccgtgggggggtcccctggacgactctcctgtgcagcctctggattcacctttagtagtctcttgggatggaactgggtccgccagtcctccgagggaagggctgggagtgggtgccaattgaacgcagatgggaagtgaagaaatactagtggtaggacttcgtggtaggagggggactagttccaacctatttccgaagtacgaaaccaaccgaccaaagaacctacaatttacgtatacctagaacaaagttggaacctaggccctaggaacgacccgaggaaccgacggtcttaggttttacttcgttggtccggcggtaccgtgggtccaagttaccggaaacgtcggtacggggaccgtacgggaaccccgtggtacccg

SEQ ID NO: 13235 - DNA, 945 bp, Homo sapiens
  misc_feature: GYAE6OF01CPGDF.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaggtggccagtgtgaggtgcagctggtggaggtcggggggagtcgttggtccaggccgtggggggtccctgagactcctcctggtcgcagccctctggacttcaccttttagtagtcctcttggatagaacgtggggtcccgcctagtccgtcccgaagggggtaacggggcgtagggaggttcggggtcgggacccgtaaacgtttcggaaacggcccgtaaggtaagttaggggtaaaggttaggaaacggtaaaaacgttaacgtaagttagggtacgggtacctttccggttgggttaggggaacggggggtaaccttaacggtttacccgtaaaccccgtttaacgtttttaaccccgaagggtaaaccggtaaaccccgtaaaacccgggaaccccgtaaaaacggtaaacccgttaccgttaaacgttttaacggtaaccgtttaccgtaaccggtaaccgtaaaaacggttcgggaaaacccgtacgggtaaccccgttaacggggaacccgggaaacccccgggtaaaccggggaacccggtaacccggggttacgttttaaccggttttttaacgttttcccggtttacggggttaccgggtcccggggttacccggttaccggggggtaacccgttaaaaccggggtttaaacccccgggtaaaaaacccgtttacccgggggtaacccggggggtaacccccggttaaaccggggggtaaccccccggtttacgggggtttaaaccccccccgg

SEQ ID NO: 13236 - DNA, 885 bp, Homo sapiens
  misc_feature: GYAE6OF01C2Z3O.3.59.F04.1.454.CMB.1.raw
  modified_base (450)..(450): a, c, t, g, unknown or other
  misc_feature (450)..(450): n is a, c, g, or t
tcagagacgcactccacgaccggtgctcgatttagtacacacacttagggattggggaggtctcagagaggagccttagccctggactccaaggtcctttccacttggtgatcagcactgagcacaggaggactcacagtggaagttggggctgagtcgttcgggttttccttgttcgccttagttttaggaaggtcggcctaggtggtggaggtgcgaggtcggtggggtgggacggggtcgggggggagtcgttcgggtccgacgggtccgggtcggggggtccctaggacgtccgttccgtccgtggtcgaccgcgtccttcggtggttactttaccgttaacgtttacgacggttcctggttaggtacgttacggtaaccgggttcggggtcccgtaccgtcggtccggtaaccggggtaaggggggacggggtcggttacggggngggttcggggtaccggtaaccgttaacgggttacgggaaccggtaccggtaaaggttaaggtaaagggggtaaagttaaaggaaaacggtttaaaaccgttacggttaagttaggggttaaccggtaccgtttggggttagggaacgggggaacggggttaaccttaaccggtacccttaacggttacttacccgaaggaacccgtaaaccggaacgtaacccgtaaaagtcgttacttaagtttgtactacgtacggtaataggtacgaacggtcctacggaacggacccgggacccggaaggtaccccggtaggtttcttaaggttttcgtacggtcgtccgggtccgaggttaaccgggagttaaccggttaacggaaaccgggttcccggggtacggaacccgggttaaccgggtccgttcccggtacccg

SEQ ID NO: 13237 - DNA, 907 bp, Homo sapiens
  misc_feature: GYAE6OF01BFU2L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccataggaacttggggctcgagcttagggttttccttgttgcctattttaggaaggtgcctagtgtgaggtgcagcgtggtggacggtcggggggagtcgttggccaggtccgtcgggggtccctgacgtactctccgtgtcgcacgtcctgtggtacttacgtacctttagcgtacttcgttaggacttacggaaccggttcggggaccctccgtacggtaccggtaccgggaaggggtacgggtccgttaggggtacggtttcgggggtacctaacccgttaacgtttacggaacggtccgtaaggtacggtaacggtaaggttacgaaacggttaaacttaccgttacggttacggtacgggtaacctttacggtagggttacgggtaaaccgggggtaactaccggtttaaccaacccggttcgtttaaccggaaggtaaacccgtaacgacccgtaaacccgtaagttaacccgtcgttaacgttaccggttaacgtaccttaccggtaaacgtaacgggttaacccgcggtaaaccgttcccggtaacggtaaaccccggtaacccggggtaacccgtaaccggtaacggtttcccgttttaaagggttaccctttacgggttaccgggttaccgggtccccgggtttacccgggtaggttaccccggttaaaacggttaaacccgggtaaacccggtttaccgggggtacccggggaaccccggtttaaacccggggggttaccctttcccggggttaaacccccg

SEQ ID NO: 13238 - DNA, 924 bp, Homo sapiens
  misc_feature: GYAE6OF01DVC8L.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagagactcacatggaattgggctgagtcgtggttttccttgttgcctattttagaggtgccagtgtgaggtgcagcgtggtggaggtcggggggagtcgttgggtccaggtcccggtgggggtacccctggacgtacctcgtccgtgtcgcacgtccttcgtggactttccacctttacgaagttaatttatgtactagtcgacctacggtccggggtcccaccgtaggcccgttaccggggacggtaaacgggggcccgggagggttcggggtacggaccgtaaggttttaacgttaacgtttacgtttaagtaggtaaaggtaaggggtaaaaagtacgggtttaggtaaaccggtttaaccgtaacccggtaccgtaaacggttaccccgttcccgggtaacgggtaccgggtaaccggggttacccgtttaaaacgttttaccgtaccggtttaaccgttaccccccgttaacggaaaaggtaaccggtaaacccgtaaccggtttacccgtaaaccgtaaaacccggtaaacccccttaaacccgtttaacttaacgtacccggttaaacgaaccgttaaaaagttacccggaaaacccgtaccggttacccgaacgggtaacccgtaaacccggtacgggaaaccgggtaaccccgaacggttcccttttaaaccgtttaaacgttacgttttaaccggtcgggttaaccgggtaacgggtaaacgggtaaccgggacggggttaaccccggggtaaaccccgggtaaacgttaacccggttaaccccgggggg

SEQ ID NO: 13239 - DNA, 757 bp, Homo sapiens
  misc_feature: GYAE6OF01E5KRN.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctgggtggaggtcggggggaggcttgggtccaggccgtgggggtccctgagtactctcctgtgcagcctcgtggtactttcctaacctttagtacgcttcgttggatcgtaacgtcggggtccgcctagtccgtccggagggggtaaggggtttggaggttcggggtcgacctaacgttggaacgccaggaagttgggaaagtggaaagaaaacttacgtaagttggtaggtacctcgttaggtagggaagggggtaaccgttactttaccgaacccgttaactttacccgaaggaacgtaacccgaaaccgaccaaagtaaacctctaagtttgtaacttcgtagtaactaaagtcgaactacggtaccgtaacggaccggtaacccggacggtaaccgtaccggttacgtttagtttttacgtttcgtgggttccggtcccggtccggttacgggacttaaacggtaaacccggggttaaaaaccctaccggggttccgggggaaacccctaacccgggggtaacccccgttgggttaaccccgtaccccgg

SEQ ID NO: 13240 - DNA, 617 bp, Homo sapiens
  misc_feature: GYAE6OF01CLRST.3.59.F04.1.454.CMB.1.raw
  modified_base (591)..(591): a, c, t, g, unknown or other
  misc_feature (591)..(591): n is a, c, g, or t
tcagagacgcactccacgaccggtgctcgatttagtacacacacttagggattggggaggtctcagagaggagccttagccctggactccaaaggcctttccacttggtgatcagcactgagcacagaggactcaccatggaattggggctgagctgggtttccttgttgccattttagaaggtggccagtgtgaggtgcagctggtggagtcgggggagcttggtccagcctgggggtccctgagactctcctgtgcagcctctggacttcacctttagtagcttcgttggatgaacgtcgggggtcccgcctacggtcctccgaggggaaggggtctgggaggtgggtggcctaacgttgaacgccaaggagtagggaagtgaagaaatactagtagtcggactcgtggtggacggggacgaagttcaacctacgtttaccaaggtacgtaaaccaacgacccgaaagaacctacaagtttagtacgtacctaggactaaatcggtaacacgccgtaggaccgacccggaacggacacggtcgttgtttacttctggtggtcgtccgtgggcacgtacggaaacctcgngggacccgacggaccgtcggtacccg

SEQ ID NO: 13241 - DNA, 846 bp, Homo sapiens
  misc_feature: GYAE6OF01B1PC7.3.59.F04.1.454.CMB.1.raw
  modified_base (188)..(188): a, c, t, g, unknown or other
  misc_feature (188)..(188): n is a, c, g, or t
  modified_base (200)..(200): a, c, t, g, unknown or other
  misc_feature (200)..(200): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccagtggagttgggctgagcgtggtttccttgtgctatttagagtgcagtgtgngtgcagcgtggnggaggtcgggggagtcgttcggtcctacggtccggtcggggggtccctggacgtaccgttcgtccgtgtacgcgtacgtccgttcgtcggtactttaccgtaacccgttttaggtacgtccgtttacgttaggtagttacggtaaccggttccggggtcccggtaccgtacggtttcccgtaaccgggaagggggtacggggtcgttacgggggacggggttcggggttacgggaaccccttaaggttaacggaacgaaccggtaaggtagggttaaagggtaaagggttaacgtaaaggtaaaaccttacggttaaacggttcgggttaacgggttaacccgttgggtttaagggtacgggggtaaacggggttacgttaaccgtttaacccgtaaaccgttaacgttttaacccggaaacggtaaacccgtaaacccggaaaccgtaaccgtaaaaaccgtacctttacggtaattttaacggtaacttaccgttaagaaccgtaagcggtaacgaccgtacgacggaaccgaccgggacgtaaccgtgttacgttcgtttagtcgtggtcgccgggttgacggtacgtaccggtaacggaacgtcgggtaccggaacccggtacggtacccggtccgtacccg

SEQ ID NO: 13242 - DNA, 845 bp, Homo sapiens
  misc_feature: GYAE6OF01A9L9M.3.59.F04.1.454.CMB.1.raw
  modified_base (313)..(313): a, c, t, g, unknown or other
  misc_feature (313)..(313): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatgggaattggggctgagctgggttttccttgttgcctattttagaaggtggccagtgtgaggtgcagctgggtgggaggtcgggggggaggtcgttgggtccaggccggtgggggggtcccctggacggacctcgtcctggtcgcagccctctggtacttccgtacctttagtacncttcgttggatgaacgtcggggtccgcctagtccgtccgaagggggaacgggggtcgtaggggtaggtcgggggtacggcccgtaaacgttggaaacggtccgaagtacggtaggggtaaagtaggaagtaaaattactagtacgggttaggaaccttcggttagggtagggtaacgggggtaaccgttaacgttaccgtaacccgttacgttttacccggaaggtaacggaaaacccgaaccgtaacccgtaaacgtaaacccttacgtaagtttacgtaacgttcctaggtaacctaaaagtcgggtaacctaaccgggtcccgttaagggaaaccccggtaaaccccgggaaggggtaacccgtacccgggttaccgtttttaaggggtttttaccttttcggtacgggttacgggtcccgggtaccgggttacggggaccgttaaacggttaaacccgggtaaaaccggttccgggtaccgggggaaccccggtaaaccggggtaccccggttacgggtaacccccgg

SEQ ID NO: 13243 - DNA, 701 bp, Homo sapiens
  misc_feature: GYAE6OF01C2ADL.3.59.F04.1.454.CMB.1.raw
tcagagacgcactccacgaccggtgctcgatttagtacacacacttagggattggggaggtctcagagaggagccttagccctggactccaaggccctttccacttggtgatcatcactgaacacagaggactcaccatggagtttgggctgagtcgttgggttttcctcgttgcttacgttttaagaggttgtccagtcgcccgaggtgcgagcgtgggtaggaggtcggtgggggaggcggtggcccaggccgtggggacggtcccgaaggtaacctccgtccgtagtactagtctcgtggtacttaccgtaccgtttaggttactagtgtactagtcgcgtacggtcgggtcccggccggtcctccgaggcgaggggtctgggaggtgggtagcgtaagttaacgtcgtacccgtagtagtacgtagggacgacgtaaaggttaaacgtcccgtacgaacgacggtaacccgtccgggtaaacgggaaccggtacccggtacttaccaacccgtatcccgacgtaaggaaccgtaactaaacgttaaccaaacgtaaaccgtacgtacgtataacgtacgtagaaactaagtaacgaactacggacgtagaacgagtacgacggtaacgaccgcggtacgtgtagtacgttacgaggtcgagagaggtgtaggaggttacgggtacgaagttaacggg

SEQ ID NO: 13244 - DNA, 834 bp, Homo sapiens
  misc_feature: GYAE6OF01A0YDJ.3.59.F04.1.454.CMB.1.raw
  modified_base (275)..(275): a, c, t, g, unknown or other
  misc_feature (275)..(275): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtgccagtgtgaggtgcagctgggtggaggtcggggggaggcttggtccagccgtggggggtccctggagacctctcctgtcgcacgcctntggtattctacctttagtacgcttcgttggatacgaacgtcggggtccgcctacgtcctacccggaggggaacggggtcgtggggaggttcggggtacggtacccgtaaacgttaggaaacggtccgaaggtacgtagggtaaaggtagtaaagtaaaacttacgtaagttcggtacggggactttcggtagggtaggggaacgggggtaacgttaacgttacccgtaaaccccgtttaacgttttaccccggaaaggtaacccgaaaaccgtaaacccgggaacctaaaacggtaacccttaccgttaacgttttaacggtaacttcccgttacgaaacgttaaaaggtacggaaccctaacggtacccttaacggggaaaccggtaaccccgggaaacggtaacccggtaaccggttaccgttttacggttttaacgtttccggttaggttccggtccggggtaccgttcgggggaccttaaccggtaaacgggtaaacccgttacgggtacccggggaacccgtaaccggggtaaccccgttggggtaacccccgg

SEQ ID NO: 13245 - DNA, 795 bp, Homo sapiens
  misc_feature: GYAE6OF01BULY0.3.59.F04.1.454.CMB.1.raw
tcagagacgcactccacgaccggtgctcgatttagtacacacacttagggattggggaggtctcagagaggagccttagccctggactccaaggcctttccacttgtgactcagcactgagcacagaggactcaccatggaattgggctgagctgggttttccttgttgccattttagaaggtggccagtgtgaggtgcagctggtggagtcggggggaggcttggtccagccgtggggggtcccctgagacctctcctgtgcagccctctggacttcaccttttagtagcttcgttggatcgaacgtggggtcccgccgtagtccgtccgaggggaacggggtcgtacgggaggtcggggtcggacccgtaaacgtttggaaacgccgaaggacgttaggggaaaggttaggaaaggaaaacttacgtaagttggtacgggtaaccttcgtagggtagggtacgggggtaacgtaagtttaccgaacccgttacttttacccgaaggtaacggtaaccaaaccggtaccgaaaacggtaacctaccgtaagtttacgtttaataccgttaggaacctaaacggttagggaaacccacgggtacccgttagggaacccggtaaccccgggtaacggtaacccggaccgggttactttacgggtttttaactttccggtacggttcggtcccggttaccggttgggggaaccctaaggtaacccgggtaaaaacccgttccggtaccggggggtaacccgtaaccgggggtaaaccccgttcggggtaacccccgg

SEQ ID NO: 13246 - DNA, 862 bp, Homo sapiens
  misc_feature: GYAE6OF01C6TFU.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtgccagtgtgaggtgcagcgtggtggaggtcggggggagcgttggtccaggccgtggggggtccctggacgacctctcctgtcgcacgcctcgtggattcctaccttttagacgtcttcgttaggatcggaacgttcggggtccccgcgtacgtccgtaccggaaggggacggggtcgtgggacgggttggggtacggacccgtaaacgttacggaacgacccgaaggtaaggttagggtaaaggtaggtaaaacgtaaaaagttacctaaggtttacggtacgggttaaccttacggttacgggtaaggggtaaccgggggtacgtaacgtttacccgaacccgtttaacgttttaacccgaaacggtaacgtaaacccgtaaaccgaacccgtaaaacggttaacctaaccgttaagtttacggttaactttaccgttaagtaacctaaaggttaacggaaccgtaaccggtacccgttaacggtaaccggaaccccggtaacgggaacccgtacgggttaccgtttacggttttttaaaccgtttcggttacggttacgggcccgggttccggttaacggggtcccgtaaaacggttaacccgggttaaaacccgtaccgggttaccgggggtaccccggaaaccggggttaaccccggttcggtaacccccgg

SEQ ID NO: 13247 - DNA, 895 bp, Homo sapiens
  misc_feature: GYAE6OF01BGL4S.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgtggttttccttgttgcctattttagaggtgccagtgtgaggtgcagcgtggtggaggtcggggggagtcgttggtccgaggtccggttcggggggtcccctggacggtaccgttccttccgttggtcgcacgtcccgttcgtggtactttccgtacccgttttaagtacgtccttcgttaggtaacttacggaaccgttcgggggtcccgacccgtaacgtcccgttaccggaaacgggggtaacggggtcgtagggaacgggttcggggtacggtaacccgtaacgtttaggaacgcccgaagtagtagggtaaagtaggtaaagtaaaagtacgtaagttcgggtaacgtacgtttcgttagggtacgggtaacggggtaacgttaccgttaccgaacccgtttaacgtttaccccgaaaggtaacccggaaaccgtaaacccggtaaccgaaaacggttacccttaacgttaacgtttagtaactttaccgaagtaactaaacggtcggtaaaccaaccggtacccggtaacggaaacccgggtaaacccgggaggtaaacccccgtagggtttaccgttttaaccggttttagttttaccgggtaccgggttacgggtccccgggtacccggttagggaaccccttaaggggttaaaacccgggtaaacccgttacccggggtacccggggaaaccccggttaacccgggtaacccggtttcccgggtaacccccg

SEQ ID NO: 13248 - DNA, 761 bp, Homo sapiens
  misc_feature: GYAE6OF01B4938.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcacatggaacgttgggctgagcgttgggtttcctgtgctagtttaggagtgctagtgtgaggtgcagtcgtgggtggaggtcggggggagtcgtttggccgacggtccggtcgggggtcccaggacgaccttcgccgttgcgcacgtcctcgtggtactcttaccgtttagacgtcttacgttaggtacgtaggtaaccgtcgggtcccgaccgttacggtccgtacccggaggggaacggggtccgtagggtagggtcgggtaccgtaccgtaacgttacggaacgtaccgaaggtaggacggtaagagtaagtaaagtactagtacgtagtaccgtgtacggagggtaacgggacgtactacgtaaccttagttaccgaagaaccgtaacgaaccgtaacgaaacgtactacgttagtatacgtaccgtaagaagtaaccggtaacgtacgaaccgttaccggaagacccgaaccgggagacccggtaagttcgtttaacggtttacttcggtaccggtcggtacccggtacggtacgggtaccttaaacgggtaaaccggttaaacgtaccggggttaacccggggaaaccgtaaccccgggttaacccggcggttaaacccccgg

SEQ ID NO: 13249 - DNA, 878 bp, Homo sapiens
  misc_feature: GYAE6OF01B7BDQ.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcgttgggttttccttgttgtcctattttagaaggtggccagtgtgaggtgcgagcgtgggtggaggtcggggggagtcgttcggtccgagcccggtcggggggtccctggacgacgttccgtccgtggtcgtacgacggtcccttcgttacgggtatttacccgtacccgtttttaaggtacggttccgttccgtttaggtaagttacggtaaaccggtttccgggggtacccgcccgtagtttacccggtacccggaacggggggtaaaggggtcggttagggggtacggttaggggggtaccgggaccgttaaaccggttcggaaacgtccggtaaaggtagtaaggggaaaggttacggaaaaggtaaaacttaacggtaagtagggttacggtacgttaccggttagggtggggtacggggtaacggtaaccgttaccgtaacccgtttaacgtttacccggaaagaaccgaaaccaacccggaaaccaaagtacctaacttaacgttaagtacttaccgtagtaacgtaagtacggaacaacgtccgtacggaaccggacccgggaaggaacccgtcggttacctttaggttttaacgttcggttaggtcccggtcgggttcccggtaacgggtaccgtaaacggttaaacccgggaaaacggttcccgggttaaggggaccccgggttaaacccgggtacccggttccggtaaccccgg

SEQ ID NO: 13250 - DNA, 787 bp, Homo sapiens
  misc_feature: GYAE6OF01CMVL8.3.59.F04.1.454.CMB.1.raw
  modified_base (208)..(208): a, c, t, g, unknown or other
  misc_feature (208)..(208): n is a, c, g, or t
  modified_base (270)..(270): a, c, t, g, unknown or other
  misc_feature (270)..(270): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggnggaggtcgggggagcgttggtccagccgtggggggtccctgacgactctcctgtgcagcctntggtattcacctttagtagtctgttcggatgaacgtgggtccgccagtccgtccgaggggaagggtctggagtggggtcgcctaacgttgaacgtccaggaacgtgggaaaggtagaacggaaattaactagtaggtacggtaactcgtaggtgggaaggggtactagttacctacgtaacgttttaccgaaggtaacgtaacccgaaaccggaaccgaaacgtaacccgtacttaaattttacggtaacgttccgtttaacggaacttaaaaggttcggaaacctacggccccgttaagggtaaccggaaccccgggaaacgggtacccgtaacccgggttacgtttaacggtttttaacgttttccgtacggggtttacggtcccggggttacccggttgggggttaaaccctaacgggttaaaaccccggggtaaaaaccgttacccggggttaacggggggtacccccggtaaaacccggggggttaacccccgttaggggttaacccccccg

SEQ ID NO: 13251 - DNA, 629 bp, Homo sapiens
  misc_feature: GYAE6OF01BZC52.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgcctattttagaaggtggccagtgtgaggtgcagctggtggaggtcggggggagcttggtccagccgtggggggtcccctgagactcgtcctgtgcagcctcgtggattctacctttagtagctcttggatgaacgtgggtccgcctagtcctccgaggggaacggggcgtgggaggtggggtcggaccaagttgaacgcagagtaggagtgaagaaatacgtatgtgactcgtggtgggagggtacgattaccacctacgtttaccaaggagaaccaaccgaccgaaagactactaattgtatctgaacaatggactagaccgtagaccgaccggagaccgacggtcttacgttttacttcgttaggtcggtccgggttaccgtgggtccgtaacggtaaccggaaaaccggttcgggtaccggggacccgtaacggggtaccccgtggttacccccgg

SEQ ID NO: 13252 - DNA, 544 bp, Homo sapiens
  misc_feature: GYAE6OF01D3QOS.3.59.F04.1.454.CMB.1.raw
  modified_base (312)..(312): a, c, t, g, unknown or other
  misc_feature (312)..(312): n is a, c, g, or t
  modified_base (472)..(472): a, c, t, g, unknown or other
  misc_feature (472)..(472): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggagcgttggtccaggccgtggggggtccctgagactctcctgtgcagcctctggattctacctttagtagtctcttggatgaacgtgggtccncgagtctccgaggggagggctggagtgggtgaccaattgaagccagagtggaagtgaagaaatactagtgtgactgtgtggagggacattcactattcagagacaacgacaagactactatgtatctgacaagtgacagcgtagacgaccgagacacgtntgtttatcgtgtcgcggtctgggaccagtaccggaaactcggtacgggaccgacgggtacccgtggtacccg

SEQ ID NO: 13253 - DNA, 821 bp, Homo sapiens
  misc_feature: GYAE6OF01DNBD9.3.59.F04.1.454.CMB.1.raw
  modified_base (252)..(252): a, c, t, g, unknown or other
  misc_feature (252)..(252): n is a, c, g, or t
tcagagacgcactccacgaccggtgctcgatttagtacacacacttagggattggggaggtctcagagaggagccttagccctggactccaaggcctttccacttggtgatcagcactgagcacagaggactcaccatggaattggggctgagcttgggttttccttgttgcctattttagaaggtggccagtgtgaggtgcagctgggtggaggtcggggggagtcgttggtccaggccgtgggggtcccnggacgactctccgtgtcgctacgcctacgtggaactttccgaaccttttaagtacgtcttccgttggaactggaaacgttcggggtacccgaccgtacggtccttacccggaagggggaacggggtccgtagggacgggttaggggttacgggaccctaaacgtttggaaacgtccgaagaagtagggaaaagtggaaagtaaaaactactagtacgtaggtaaccttcgtagggtggtaaagggggacgtaagtttaccaaccgttaacttttaccccgaaaggtaaccgaaaccgaaaccggtaaacccgaaacggtaaaccttaacgtaacgttttacgtaacttaccgttagaacctaaaagttcggaaacgacggtacccgttagaaccggaacccggaaacggtaaccgaccggttacgtttacgttttaacgtttccgttagggttaccggtccgggtacccggttacggggtaaccttaaacggttaacccgggaaaaaccgttaccgggtaaccggggacccggtaaaccggggtaaccccggttcgggttaacccccgg

SEQ ID NO: 13254 - DNA, 594 bp, Homo sapiens
  misc_feature: GYAE6OF01EFN6Z.3.59.F04.1.454.CMB.1.raw
tcagagacgcactccacgaccggtgctcgatttagtacacacacttagggattggggaggtctcagagaggagccttagccctggactccaaggcctttccacttggtgatcagcactgagcacagaggactcaccatggaattggggctgagctgggttttccttgttgccattttagaaggtggccagtgtgaggtgcagctggtggaggtcggggggagcttggtccagccgtggggggtccctgagactctcctgtgcagcctctggattccacctttagtagctcttggatgaactgggtccgcagtctccgaggggaagggctggagtgggtggcctaacgttgaagccagagtggaagtgagaaatactatgtggactcgtgtaggaggggacagttcacctatttccaagagaccaacgccaaagactacattcgtatctacgacaaagtggacgtagccgtgacgacccgaggacgacggtcttagtttactttcgtagtcggtccgggtcccgtggggtcctaagtaccggaaaaccgttcgggtacggggacccgtaacggggtaccccctggggttaccccg

SEQ ID NO: 13255 - DNA, 797 bp, Homo sapiens
  misc_feature: GYAE6OF01ECZUT.3.59.F04.1.454.CMB.1.raw
  modified_base (366)..(366): a, c, t, g, unknown or other
  misc_feature (366)..(366): n is a, c, g, or t
tcagagacgcactccacgaccggtgctcgatttagtacacacacttagggattggggaggtctcagagaggagccttagccctggactccaaggtcctttccacttggtgatcagcactgagcacagagactcacatggaagttgggctgagtcgttgggttttccttgttgcctagttttagaggtgccagtgtgaggtgcagcgtgggtgggagggtcggggggagtcgttcggtccgaggtcccggttcggggggtcccctaggacggtaccttccgtccgtggtcgacctacggtcccttgtggtactttccgtaaccttttaaggtactcttcgttaggattcggtaacgttcgggtcccnccgtacgtccgtaccggaagggggtaacggggtcgtagggtagggttcggggtacgggtacccctaaaggttaggaaacggtccgaaaggtaggttaagggaaagtaggaaaacgtaaattacgtaagttggtacggtaacttggtaggtaggggaacgggtacgtagttaccgtaccgttaacgtttacccgaaagtaacgtaaaccgaaccgaccgtaaaacgtaaccttacgtaagtttacgtaactacgtaacgtaacgtaaagtacggaaccgtaccgaccgtaacggtaaccggtaaccgaacgggtaaccgtaccgggttatttaacggttttacgtttcgttacggtcggtcccgggtgtacgggtactaacgggtaaacgtaaacgtcgggaacgggaccgtaaccggtccgtcggtacccg
